United States Patent 11,337,426 (BIOLOGICAL CONTROL AGENTS AGAINST FIRE BLIGHT) - sequence listing, part 3

SEQ ID NO: 17 - DNA, 203764 bp, Pantoea agglomerans NY60
tgccgggcggtaacctggtggcggtctgcgcaagcggtccgcgtcagcagcgagaatttaaggatattgcgacgcatcaggaagtgctgccacgcggggcgttcgcatatacggacgtttcaacaatgattgtccgcattcatgcctgatcgcctgccttaccggcttcgcgccagcggggccggattagtgccgccagctgaggccgcaaacgtcaacgtcggataataacggctgcggcggctgcgccgccacggcggatactctccctttgcctgcgctttctctctccgggacgctgtctcaccgtcttctctctctgctttatgctgctgtctgttctgctgccatgctgcagctgcttctccggtttcctttccataaaggtcaaaagcatgaacagcctgatggccccctccggctccccggcgttgccgggtcgtcagcccaactgcgctaaccggctgtgccggtaagctccgccgaatccctgcggggttcgggcctgccggctagggtctgatggctggtttaagcattatgagaaacgataaaattacaatccatattcctagaaagaaaagaagtcgagagtaaataaattttataaatagggagcgtttattttataattgataagcatctttttaaaatttcttcattagaaattataattaaatttaaacgctttcgggtgcgggttatgttttggaaaaacatcttgattggattgtaatatgtatagccagagtaaattagtttgccatttccattgtatttaaagtgtttatcaatagttactgcgacattgtcaaattcttgcccgataatttcatgtgattttttatgtgtgaagtaagagtaatcttcgtggtgttcattatcatattgagaaggagtgaatcgtagaacttcccattcatgatgatctaagttgtaaagataggatcttgcatcatcaaggttattaaaatagttgataacgatgtttccagaactaacctgatccaatgaggtgtttttattaaataacattttaataaagcttgcgatttctttgttggatcttattttttcagataaattgaagatgcaagtatcgcagctcttaacaataacttcattaactccgctatattcttcgccccgcccaagagtttgaagcttatcataagaaaaaatacaggttgttttattagacttgacagaggaaattaaattaattagctgatcagccttaatacgctgagcttcatctaccaaaattgtatcaaaatgggttaaatcagtagataaaagcatcttaatgcctataatgttccagccgagctcttttaaacggtgatggcccgcattcaaatttccacaatgaacaactaaaactttatgaccttcagataaaattcttttcacaacatcataaaccagaagagtcttgcccgttccggccgcgcctgtgacagatatgaaatttgcatttaaagatgtggaaatgatttttaagatattatctttgaattcttcttgttgatgagtgaggaagtaaaggttgttaataaatttatcagtggagttaaaaggtgaaactagatagtcagaagggttaaataaattgtctatgttagtgtttaggctgtctgaatttttaattaaggcgtcaataacacacttaatatctgtctcagtaagatttgaatttttatcgagataataaaggctctgcgtgtcagaaacatagctgaatgtgaacactgccttcccgataaagcttaagtaataacggtttcgttgtaattggtttctgatcttttcaggtgaacttgttctctttaattcaatattaatgacagcgttgcttcctattttgagtaaatcaaattctttacctatttgaggtattttatagccaacataaaatccactaaacaaacatggattatcatcctcattacataagcattctagtaatttttttagatcctgaagctcggcgttttttatttgtatgccatagtggcttttaaaggctttaaagtcatcatcagaaagtgattcatagccttgaattaatgataaaatatttatacttttcacaaaaggattccattcaggtttttatttattgttagctgcgtaaattaaagtggcgtatttcatggcgttttaactacatatattaaaacaatttacacctaacccagatatttatcaattcccaacttaaacacgttatagataaatttgttaactataaaatggccccctccggctccccggcattgccgggtcgtcagccccactgcgctaaccggctgcgccggtaagctccgccggaccgcgaagcgttccgtgcctgacggctaaggtctgatggcaacgtccaggttaacccctgcaaccggctggcgccagcgcgttcactggccacaaaaagacgtggccgctgaggaccggaccggcaccgtgatgtgccgttccggggctgggccctgttcatccttccgcattctgttttgttctcctgagccccttcgccgtgcagaaacctggcacccgggcgccttcacgcaagggtcgcgcgctaaacggctgcacccggtcccttcgggctgcggctttgccgtttccccctgcgttcagcctgatgcccgcgcgcctgttctgccctcacggcgaggaactcagagaaacatcacttaaaccacacgggagaaacaacatgtcacagcagaaacgtcaacaccacggcttcagaatctaaagaatcatcttctttaaagacaaaaaccccgcgtcgtcccgcgaaagcgaaagcgcacaaagtcgcggcggaggcagtagagcaggcgctggaaaaaatcgacatcgaaatgatcccgctttcacgcctggcgatttcgcccctgaacgtacgcagtaaaatttacgtgcagtcgcgtattgagtcgcttgcggccaccatcaaaaacgtcggcctgctgcataatctgattacacacgatatggctgacgggatgctgggtgtggcctgcggcggtcgtcggcttaccgcaatgcagctgctgctgtcacagggtgtttatcagcccgatcagctgatcccggttaagcgggtgacggaggagctggcgcgcgcggcctcgatggtcgaaaacggcgagcgcgaggatatgcaccccgccgagcagattgccggtttccgggcgctgtcagaggagggcaaaacaccggcgcaaattggtgacctgatgggctacagctcgcgccacgttcagcgctgcctgaagcttatcgatcttgatcctgccatcctggacgagctggccgccgataacattacgcttgagcagtgtcaggcgctggcgctggctgatacgcacgatcgccagctggaagtatgggagcaggcctccgggtactacaacgcctccgctgaagtcattcgcaagctgattacctcctccgagacggcgatcagccactctccaaagtttaccttcatcggcaaagacgcctatctcgcggcaggcggcaccattcgcaccgacctgttcagctgcgacgacgagggctacatcgatacggcgctggtcgagcagctggcgctgcataagctgcagcaaattgcctatgccgtgcagagtgaggaaggatttgcctgggcggaagtcaggatggatagtcgcctgcagagctggagtagcgaggtgaaaaaaacctatcacctgatgccggagcactgcccgaagctgacgacggaagaagacgcagagctgagcgagctgcgggcacagttgaagctttcagaagacgatgcactggacgtgacactgagaaagaaaatcgccgccctggaagaaacgggcctgaagcgcagctgggcgaacgcggacaaggataaggtcggggcaattgtttgcttcgagcgaggaagctgcttcattcagcgtggggttcagcgtcatgccgatttacctaaaaaagaaaaacccgaaaacaaaggcgatctgcagaccctttccgaagactattccgcgacgctggtccgctcgatgtcctgtgagcgttcgctggccgtgcaggcggcgctgagcacggagccggaaatcgcgcttgccatgctgacctggactctgtgccgcagcaccttcagccataaaagttatgaggggaccccgatgaaaatcagcctcacggataacagcacggcgctggttaccggaacggttgcgaaggaggagacaaaagcctggcggtttcttcaggagcagaaagcgcagtgggaggcaaagctccctgaaaactggtcgcaggacttccgctggctgatgggctggagcacggacgagatactgcagctgcagggattctgcagctccacggcggtgtgctgctttcaggatcgcatttatggccgcagccagacaagcaacctcgatacgctggaaacggcgctgggctttgatttggcagagtggtggcagccgaccgctgagggtttctttaagcgcataagcaaagagcagattaccgggacgctgacggaggcaggcaaaacgggcaacgccagcgacgcggagaaaatgaagaaaggcgacgcggctgagtttgccgaaggggtcatgaaggactcccgctgggtgcccgcgtggatgaaacctctgcggcctgcggcagtaaatgacagcgcagacgacacgggcagcgaaggctgacagcgtcagaccgcccttcggggcggtcattaaagacaaggagaaatcccatgaacatgatcccccgtcatttatcgctcgttcccgcctgcccgtatacccttgcggtcagcctggccgtcgccgaggttgaaaagcgcttgcagggcagggcaacgtgcggtgcaaacccatacgccagcgcattcatgcgccattactgcgggacgcgcaccattagggccgatcagctgcgccgggttatgcccgaatactcgccaggcgatcgtgccgcgccacccgcgcgggagtacctggccgcgctcgatacgcttatcgcctcacgcggcgagcgctgcccctcgccgctgtcgcaggatactggctcaaggttgtttcctctgaccgccgcccgtttcactgagcgacgggaaaagcggctctcactgcgtcagaacagggaatataaccgggaatcccgtgagcgcgaacagaagcgcagacgttatcaaaaccgcctggcgcaggcggcgctggagctggtatttcatacgccgcagacggcagggcgctggtacgttcactggcagggccgggacatctatgaaagcgatctgcagtcgctggttctgacctggctgaagcgatttgtgtcatgcaggcatatcgatccgtgggagtggcatgacgaaaccgttgtggcgcgtgatgctcgacatcagcattctggccggtgaaatgagcgccttcagtagaatgactaaccggttctcgctgcctgtgctgctaacgtgccgaccctgatcctgttaagccgggcgcatcgtgtccggcttgttgcctgcatcgggtgccgctgaaaagcggacggccctgcgggccgggaaaagccggtgctgacgcaccggccatctcccttcgcctgcgctttctctctccggcacgctgtctcatcgtcttctctttctgcttactgctgatgtttgttctgttgccatgctgccgctggttctccggtttcctgtccctgaaggtcaaggtcatgagcagcctgatggccccctccggctccccggcgttgccggctcgtcagccctactgcgctaaccggctgcgccggtaagctccgccgaatccctccgggtttcgggcctgacggctggggtctgatggcaacgtccggtttagcctcatcagattgctcacattccgctattagcgaaaaggacatatacgattagtaagttttcagcgtcactaggttgcattgcgcgacaaattgtcgcataatcttgtctgtagtgcgtcaaatactgacgtatcgattgaaaccaccccaatacctaactggcatgggtgactacatcatgaggtttaaaatggcaacaagcatccgcttagatgatgattttgttgaagaagtgaaaacacacgcagacgcaatgagtcgtagcgtgcccaaacagattgagcactgggctaagattggccgcattgctgaggacaaccctgatctgccgttttccttcatcaacgaaatcctgctggcgaaatcagaaatggataacgggagaatgaagaaatatgtgcgcagaaaagacaggtcaggaaattgatgtttaccagtcaagtcgttttgagaaggcctttaaccgcctgaaaaaagcggaacaggacaatgttgatgaagagattgaccgcatcatcgcaaatccggagataggagagcgcaagaagggcgatcttagctatctgttggtgcataagttttacatggggaagcagcaatacctgctcggctacacttggctggaccaaaaactggagatctatctcttgagcctgggaacgcacgagaattactatgacgagcaaaagcggcatcggaaagccgacctgaaactaatcgggtaaagtctagtaagaagaattatttttacaacagccacatattctatgattccctcattaatgagggaactattcaagtaaatctttttttccatagtctaaaatcccagcgccccttctcaccatctacttaagttattacggcccgtattccccgtatttgacctacttactgctaattaatttagtgtgtgggatccatcgattgaactcacagcacaaagcagacattaacatctacatcatgatagccccctccggctccccggcgttgccgggtcgtcagccccactccgctaaccggctgcgccggttagctccgccggaccgcgaagcgttcctggcctgacggctaaggtctgatggcgaacggcaaaggtacaaagcggacaagctaactgagctgaggtccgctatgagcgagaagcggacgttagcccagaaaatatatgagcagtagaagcggtcagaaagagtctagactggctgtgaagattctctaccggcacgttagtttcagtactcttggaaaagatgcggtagcaaaccttgaaacattgcaaaggatttatccgataatatcccttaatacagtagatcaagctgttcaggttcactgataagacggggcgttccctgtttgttcgtatcaaagagggcctgatagcgcactgaattaatccccatgaccagattatcgaggtcggtattggcaatacgcactgagtgattcttcgcccaggcgggcagggcatagatataataggtgaaggtcacataagtaacgcctgtgtgatctgttgagatagtccttatggttctgacacgcatggttccatagcagaaatcatgatgctttatgaacgaagcttgaccgtatggggtcagctcccagatttttcttcctgctttcacatgagaagtaatcaggccggcatcaacaagcgcctccatttttgcattaatccaccggtcggtacctgttctgattgaaaccggccactgcttttcacccagacaaagagactgccgattaagtgactgctgtataagctcacggtactgacttttgtatcccgcacaacagcagaacgacaggaaaaaaagcaaaagccctgtgatacatttcaacgaaatttctccatatccagaatctgaaaagcttcattcacttcatcaaaagtatgttcagtgagataaattcctgccggatcccagtaaaaaacagacgtcccgggatcctcgttattttcctccagccggaatcgtgaaaacctgactcgcgttttatcggtaaggtctccgccaccggcgctgccggcatatttgacagccctgataaggtaaacccgccctttatagcggtgaagttctgtgccgcttatcttaagggcagatgctgacagtcttaaatctgcccacgtaaagccatcgtcgtccggaaaccggtacgataaaccagttttttccctgtctgataaagacgttgagggtctcactgggatgagaagtgttattgtcataagtggcggaaaagacggtgtcgggtatgccatcaccattcaaatcaatgctgttcagccccttattcaggtgaacgcgggtgtctgcctgtgatgaagccggaaggcttatcagaatggtcgtcagcataataaaaggcatcttcaggttcaaaattttcgcaccagtctgaagccggtgtccggcagggcgtatccggcactgtgcgtgtcgcagctggtcagactgcccgtatgcaacaagaagctgccgccgcaaaaatagtacattttcacaccggaaagggtgtcgaaagcatcaacccattccgaaacgttaccgctcatgtcatacagaccgagcgcattgggccgcaggcttttcactcggacagagccgaaatgcggatcgttgaagtcagggaaccaggcgacagcatttgcgttgttgctgccagcaaatctgaaaccatacgagccattttccagtccggcctttcctccacgggcggcaatctgccattcctcggccgtgggtaagcggtaaccattagcccgggcatccagggtaaattcgtaacgggaactgtcgcgtgccgggacgccattattattgagatagactggtctcagccctgccttttcactcagagcatttgcaaaaatcaccgcatctgaccattcaacactggtaaccggatgtgcaccgttgtctgtatccgccggccggcagtcctcgtaagcggctccgttacatccgacaccgaatacataaccacgctcaacagcccattcgtgaacatctgaataaagccggtaggtaatttcagtacgcatgatccagaaggtattcagcgtgatgttggcgtgtgctgcatagtcatgttggccaaaaacgttaccggcataatatctacctccggccaccacgatttcatcaggggattgtgttgcagcggcaaaggcggaaaagacagacagcagaaagaggattttatttttcacagagccatcctggctgattgatatgggcattcacatagctgatttccagcatcgccagactttagcaaccagatggatttaaagttagaaatattaagtaagtaagttctgaaattccgtacggcaatacctgactttcagccctcttatactgactgaccggtacaggctgtaagctgcaattcaacagtatcttcactgacagcttgaaattgccattaaaggggcatagcaggaaaactgccaatgtccgcttctggcacaaagcggactaacacgttggcccatgtccgctatgagcgaacagcagacgtttttttccggcgtaatagtctttcgggatgaaatgtctgatttggggttatatctgtgattgccataatcgcactgatctacggcatgaagaagggttcaggaagagtaaaaccgggctggtcagcattctgagcagcccgctaaaactatttcagatgctcgcgaagcagactacccgcctgagtcagtgaggcctgaacttcaggaacttcggcgagagcattcagcagtccgtaatcatgtatcatgccgttataacgcacctgaaccacgtccacgccggctgcgttaagcttacgggcgtaagcttccccttcatcccgcagcacatcgttctctgccgtctgtacaagcgctggcgggagacctttcagctgggtttctgaagcacggagcggtgaagcgtatatttcattgcgctgcgcatcgctggttgtgtaattatcccagaaccatttcatcatattccgggtcaggaagcgctttgtcgcatatttttcgtaggaggctgtgtcaaattttgcatcggttaccggccagaacaacacctggtaacgcaggtcaggtccgtgtttttcttttgccatcaggcttaccactgccgccatgtttccgccaacgctgtttcccgcgaccgcgaggcgcttaccgtcgacactgatttcatcgccatgttcagcgacccactttgtggcaccgtaggcctggtttatggcaaccggatagtgtgcttccggactgggggtatagtttacaaagacggccaccgcaccggacgcaaggaccaggtcccggaccatgcgctgatgcgtcgggaaatctcccagaacccatcctcctccgtggaaaaacataaaggccggcagctttcctgaggcattttcaggcctgacgatggtcagtttctacgggcttaccatcgacctgaatggttttgtttgaggttgtcacgccggagaggtcaactttcactgaagactgtgcaccggacagaaccttgcgggcttcctccggcgaaagtttctcaatgggttttccattaccgctgttcagctggtcaacgaaagactgcgtgtgatgctccagatgaacatcgtttgaggccgcgccggccgcactcatagccagaaaaatactgctgctaatcagggcagaggtcactttattcatgatatatccttaacaattaactgtatcaggtcagtgaaaaatcatccgtacgaatccaggtgatgagacctgattatagtttaaatgccaaatagagcctgattttaaggtgtttttttgttgagggtatgaaaatatggagaggatgaatgtcacaaattaaatgaaaatattttatatattttggattgcggagccaaatttagtcaggcctgaaactgaagaatcacttgcgtccagcttcagggcagccactgcagtgccgggctgtcaacgtccgcttctggcacaaagcggactgacggcaggccagggtccgctatgagcgagaagcggacattttgtacagaaatcattctacgcatgttcaaccaaaaccgcgcagccgctataagagggcttttaactatcccgcatcagaagcccttcagcaacgccacacgccgacatcactgcgcaaaaagcaatactaaacaacctcacagcgaggcgctcagacacgaataaataataattagcaccccatcacgcctgcccacttcagagatgggttttaatgcagtggcattatgtgctctaaccagcctcagagctggcagagcataatagatcagtcatttcggattacatgcaaagaaatgtagcttatttatgcatccagtttacgaatcagcttgccgtcatttttatcgaaagatactatcttgtagttatggcctttcaatgcatcaacaagcacactctcttcctctgatgtcgcaaaaattatttgtccactacttgaagccgatctcgccgcatctcttaataactctgcaaaactcaccttatttgcttcttgctggcgtggctcatcaaatataaccaccccaggatgatttgtagaatatgctctactaacagagaacaagcttaacaaatacccccagataattcttattccgtcgctagccgaagtgtcaaagccaatgtcatagccctctctagtagggaggtatgtatcttctgagatgctaataagacttgcagcaaagctggtgaaattatacttattaagtctatttaccattccggactttagtagattcaatttttcaacatctttagctgagagtacgctctgcggcagtgcttttcttttagaattaagtttgacgtattttgcatgcaaagcatttaattcaagttttatttcagccagtgccgcataggcattggttatattatcaattgaattttctaaatttatttttcttctcaaaatatcttcttgtaaggcaagtgatgagtcatctcttttctttagtctatttatatcgacttttatggcggcgattgtctcttgtgtttttatctgctctgatgttttaaatttaagttggtttttgctatcttccaaaacaaattcaaaagctttaatctgatctttaatgaaatttaaactactttcataagtcatgagattatcttgcggtgaaagatctagcaagttatcactgtaaggagccccgcaagtcgggcactcattactgttcaaatgagtattatcaaaaacagttgaggaagctatttttttaagatcttcatatttccttttatcatccaaaagattatttagcctgcctgttgtagaggtgatttgatgcgctatgtagctcttatgatcgcttattttttgcaaatcgagctctaatgaattaatttcatccagtttagaactaataataccgacaacctctttctgaagttcttcatcatccacaggacgaacatactcactattaagagtttttagctgggcttcgagtttaacccgataatcaatcgctgcaataatggaatctttttcctttaaaattagatccattttataagtatcgaactttacttcgggttgctcagggattcctgaaacaattgcagaaactttagctgcaacaatctccgcattatgccttataagcttccattgaaagcctatagcatctatttcatttttgatggtgcttcgctctaatacattatcattgacatctaaagaaagtaagaactctaaagcccttttctttgattcctttatgccaaattgagttggtattgtagcaaggatagatgaccaaccttttttctgctcaacgaaccatgcaggaaaaagaaccgacggatataagggggtatctttaccattatgattcggaacttgtggaagttcccaaccaaggaatttagaaaaccaaaagtaaaagcccctttctcttttagtatcgccttcaagatgtaaaaaatatgagccattagtttgatcgcccccagaactaacctcatcaatatttataagattgtcattttcaaaacctgctatatttctctttagtttcgcaacagtgtttttattattttttattgttaattcaacatatgatttaaccacactgacttctttaccatccttattagtcagtgctctagttaaggatggggggaagggtattttagcaccacctaaacctaaagccttttccattccaagtgcataagcaatggcattcatgcacgttgatttaccatgtgagttttcaacgcgtaaaagaaacaggccggttgagaaagggatatcaatgccatatagtccatctatagtattaactgttattttaagagaaattatttcaaaagacatatcatcccgcctgaaatattttggttatattagtctctgtcaaaccttttttaagttttcttaaggaaatacattcctttttaaagacgtctaatgcaagtaaattgatcgcacaaatatcgcctttgtctgtcaacttcatcttgtcattttcgcgagtgagaaaaccatcggccagtaaaagctcaatggccctatccaaagtcggatccattctgacttcaggcttagcactatctttattcaaaacccaaaatgcaaaatcagtggtgtttttttctgactttaacaaccaattgacaacatgaagttttttcaatgtgcatgaaccagtttcttgcagcaacaagtaagaatattattaaaacaaggctagatcgccacataggtctcatttcacatgggagatgttccggcctccgcgtaaatgtgaaaggtcgtccgatgatatcttctattttaatattcatttttcaccatgttaaaaatctaacggacacctaattaaccaatccgatattacaccccaatttattttttctaaatctgattctttgagcgtgggtatttccttttcgatattttctttgagaacttccatttgtttcatcatcttatcgccaggttgcgcacttgaagatgtaagcatagaaagtccaaccaagttcgtttctctttgttgaatgcatttgtatacaacttcataaatatcaacccaattctgctttaattcatcgataaggttctgataatcaagatatttttgtattagaaaacgtctgtaagtttcctgtactgattctgaaaggtcaatttttggaagtttcaaatttaacttattcaaaaaatcaacatgctcattaataaatgatactgcatgatcaatagtagagttactaagatctaaatttaactgatagttcgttcttcgaagaagtgccctctcagttatatagtcactatctgtttgcaccaaaatctggaagtcatctgtaacatacggtaatttcagtcctcttacttttaaggatttctgagtacaatattgcgtaagttttgcagatttactataaggtgtagccaaaatccatctactaactttagtttcaccaaacaacaattcaagatcagctttatacttagttgtgaactttaaaatgtcagtacttatttttctacgctgtgctttaactagcttttcaacatcgcttgattgctcgggcaagtagcattggaaaacatggcctgatagagtgtaacattcaatgccgaaatcaccattttgcgaatcaggcaaatcgcagcaattagctggcttatagtgtaaacggataatgctcttaaaatattgctcccatactttcgggtcgctgttcgggtcagtaaacattcctagtccatagagattactttttcagattataaccccttgttctatagtgagtaaaccagagcgctcacatttacagcattgaatataactatgttaaccacgctaataactgtatataaatacagttgtaattactagctatttctacggtttttttgatagacattactaaccgtatgtttttctttaccttaacccagagctctacccttcatcatcttttatcattagacacaagccttagaactcattaagtttcatatagaaattatttaaaatgtatattttttttattgcagataatattctattaaaaattagataggatgtatttaaagctcgcatcagattgatttaaaccacactatcgcctttgattttgtttgcctcagatggtcgagttatcaaaacacaattcgtcatgttcaacgtttatgctaaaaccttttcatagcatacgtgcgtcaatccatctctaagtaccgtcacgacctcggggtcatctcatccagacctgcttccagtaaactaatatagcacgatgtaagcaatatccgcttctggcactaagcggacattaagatctacatcctgatggccccctccggctccccggcgttgccgggtcgtcaagccctactgcgctaaccggcagagccggttagctccgccgaatccctccggggttcgggcctgacggctggggtctgatggcaacggccgggtcaccccttgcagcgggcgtgcgcccgcgcattcactggccacgaatggccgtggccgctgaggaccggaccggcagaaagccgccgtccggggctgtgccctgttcatcacccgcactctgttttgttccctgaatcccttcgccgtgcagaaacctggcacccgggcgccttcacgcaagggtcgcacgctaaacggctgcacccggtccctccgggctgcggctttgccgtttccccctgcgttcagcctgatgcccggacgcctgttctgctctcacggcgaggaactcagagaaacatcacttaaacctgaacgggagaaacaacatgtcacagcagaaacgtcaacaccacggcttcagaatctaaagaatcatcttcttttactgcaaaaccatcagaaggtatcaactatgatgctatccggcgcgccttccgtcgcaatcttttttactttggctatccgcagttcaatgtaaatactgcagcactgcggagtgatttttctatgaatctggaatatctgaccgcggcaacatttacgcgtgatcaagtggaatttgatacgggtaagtaccgctcgggaatcgagatgctgctgattaacgcgcacgaaaaactgctcatcactgtatctgtgtatgctccaaaggcaggcgctgcaccagaaacctatgaaacccggatcgtgcattcagctaatccgatcggcgaagaagagtacgcagaaaataccgaataccagacaaccaacgtttataaagccgcaggtgatctgaatgtcgcggcacttgagttgttctggtcggagcatgaaggcctgagtaaatatgcgcagcaaaacctgcctctgactgacgaatacagtccattttgtcactggcagttttcccgcctgaaagcctgactatttaatccctgcggcatgccgcagggaaccaggagactaaatcatgaacacacaggaacgtctggcggcagcgcttaaaaacccgcttaaggcaggctatgtaacttactcaggacacattatgactctggcggaatgtgaatcttacaatcgctatacagaagacgcggcacggccatacataagcgaaaaagcgcgagaatatctgctggatcagcgacaccgatattttgtcttaataagtgaacctgagcgtttgagttaagaaatgatgcaagccgggcgcagcaggtccggtctgcctctggacgtcagtcgcgttataacgacgggcggccctgcgggccggggaaaccaggtgctgacgcaccggccatctcccttcgcctgcgctttctctctccgggacgctgtctctccgtcttctctctctgcttcctgctgctgtctgttctgctgccgtgcagctgctgcttctccggcttcatttcactgaaggtcaacgtcatgaacagcctgatggccccctccggctccccggcgttgccgggtcgtcagcccaactgcgctaaccggcaaagccggtaagctccgccgaatccctccgggtttcgggcctgacggctggggtctgatggcaacggctaggtcaacccctgcagcgggcgtacgcccgcgcgttcactggccacaaaaaatccgtggccgctgaggacgcccgcgttgcggtcgggtgtgtgcatgctcatttccggcacggtggttatgttccggccggttccacgcgacgggcgaatcaaagcaccgtcattcatcagatacaagggtgaaatgcacgcctgcggcgcccttgtatctgctgcctgccgttgcttctcagccctttgccgcgaggaactaaccgaaacatgacttaaccacccgagaggagaaccagcatgcacacacaaaacatcaacaccgccgcttcagaatcttccaaaacatgggttaacggcccgaacaaaacggctgacgatctggtattcgtgcgaatcgatacgggcaaggtgttcagtcaggcaatcagaatgaatgacgggagcattgtgtcgctttttaattttgaaacgctcgatgaattgcagatgcagtacgacgatatggcactgatgactgaatctgaggccgatgccctgttctgtacccgtcttttcagaccgtgggaagaaattacagaggaacgctggatggatcagctgaccgtgctgccgccactggactggaaatcatcgcccgctggcgagacgttcaagtgctgtgagatgtattcgggcaaggtgacgcatatttttgcgcacattcgcggtcgttattttgaatgccgggactatgcctggaagaaacacgcggatctggtgctgagcgcagtgctggcaatggcggcggaaaacgcgcattaaaaaagcaggcataagcctgctctcttaacggccgggcgtgcagcaacacggtccggccagcatcaaaacacgaaggagttaactttatgtctgatacacgcatcctcgcacacgtaagcaaggctgtaaacctcgctgcactggcaacgcccgcacaggagcatgacacccttacgacgatgcaatttatggatctgtacgcgtacatctgcgatgcaggaatgtttgcaggattcagcgccgtaccgtgggaagaactgggtatgtgtgacgtcatccatgagccgaccgacgaacctgaagggctgcgcatttatctgcgtgatagctggccggtagcagtgctggagttcgacgtgggctacagagtggtccccggcatgatcaccaaccgctggcagcaaagctgaggacaacagggcaattatcagctttgactaaactttgtccgctggcgtggtgtgtgacaggcctgcgggataaactgacagcagagcgcagaaaggctgcggccctgcccgaaagggagaactgacggatgtcggtaaccgatatgaacgagcttaacagtaaccgaattaatgtggatatcgccaagctaatggcggaaacgcaaaaactgaacgcagaggcgggtaagctgaaccgtgagacgttctggtatcccgttgcggtttcaacagggatgatcggagctgtggcgactgtgaccgtactggttatgaaggcgctgggagtgtaaagggaggttttatgcttgagcatttcgcagaccccggatcagctacagggtttaaaattatagctgccgtggcaatagtaatgctgatatacggcctggcagagttagccgacaatcttcaatggtgcatagagacgcgcagagagcacaaaaaaggcgaaaggcctgatcattcagccccgaaaggggctttttaatacctgctgcccggtatcacatgtgcattagtctgacattaccaggaagtagctgatgcactgcgttctactcgttaccccagatatgctgacagagtctggtaggatcccagctgggctgcgccagttttggaaattcgctggttaccttttccggatcagtataactggtaataacataatcatttggaatttcatgtacgccgcggttaacagcaaaataataacgcttcccgggctgagggataaaaggaaacttctttatcacctggaccgaggcatatggtcccaaaggataaaattgttttttgtcggcataaatctgctgaacggctaaaagtttaccaggttgtattttgagggtgaaaattcttctgcttgtatccaaactaccggactgaaatgtgtgagtctcagttctgtcgtaacattctcccttattttcatagttaagaagggtaaaatatccgtcccctccctgctgatgtatgagcagagtggcagcatcagaaccggtgtaatcgctatgctgtcgaggcaccagatttgagcatcctgaaagtactaaggttgaaataagaacgaccagggacagtgaattattcaaaaatgacggcatgtctgttatctccttgaggctgacattacccgttatcggcagaccggctaaaagtctttacctcctggtttagaagtgatgatacgcgtgaatatcgctgtatcgaaagaaagggtagtcccgcactgctatcacaaagcccacaaaggcggacggccctgcgggccggggaaaacccgtgctgacgcactggctctctcccttcgcctgcgctttctcactccgggaggctgtctcacggtcttctctctttgcttcctgctgctaattctgctgtgctgcagctgcttctccggtttcctttccataaaggtcaacgtcatgaacatcatgatggccacctccggctccccggcgttgccgggtcgtcagccccactgtgctaaccggctgtgccggtaagctccgccggaccgcgaagcgttccgggcctgacggctggggtctgatggcaacgtcaaggtcaacccctgcagcgggcgtgcgcccgcgcgttcactggccacaaaaaatccgtggccgctgaggacgcccgcgttgcggtcgggtgtgtgcatgctcatttccggcacggtggttatgttccggccggttccacgcgacgggcgaatcaaagcaccgtcattcatcagatacaagggtgaaatgcacgcctgcggcgcccttgtatctgctgcctgccgttgcttctcagccctttgccgcgaggaactaaccgaagcatgaattaaccacctgacaggataaccagcatgcacacacaaaacgtcaacgtcgccgcttcagaatcttccaaaacatgggttaagggccgaaaaatctgcgtcagcgcgaaggatctgcgcacgcgctggcacgtcacaggcgaaaacggcgaaaaggtcacgcccactgcaggaaaacactatcaagcgcgaaacggcagctatggagcggacgtgctcctactcgatgaaacagatgtcatagcgctgatggatgccggacatacctcgttgccgtgtctggcaagttcggcccgagggatgactgcgatctatgacgcgggggatatatctgcggagcgctacatcattgccagccgtggtcagattttttaccgcacagcctcatggcaggaagcctgtcgggagtatatccggcgttcctctgcggtaatggcagaagaggcgaaagcgttttttgaccgttttcacgcagcgagtgatgcgggcctggattattaccgggcaagcgacgtcgcgcgtgggatcatctcactggaaaatgccctgaacccggcgagtgaaaatcaggtaactgccggtgccggtgataccaccctgagcgatatcccattctgaaatcgttgtgcggcctgtagaggcgggccgctttttcgtctcaactgatttaaggaaaactgaaatgaaaatgcacaatgcgcaggcagtggttatcggacaggttgtcagcacggttctttacaatcgtgggcggggcgtcgtgttcgccgttcacggcgaggagaaaccggcatcagtcgggtcgctttcgggttgcgtatcttttggcggaaatgccacgttagatattgcgtttgagagtggcggaatatcgcgcgggctgccggaaagtatcctgcacggaaaacagtggagcatatttccggaaataaaaagcggggaagagacggcgcgtattgcaaaatatgccgagtcagaagaacgccgcaaggagcaggaaaaggaggaggcagaacgcctttatgcagctgagtgcgagcgtttaaaaacggccccggaatatgctgcgctctcgcaggataaaaacggcgctatgcaggtaacgtctaatattcgtaaggagctgaaggccagatttgcgggcgttaaattttccgttcgcaagcgcagttatgacagcgtaagcgttaactggatggacgggcctacagaggaagaagtaaaagcagtaacggataagtataaagacagttattttgatggcatgcaggatatgtccgtttcctgtgcgtctccctttaaccgtatttatgggggagtgggatatgtttttactgaccgggattattcggacgggatgaaggaaaaggcggtgaacatgatcgctaaaaaatatggtggcagcctggagggtgaggaaataacactggcgcgctttaatagcggcgatctttacagggtggggcgagattacttctggcataatcagggtgtgcagggtgagataaacagaacgcttgagggaataaagtaacagtcatcggggagccagaaggttccctttttttcgccttttatccgccgccggcattgagccggagacgaataaatataaaaccagtgcgatgcagggagcaggctgcacgaaagaaaaaagtgaagttactccagttacccgttcccggcattgagccggggcgggtaattctgcgcgcgggctttgttgttgtctttaaaataattctgcgcagaaagataaagctgggttgcgcgcttcgtctgtatcaaaaaccgttcagccgctgaatgccttgcgcggaattgtacctgccttgatggccttgtaatgtttatcaatcagcatcgcatagttatagcggttcgttacggtcacaggcaggtttttcattcccgcgttgtacatacccaccgccagccacgttgtgccgtactggttgaaattacgacgcagcagcatggcaccaatataaatattcagacacggctcgctgagcagcttttctttgctgaggtccgggtactctttttgtaagcggcgcattgtaaccgaattaatctgcataagtccgtaatcactgctgccgggttttccatctttcgtccggttggtatttacagccgccggattatagcgtgactcctgccaggcgatagcgcgcagatagtccggatcgatggaataccattcgccagctttaataaaacagtccgcattcacgctggcggagaaaatgcctgtcgccagcagggctgcagcgtgagtaaataaacgcattgcggctcctgatttgaaaagttcggaggagatgtcaggctcaataatatcataagagttgggtttttacacaccactcgcaaatttaattttgctgattaaattcattagaaacagcaatttagctttgaatcgtagcaaatttaggctgtactacttttaccatctggtaaccatatggaatccataaagttataaataggtaactttatggtttgttctcatttaatcagtaagttacaatatttttaggttaattggtttccatatagttacttggttttcggggtgttgttacctgatggttaccagcaaaactctgcagtatgtcagaaaatctaactggtccgatgtgcgatttcttagtagtaataaaaacttagtgagagaaaaaatatgagtgaagacaattcaggtaaacgtaaccgggttaatcttaccatccctttctccctgctggaaaagattgatgcccacgttgagaaaaagcttgaagacggagagtcacgcgatacggcgaaccggtcagcgttcgtgatggaaatgtttaagcttggacttcgtgtttatgaaaataaaataaacaaggatgcttcagaaaagacgcttgaccagaaactggagtttatcgccaaaaacgtactggtgagtggttttatcactgacgctatttttggcattcagaaggagaccgttgatcccgccagggtcattaaaaacgaaatggttcttgatccagagtgggtgaaagctgttaatgaacgtgtagcgggtaagctgcaggaatactttaaataattaataaaagcctgatgtctgcacatgttcatcaggctgtatatttatggcttatcttgtccatccgtttctttgtcatcttccctcaatgcatcggcctctctcttcagcgcatcacgtatataacgacgcagtgtcagtgcattaattccatactgcgtataaatctgctttcgggtatgtccatcccgcagaactgcatttacggcctgatcgcggtcgcgcttagacagtacattgcggttatcatacttgacgcgattttctttaatctgaggggagtttttcactttgttccatgctttttttactgtcgctacagtcaccccaagaatatcggctgtctgctgaagggttttaccctgcacgcgcaggcgaaccgcatagtcttttaattcacagggaataaccttgtgatcttcacgcgtaccaatgtatttaatcagcgtatcaagggtaatgccgtaatcgttgcagatatcttttctcaggattccatctgctagtttcttctttattaattcaacatcgtccggtgaaagttttctctctctttccctcggtgcgacttcttttccgtcccgttcggctatttttctgactgcatggtaaatcactgctcgcgatacaccgtatgccttttcaatttgctcaaccgtcatcttcggttcagcatgatacattgctgcaatcagttcccactgcttccagcgataatccattgctgatttccccttcagcttctttataagtttgtagacgtaggcttcagagcaatgctgttcttcgcatatatcctttacgcgccagcccagcatgacgcgctccattactttttctgcgtcgggactgttctttctttttcctgcagagaaaaccgtatttcctgtggcctgtttatcacatttttttaaaactgacggggaactctttttctccgggctaatgcccgtttccggctcaataaatatcgtcttatccagactgttctttaattttcgagcctgccagaggttgacgccggggcggggaaggggagtgaagaaatcggcatttatcattatccaggtgtctggatcgcacacatcataatgctctcttatgtaggcgagtgctttttttgctgcagtccgcagctgactgccgggaacgcgttttgaaataaaggcgagcaggggaatagtcaccagctggcaggcataaaaacggccttctgccgtcatcacctcaaaccagcccgggtcgcgtttgtaacgaaaaattgcttcttcaagcagcttacataaggctgcctcatcatttttcctaaaaactttcgccgcaaaacccgccggttcggcgactcgaacaattaagtcggcagcgtcagccatgatttttcatttccgttcaaccagttatggacttaagtaaaattgctggctatgacgataagtgaaattgatcagtaagatcaataacttaaattgaagtacgtgatccagaagcgtaaaaaaacgtcaaccaaacagggaaacgtaagcatctgttgcaataccattgatgtgtaaaggaggcgtaaccggcaaaacaggaatttgacttaaggcaatacaggtagtgacaaaagatagttcaaccaactgatcattataaccctaactgaggaaatatcctatgaagggcactctctcttcgtgtgtaaattactgccgcaaggcaggggcggtagcgtggaacaaagcaaacaaaccagctctgttcaccggaatggcgatcctggctgctgctgctatgccagcgcacgcggaagaccttttcgcaaacgggaaaaccaccattaacgatacattcggatctggtagtacagtggtgtggattctgtatattctcgaaatcatcgctgccgtgtttacctatgtgaaaaccaagaaccttgccatgtttggcggtatcgccgcggtcatggtgtttatcaacgttgccttcggcatcatcccgtcttaacgcgcgctaatggataaacgtgaccggtatacctttgcggctacgttttccgagcaaaagcggttcgtggggctgccacctgatgagttctgcctgtacgtgccactggcactgctcgcaatcttcctcaacatgtggattttcggccccacgctattagccgccgtggttggaattcgtcatctcaagaaaggccgcggttctcagtatcttctcaacctggcgtactggtgcctgcctacatcagtgatgcgcttctttatcagcatcctgcctgacagctacaaacggcactgggtcgcctgacccccctccggagacaacatggaattaaagctgcgttcggcgggaaaccgcaatatggccgtggctattctggtgctgctcgttatcacgatcctcgcgctggcgctctgctggcgcatttacggcgataaccgggcgctcatgaatcagctcgttaacaaccgacagaccattgttattccctacggcgcggacacgccgttcagctttaccggcgagcgcggcgacgcccgctacctgcgcctgatggcgctggcgtggttgaacctgcgcctcaacatttccgacagtaacgcagacgccagccacgaaatgctgctggccggtgcctgcgacggcgcagagaagtccctgaaaggcgtgctggcagacgaagcctcacgcgtgaagggaaacagcggcggctcggtgttctatccgaaggatgtcagcgtctggccagataagggcatcgtggacgtcatcggcgatctgcagctgagttacggactgcatgacgcggagccggtgaagaagcactaccgcctgcgcaccgatacccgaaacaaccgtctctgctggagcgctttcctggaggttcctgatgcgtaaatccctgttaatcagcgccgtggcgttgtttaccgccttcggtgcccgcgccgaacagctgacgcttaaccctggcgcccgcgtaaacgcggcagtaagcaacactaacccaaactacctgcgcgtaaatgacgaccgtattctgagcgtacaggcggcgcagggggtgctgagcgccaaatcacctacgccggaaggcgcaattgtattttctaccgtaaccgataagccgttcaccatgttcgttcagacagagtcaggctttgccttctctgtgcaggccacgcctggcaaaagggcggggctgagcctgacggtggataaccgcgaggtacagggtacggaagaggcgcgggagtacgagcagaagcaggacacctacagcgcgctcatcagcggcctggtcgggcgctttatcaccaaccgcaagcctgctggctatgtgttcagcaaaaataccgacgtgccggtcagcgaatcggtgaaaagcgcctttaccctgcgtccggtgaccgcgtggcagggcgaccgggtccgcatcgtgcgcaccgacttaaccagcctctcttcgcagcgcatccgcctgagtgagcgctacttctggagtccgggcgtaatggccgtcgcttttcatccacagctggacgtgctggagccgggtgcgaatgtatcggtgatcactgtgttccgcacccgaggaggcccggatgaaccttaatagcctggtccgcagcaagcagcgccggctgtttgccatcattctggccgctgctgccgtaatcatcggcggcctgtaccttgccaaccgtggcgtgtccggtcatgcggtgaacaaagcgggcaagcccgataaagctgccgccgagccggacctgaccggcggcggcgtggtgaacacgtttgacggctccgggcagggttcgctgctggtcagcgcgcagaaccgcgagaaggaagcgcgggagcagctcaccgcaatgaagaaagatttcgggtcactcaaagaacagatgtccgacctgatgaacaacaacaagtccctgcagcaaaatgtcagcgacctgatggaacagctgaaaaatcagcagaaccagcctaagaccgctccgggcggtcagcagagcgcaggttatacaccgccgcgcacggaatatacctttgcgcctgcgcccgtgcagagaggccagatcgataaccagacgtttgattactcgccgtttgagcctaaagcgaaagacacctccttctgggtgccgaccggtacgttctccgacgccatcgttattgaaggcgccgacgccaatgcctcggttcgcggggagaataacctggtgccgatgcagtttaagctcaagggaaaagcgcatttgccgggcaacaacaagttcgaccggttcgataactgcttcgtgacggccgctgcctatggcgacatctccagcgagcgggccatcgttcagctgcagcgtctctcctgcatcattgacggtaaacatatcgatcaggcggtgaaggggcacgtcgctttctacgggaagaacggcatcaagggtgtgccggtaatgcgcaacggcaaaatcctcgggctggcgtttaccgccggcgcgctgggtgggctggggcagagcgcttcgcaggttggtcagacggtgactggtattggcgcaaccagcacggtaagcggaggagacgtggcgcgcggggccatcggcggcggcgtgggcaaggctgcggacaagctggccgactactacatcgagcgcgccgagcagtatcacccgattatcccgataggcgcggcgaaccgcgtggaggtggtgtttatcgaaggcttccgcgcgaagtttatcgaggatgaagaggccgcgaagctggcaaaagagcagcagcgctcaggcgcacatcagcaggacacgcagacgcgtgagcagggcaacagcggtcttccgccggaccttgtcggcaaactcggcgacgcgacgcgcctcaatatgaatgactttgttactccttcaggcagccagccgaaaaatatgactccgcagggcgtttcgcaatgacagacacaaaaatccggcttcgtcacgcagagcactgcggctggatggtgtttaccgaaaggacggtgagctgcttcgggcgtgaggccgatgcacgaattccgggtctgcaggcactgggctaccgtgtcaagaagctctactgcaaacccggactcattcctgacgacggctacgtcgcgcttttcggggaaacgctgcgccgcctgctggaggtggcacccggcgacaccttcgcccttaacatgctgtcccggctcgggaccagcggcaaacacggcgacctctttatcgacgttaccgaaatatctgatctcaacggagagccccatgaataagtcacatgctttatccgtctgcgcgctggcgctggttctgagcggctgcgctggcatgaacagcgactttgagttcgacaagcctgcgaaggactccggggtctggatgtcgcaggccgacgacatgtctgctggcagcagcggcaacgccccgtcagcaacttccgccgcaggcggctttaccggtgcgggcattcgcctggacgactaccgcctgatagataccggcaccatccgcctggacccgcagacggaggcgcaggcgggccacagcggcctgaacgacggcatcccggtacggcttgcatcatccggcggggtccgcccgttcacgagggaaaacggcgttctgcgcaccgatgcccgacagaccgcgtactgcagcgcctcgcactgcttcccggaaccagccgctgcgttccgccgtcctgacggtgtagcgcgcatctggattgcaccgtacgtttcccctgacagcaacgtccacatgggtgaggtcatttacagcgtctccagtcacggcgactggagcggcattctgatgtgaggtccgcatgaaatttctgaaaggcttccgctttgacccgctgaacgtggtggacacagtggcgggcattctgggggagcgcgacacaacgaatgaaacgcgtcagaagctgcaggacatggactacccgcatatccgcgacctgctgccttaccaggactatgacagcgaaagtcagatctgggtgaacaaggagtcggtgggcttcgtgattgagtcgcagccactgattggcgccaacgagaagctggcagaaagcctggagtacctgctgcgagacgtggcgccccgcgacgttccgctccaggtgatgctggtctcgtcccgggcggtgaaagagcaggtcgagcagggcctgaaaaactttgcctggaaaggacaccgggcggacgagtgtaacgacgtcaccgcccgcttttacctgaacggggcgcgctatacctacagcaacgggcttgaccatccactgaccctgcgcgactaccgtcttttctttgtctggggcatgccggttaaaagtctctctgaaaccgatctggtgcgcgtgcgcgacgtacgccgtaacctgctgaacgcacttaatgcggccgacatctggtctgaggccatcggcgtgactgagttcagcagcgtactgcgcgagttctttaaccatgaccctgcgcggcttgagcgatacgacagtgagtacgatccggcggccgatctgaacacgcagtttgtggaccgcaccacctcctggcgggtgaaaccctcgcatatccgtatcgagggcagcgacagagacagtaagccgttcgccgcgcgtatggttaacctgaacctcgacaacaacccgcaggagcattacctgtggcaaaacggcaatatttttcaggacctgatgtcgccgaccaacggcattccctgcccgtttatctgcacgatggtgctgaccaccgaagagcagatgaagagccagggtgaggccaacagccgattcctggcgctggactcgcgcgtgaacaccagttacgccaaatacattccgtccaccacgcgtcagcacgctgagtggaaagacgcccgcgcgcgactactgtcgaaccagacgtccctcacgagctacttttacggcatcacgctgttctgcccggacgacgacgacctgacgtcccgctacaccgagaaaacgcgcaacgccttcgcggcgcagggcctgcgtttcgtgcgtgccgacttcatgcagttgcgcaacctgctggccacggtgccgtttgcgatggtgaacaagaagctgcgcgccgactgccgtaagaccggcggtatccagcgttcggagtcgtttcacgcggtgaatctcatgccggtcatcggtgacaacaagctgtgcgcctcgggcattcttattccgagctaccgcaaccaggtcgcgtttatcgacgtgtttgacgaaagcctgccgaacacaaacttcaactggtttatgtccggcacctcgggagcaggcaagtcggttctggcgaactccattgcgcgttcggtgctggacaagggcggcacggtggcggtgcaggacatcggcgactcctacaaggcggcctgcagtagtctgggcggcacctacattaacggcgactcgctgcgttttaatccgtttgcgaacgtcacgaatattacgctcgccgccgagcgcatccgcgatcagctgtgcattctggccagccccaacggcctgctcgacgaggtgcacgagtcgctgattctggaggccatcaccgagtcgtggcctcagtatcagcaggacatgcgtatcgatcacgtcattgcgtatctcaaaaaacagcagggcgcgattacacgcgagcactcttcactgattggcgggcgcattgacgaaattaccacgctgctcggtaagtacagcaccacaggcatttacggtaagttcttcaactcgtccgaaccgaccctgaagcctgatctgcagttcgtggtcaccgagctgggcgacctgcgcaaacaacaggacctgctgtcggccattttgttcaccatcatgatctggaacgagaacatgatgtacaccacgccacgcagcatgcggaagatgaacatcatcgacgagggctggaagctgctcggcgggtcgagcaccaagattaaggacttcattgaagagggttaccgcaccgcccgccgccacaacggctcctacggcacggtgacgcaggcgatacgcgataaaaacctgtccacggcggcgcttgcagcctacgacaacagctcattcaagttcacctgtatgcaggacgccaagtcgttcaccacctttcagaaggaggaaccgcacgccttcagcgagctggagtgggagatgatccgaaagttcccgccggcgaaaaaggcgcgctacagctcgttcctgctcagcgtgggtgagttttccagcttccaccgcctcattctcgatccgctgagcgacgggctgttttcctccaaaggcgaggacttcacctaccgcgagaagcgtctgcgggaaggcgcggacatcaaggacatcctgtttgagatggctaataacgacgcgcacaagcgcgacatcatccacatgctgcgggagatgcaactttgaatacaagacaccttgtggcgggctgcggcctgtcggttgtgctgagcgtgggtgcgtgcgcggccgcctggtttttctggctgaagccgcctgagcttgtcaccttcgatatgaagggcacgaccaacgcgcttatacgccagaccgcgaagctggacctgaacgatgaccagcgaaaggcgctgctgacccgctttgaccgcagcgtcatcactgcaacggcggactatgccagcgaacacggtgcggccattctggtgagccccgcagttgttaccggcctgccggacgccacgccggagattcaggcgcgcctcgctgaactgatgaaagccggcaacccgccgcagtaaccctgtccgatcaccccaacgggagcctcccgatgacacacgcaactccgctggcgcgactggccgccggcgcgctgctcgccatgctcagcctgcaggcgggcgcggctgagctgggcacgtacggcgatacctgggacatccgcgagcgcaacctgatcgctgtcctgaaagacaacctgaagcagcactttgacggccgatcgcaggccgacattgagcgggaaatgcagaaaaaggccgaagacgaggcgatgcgcccgccgccggttccggggctcaccaccgcgcgcgagacgcacagccgcctgtttgacccgtcgttcacggtgcagcgcgacattgccgaccagaacggggtggtgtttgcgcataaaggccaggtggtgaacccgtttgacgttatcccggtgtttgacgagacgctttacttcatcgatgccgacgacgaccggcagattgcatgggtgaagcagcaggtgccgcacaccacgacctcccgcgtcattctcgtaaacggcaacgtgcgcgacagtgcgcaggcactcggcagccgggtctacttcgaccagaccggcagcatcacgaaaaagttcggtatcactcaggtgcctgcggaggtgaagcaggcgccaggacaaaaacttttccttattactgaattcggtcttcccgaccgctaacggagccagacatgaaaaagttaatcctcaccaccgccctgacgctgagcctgacagggtacgcgaccgcagacacgaccggcactgcagcggctgccttcagcgacgcgcagaaggcacaaatcggcgagatcgcggcagactacctgcgcgcgcacccggaaatcctgatcgagatgagccagaagctgcaggcccaggcgcagaataaacagatggcgtcagcagccggtgcggcgcttgcaaaccaggacgcgctgctgaatgacccttcctcaccggtgctgcatccgaagggcgacgtcgcggtgatccagttctttgactaccagtgcattttctgcgcgaaggttgctcccactgtggagcagttcatcagtaaaaatcctgacgtgcgcttcgtctataaggagtggccgatctttggcagccgctggccggcgtccgtgcaggcggcaaaagtcggcctgtctgtttataaaaagggcggtgcagaggcataccaccgctaccacgcggcactctacgcgaccgggcatgatgaaggaaagctgctcgatgaggatatccgtcaggcagcggtaaaagcgggtgtgactgacacgccgcgtgaggaggttgaggcgactgacgctgcgcttaaagctaatgaccagcttgcgaagcagctcggtattcagggcacgccggccttcttcattatgccagtgaagggcgccactgctgagaacatcagcgtgatcccgggtgcgacaagcctgcaggggctgcaggctgcagtggaaaaagcacgcggcggcgttaagaaagggggctgacatggtctggcgcacggtatttctggcgctgacggtgtggttctgccagtccgctaacgccgctgaaaacggcaatacgtccctgacctgcgacggtcgctgggtcaaccctatcaccgatgtgtgctgggagtgcctgttcccgatgagcatcggcagcgtgcaggtatcggccgggtcgctgccggataccgaaaacccgtcatcgcccattcagttctgtccggtgccgccgcccatttttgagcgcccgggcatcgcgattggcttctgggagccgtttgcaatgactgatgtgacgcgatcgcccggctgcatggtgaacatgggaggcttcaacatcaacatcccgaacaccgggaccggcaccggcaccaaaacggcgaatgagcaccctggcaccttctatcacgtccactggtataagtacccgctgatctcctggctcaacattattacctcggagatgtgtatgcagggcggtgagtatgacatcggctacctctcggagctggacccgacctggcagaacgacaatcttgcgctgttcctgaacccggaagtgatgctgtttgcgaacccggttgcgcagatggcctgcgcggccgacgcggtggcatcaggtgtcagcaagccgattgatgcgctgttctggtgtgccggctcacacggctcgatgtacccgtttaccggcaacattgtgaacgagtcgagcggtctgaacagttcggtgctgctctctgagcgcatggacttcaagctgcaccgcgaagggctgatcctcgataccgtgccgtataacaccgccgtctgttacgaatatccgtccgtcatcctgccgaaaagccgctaccgctatcagatggtgaacaccataccggacgtggcgtcgtgtcacccgctggggcgcaacgtgatgctgtggcagaccggcaaggaaatgccgaacagcaaaaagaactacggctatctcatctggaaaaagcgcaactgtgtcgtgctttaagtgaggaaatatgaggaaaacacgcaacacgctgtggcttgccgccgggctgatggccgcactgtccgcgcaggcggaagacgcgccgaagggcacgcaggtcggcagcacggaaaacgagacggcctatttcctgtccgcctcggtgccggaaaaagagctggccattctgatgaaagcggcggaagcgcggaacattccggtgtacttccgcgggctggttggcgacagcatggagcagaccgcgaagtacatgatgtacatggtcaccacctataaggtgcgcggcgtgcagatagacccggtgcgctttgaccgctacagcgtgaagcaggtgccggcgctggttaagaagtgtggtgaccacttcgacatcgtgtatggcaacgtggcgctgaaccaggcactggacatgattagccagcgcggcgagtgccgcaacaggccctgaccactgcccgctgcggcgggcccttctcttactctgaccggaactcccgatgaaaaaagcaacccgcatcaagctgctgggcctgctgctgacctgcgcttcagcgggtgcactggcggcgtcaatggatgcctcaaaccaggaaggcattaacgccgcgaagtcggctaacggcacaaccagcgccgacccgaacagttattttgacaactacacctctgacgcgccgcagcgcgactactacggcgacccgacgcagacgtcaacaaacatcgacgtaaaggggcagacagagctgagccagtcggaactcgggcagacggcccgggaatcctatgtgaacaacccggcggacaagctcagctacgactcggacatgatgaaacacagcgatgagatccgggaaaatgcgaatgcgattaccggggtgaacggcaatcagtgcgtggcgcaggagctgaacaaaaccacctacacgacgcacagttgtgagatggcatccccactctcacagtcatgtacgcgtaaggccacaattgtgacgaccgggtcacgtgaaacctttaatactcagatggtactgaatgcgggtgatgtcagcggaaggcgcatcgataactactggattcagtacgacatcaccgtgccgcaggatggcactatcagcagcgggacgtgggagtttctctatccgtccgcccccggttatcacggtggtcgcctagattactccattcaggtgcttgggcaaaatttcaggaccaaaataaactcctccggcgcattcagcgtcgccacgcaggaagtaaagcaggggcagatcatcagccttctggtacgcaataacagcgatggccacaacgatcaggccgctgataatttcatgaagcagttagccagcggacaaatgattgtccgcatcacccttccgatggaggcggtccgggatacggtcagtgccgggatccagtggacggacagctgcccggcagatatgggcgacgcggtgaagatgagtgaggtctgcagcgatccgggcggcacacgttctgtcacggtgggcggcaaggcctacagcctttacagcgactgctggggttacaccacacagtggaatgttttcgaagacgacaccaatacctgccaggcctatatcgacaatccaaactgcagtgaaggcacccgtacctgcacccagaaaatcggcaacctctgcgtttacagcaagctgacctaccagtgtgcgcacaccgttaagagcaccggctatatctgcggctcggagttttactgctccgacggcagctgctcggcgatgcaggcaggacagaatcagaactttgaggctgcggtatcacagctggcggcactcgccgctgcgggaaaagacttcgcgggcatggacccggattcggtcacggcgtttaccggcaaggcgatggcgtgccgcaagagtgcggctggcttcagcaactgttgtaaaagcggcggctggggtcaggatgccggacttgcgcagtgcaacaccgaggaaaaggaaatcggcaccggcaaggagaagaagcttgtggtgaaggtcggctcttactgttcgaaaaaagtgctcggcgtctgcctgcagcagaaagagggctactgcgtcttcgacagcaagctcgcccgcatcgtgcaggagcagggacgccgggaccagctgggcatcagctttggttcgggcagcaacccggactgccggggaataagggtggctgagctgcagggcattaagttcgatcatatcgacttcagcgacttttacgacgacctgaacagcaacattaagctgctcgatcaggacgcgctgaaccagcgcatcacatccgacatccagaacagccttaaatcaggagactgacgtgagaaaactcatcagcctcacgctgctgcttgcggtatcgccgttgcacgcggcagaggaaacaaagcccgacggctacaactacgatccggcggtcggctggtactggtacaacgagccggtaaaaaaagaagaggaggagcagccgtcaccaccacctgccgcgccacaggagactcccacgcagaagatgaagcgcctgcaggcgttccgcgacaacctgatgaacgaagcgatgctgcacccctcaacagagaacatccggcgctacaaaatcgtgcaggactggatggtcaatcaggcgagcatgttcgcctcgcgctgggagaaggtgttgctggataaccctgagctggactacagcctgaagcatccgttctacaacggtacagccaacatccagtacaccgaacagcgtcagaagcagcaggcggccatccgctacgtgaaccagcgctacggcgtgtttttcttctatcgcggtaacgagccgctggataaccggctcggcggggtggtgaaggagttcagcgagcagtacggcctgaccgtcatccccgtgaccgttgacgggcgcgccagcccggacctgccagacaccaggcagaacgccgggcaggcagagaagatgaaaatcgaacacttccctgccatttacctggttgaacctcgcacgaagaaataccagccgctggcctacggctttatcacacaggacgacctggcgcgtcgcatgctcaacatcgttaccgacttccagcccgaggattaatccatgatgtcaaaactctttgccgtattgctgatgcttacgccggtgctggccacggccagcacgattgatgacattgcccgcctggagcaggcgaaagaaggtgcagacgcgcccgcgcagccggaaaaccggtcagcgaaaagcgcgcctgctgccgacgcgcaacctacgcctgcaaagccgatctggtatcacctgagcgacggccgccgcgtggacgtgggccactggcagatcgtgcactttgttcgctccgactgcccgtactgccaccgcttcaatccgactcttaagtcagtgtccgagcagaccggcatcggcgtgttcgtttacagctttgacggcaagggcgatgcggtgtttccgaaggtcatgccggtgaatgacggcatcctgaaagacttcttcgcggagctgccgcaggcgacgcccaccgacttcattatcaacacgcagtcgctggtaaccatcccgctgtcgcagggggaaatgagtgaggaggcgctgaggcagcgcctggatgaatcgttcgcgctggccgtgcgtctgggggtgctgtgatgactaaatttgtgttaagtgcaggcgtggccactggcctgctgttctccgctgcggcgagcgcggacgtgcagaacgacatcaacaaattctttaacgacatgggcggtggcggcggaaactacacgcaggcggccgcctggcagggccagtcagcgggctacctcaccggcggcaacctgtttatccgcacgccggtgcgcaacatccagctgatatcggtcacgctcccggacatcaagtcgggctgcggcggcatcgacgcttatctcggctcgttcagcttcattaacagcgacagcatcaaaatcatgggtaagcagatcctgagcaacgccgccggctacgcctttgacctcgggctggaaaccatctgcccgcagtgtaaggcggttaaggactacctgcagaagctcgcggcggataccaacaacatgaatatttccacctgtcaggccgcgcagtccatcgtcggcggactgtggccaaagacacaggcagcgagttcccagatttgccaggaccttggcaccaagcacgatgtgttctcagactgggctgcctcccgccagggctgcggcgtcggcggagaaactaacagcgtgttcgataaggcgaccgacgaagagaaaaagcgcatcccgcgcaaccgcaacctgacctgggacacgttcacgaagctcaaccagtttttcagcaacgatcgcgcgctgaaggagttcattatgtcgatggtcggcacggtgatttatgacgcgaacggcaacccgacgttcctgcagccgcgcgggggcagcgagtcgatgttcaatacgctcctgaacggcggcaccgagaaaatctaccgctgtaacgacaacaccacctgcctgtcgcccacaatcgcggaactcacgctctcagaagatgagggcatgaccggccgggtacgggacatgctcaacgacatcttcgacaaaagccgcaccgacacagcgcttaacgataacgaaaaggcgcttatcagcagcacccgcgtgcgcatcctgcgttacaccatcgactccgcgtcggtaggcatggatcagagcgtggtcagcagcctggcggagtacatcgcagccgatatggtgatgtcctacatcaacggcctgatcgacgtagccgcgagcggggcagcaggcacgctcgataccgaagaagagaacaaacactttcgcgagaacctgcgtcaggtgcgcaatgagctgagccagcgcgtcgcgcgcatccaggttcagcagaacgggctggccgagtatgaccgcagcctgtcagaaacgcgccagcagctctcgtcatccgtttccgacagcgtgctgtcgaactatcagttcggggggtaagcatggcgcttgatatatgggtggtcagctccggcggcatgatcacgatgggcctcaacgcggtcgccacggtgatggaaaacggcggctggaaaagcacgatctgggtggcggagatgctgggcattgccttctgtgtgatgacctacctgcgcacgcacagtctgggcgcgatgtttggctggggaatgacgttcgtgctggtcaccgcgctgctgctgacgccaaaggtcacggtggtggtcaacgacctgaccgccccggacactatcgggcgcgtcgataacgtgccggcgggacttgctctgccgctctatctggctaccggtgtgggctacacgctcacgacaacctatgaagacatctttcacttcccggacgagcggtcctacacaaaaaccggcatgctcttcgcgagtaagctgatgcaggacagcttcaccatcgacagccgcaacccggtgctggcttataacatgggggagtatgcgaaaaattgcgtggtcccggacatcatgctgaaccacaagtacagcatgcaggacgtgatggagtccgaggacgtgcaggcgcagatcttcggcaacccgagcccgctgcgcgccatctactggcgcgatgctaacggcactacgtttatggtctgccgggatgcggcgccgcgtctgaaaaccctgctgacggcagaggctaacaataccggcagcacgttcatggcccacgcggcccgcatgctgccgggcaacaacgcgccgcagacggtatacgctgagcagctggccgggtcctatgaatactttctcggcagcagcaagtcggcgcaggcgatcatgatgcagaacatcgccgtggcgggcctgcgtcgcgggctgaacagctacgtgaagggtatgggcgacaccgcctcaatggtggacatcgcgtccgagcagtctctgatgaagctgcgcctgtcgcacgcggtcagctacaccattgcgacggaggtgctgccacagctgcacacggtgctgctgctgttctgcatctgcatcttcccggtgatggtgctggcgctctacgtgcgggaaattgcctggtccgtcatcaagagctatctgaactttatgggcagcctgatgctgtggccggtgatgttcgccatctttaactttgcggtgaactacagcacgcagagcagttttcacgcaacgggcccgacgctctccaacatgaaccgcctgatggaaaccagcaccaccacggcaggcatcgccggctggctgatgctgtctattccgttccttgcgttccgcctgttcaccgggctgggtcagagttttgcaagcctcagctcaagcctgggcagcgccctcagcagcgcgtcggcggcagactccggtgcggtggcgtcggggaatgtgagcgtgggtaacgtgcagatggataatatcaacgggcacaaaacggaccttaatcgcgcctaccgcgaggggatgactaccatgcagctgggcaatggtgccatgcgaaccatgacgcaggacgggcagacggtgtatgacgcgtccggcgcaaccagccgcctgccggttgatctacatcttgaccgcaatctggcgagcgcggcgcagcgctcagttcgcgacagtatggcgcagaccgagatggcggcgcagggctacaaccactcggtgcaggaaacgggctcgcagcttaagcagttccatgagcagtttggcaatagcgactcgaaaacgctgtcggcttcaaccggcatgagcatcactgatgctgagcgcgtaaacaaaatgcagaacgtggcgcaggattatgcgacccgcaaccacatcagcctgaatgaggcgtactcggagcttgaagataaatcccggagcgcattagtgaatactggagcacgaacacaggcgggtattgattcaagtaaatcactctggggcaaagcaggagagtgggttacaggtgcttcggtcaaaggggatgttcatggcggtacagaattgacagggagaactggttcaacatctcagacttctgagggaggacaaagtggaaatgataattcgcaaactatctccgctcgcgagtcgcaggacttcagccagggtatggatgtgctgcgtaattacagcacgacctacaatggacagcacgttgataacaatgcgaccggcctgatgaaccagatctcttctggcatcaccacctctgacacccaatatgcgcagtacacggccagccagtcgcatacgcatgaactgcagaaaatggcctctgagactgaaacgctcagcgcaggcgcacgtgacaactacacgcaacagtttgttgagtgggcacagaaacgagcgccgggtaatgccgaaactatccttactaacacgtccgatgaaggcgttcagaagcagcgtgacggtcttgtgcaggagttctttgcagagaagttgcagggccgcattgacggagactatgcgcgcaactcaggaagcacgggtgaaggtatgggcgcaccggcgaatacagcaggcgctcagttcggaggagcatacgatagtgcaaatcagaacattgatgcaggtgtagccagaaataacatacgcactggcgttatcaatgatgttgaggaacagcaggctgtagttaacaataaagccaacgacgcaaatgctactattgaaaaagctaaaggtgaaacagatagcggtatagcgtcacgtatgggagagtatacgtcgagcgcgaataactttgcggatgataagcgggctgctgataagcaacaagacgacttattagtgaacccttttaagaatcacacccataaagattacaaaggggatggtaaggagtaattaatatgatgacatatgcacaaattgaaaaggactccaaagaaataatagactcaataggttcgtctgatagagaggtgcctagtttttttgggatgttcagtaaggttaaatatcacttcattgcatattgtgttctcggcgtattaagttatttttcgctacctcaaccaaagaatgttggattatggctgttttttgtagctttcggtatcttccactggcttgtgattttttcattcactgcatcatatgcaagcctgttcaacatgattagatctgacaagttaaaaagtttagagctaacaaaattaatatcaggaaaagtcagagcgtatggggtggtttggttcgtagccttggttacatgcgggcttgcaggagtccttactgagtggagcatactacctcttgtaatcggtaactttgttgctacgttcctgatcttcattgtcttcaatatggatatatcacgctatcaggtttcttccattattggagctgtgaaagctgtaagaaataaagcgtaaaacaacttatctaataaagtgttctcgcctgattaaattcaggcgagagcttttgcatctctatcttaaccagaatatttagaggaaaaaatgctaatacacttaacaccttctttctttttaaattactccaatatctctgttaacttaattgatgtcgaaatccctgaattaggtctgcaccttcatgctgaaagagatattaccgtccggttcccgtcacctaataaacgtctgcattacgtctgccgtaaaaaaggacgcaaagctattcacggtattctgctgaatacggacactgacgtgacggacataaccgtgataacccgctgggccgttcagggtgaggtgtccgtgcaccgcgtgcatatgcacatcgtcggcgatgacgatgcagtaacggacgttattcacttgtggagcggcgttttcaacacccccttccgggataaaaccccggctgaggccagaaactggataccggcatcctgtcagccccgcctgaccgtgaacgctggcgacaggccgtccgcacgcgaaccggctatctggcgtcgtgccgatccggccgggattatccggcagcagaccgaatactataccgccgctaccgtagagcctgaacgcctgctttcgcctgtgcgtagcaataaccggttaccggcactggaagacgcgtttgactgcaaagtacgggaatattcggacacgctgcgcgtcctgtatcccttcccgggcgtaaccgtctgcccactgacggagcatgaggagcttattgaaaacgacctgaaagagatcggaaagctcgatgcgtttacttcgatcattcagcccgttctgcaggaagttcgcacggtgtgtccggtgtttttcaccaacacgaccaacctgatgaactacatccgaaggttttccacgcgttttagcgcgctgagtgacgccgatcagcggtttgttgaagaccagattaatcagccattgtttcaggtttcagtcagctgagaccgcccgccgcacagcctgacgcgccctgcgtctggcggaggaggcggaacatcacgtcagcccatccgggcacgttcgcaccgtaagtaaaccccgcgcagctttctgcctggctttcgcctgcccgcagccctgcgcgcctgtctctgtttccacataaaggactttcaatgagcctcaacgcccgcgactttacccagggcggccaggtgatgaaatacatgatcggcatgtttgtgcagattatgaatatcgcctcctactgggtcgtgctgttttctgcactggtatttttcagttggatgctgctgcgccttacgatgcaggagttcattcacggcagcgcctactggctggttaagtggtttgtcatgccactgtcgaaattctctggcggtaattctaaaagcggctggacctttcactttgagcgccccagcggcgaagtggtggcatttaagcacactgctcagcaggtgatgaacgatccgtacttcgtgcagatgggcgaaagcgttaaagacgccgcattttacggctggggcattgccacattctgctttgtagccgccattctcggcattacctggtttctcgggagtaaaggcgcgaagcagcgcgagagtgagctcaccggcggccgcattctggcgacaagccctgcagtagtgaaccgcctgctcaaaaaagccgacgtgatgtccccgctcagcatttgtggtctgcacatccttaaagactccgaaatgcagaacttcggcttccacggcaccgtcgggtcgggcaaaagtaccgcgctgaacgacctgctgcgccagcttcgcgcgcgaggcgaccgcgtcattatctacgacaaagggaataactttatcccaaccttctatcggcaggataaggacaagatcctttgtcctttcgataaacgctgtccgttctgggatctgtgggaagagtgccagacggtgggcgattttgagaacttttctacctcattactacctgacagcagtggcagcagcgatccgttctgggtgctgtcagcccgttctatgtttgtggctgcctcccgccggatgggacgtgataaaaaccgcagcatcggtgagctgttgaaaaagctgatgtccatcagcctggctgatctgcgccagtatcttgagggcacggacgcggcaaatctggtggatggcagcatcgagaaaaccgcgatgaccatccgcaccattctgaccacctacgttcgctcgctgcgctacctgcaggggctggatgagcagggccgccgcccgttcagcatccgcgactggctgcacaccgaagacgcgagcggcgataatccgtggattttcatctccagtgacggccagaaccacaatgcgctgaagccactgttgagcgcgtggctctatatgaccatgtccggcattctgggcctgaaagccgatcgtaaccgccgcatctggatttttctggatgagctgccgtcactgcacaagctgcccattctgccggagttctgcgccgagggccgtaagtttggtggctgtaccgttgtcggcctgcagaaacttcccgcagcttgaagagacttacggcaccaacgccgccaaatccatctgggacctgctgaacacccgcgtcttttaccgtgcccccagcggctcgattgcggactgggtacagaaggaaatcggcgaacagcgtcacaagaaattcaaagatcagtacagctacggcatcgacatcatccgcgacggcgtgcagttctccaaagacgaggtaaatgagttcctggtcagctattccgacgtgcagagcctcaacgaccttgagtgctatatcaccctgccgggcgagtggccggtggtgcgcatgaagctgccctggaaaccctaccgcgaaattgctgaagggcgcattccacgcgacgtcgaagatgtgtttgacccggacatcgaggcaacgcttgcaggtgaaaccgccgacaacaaggccggtcagattgtcggtcggctgtttggtgacgcaactgaagcggcagcccctgcagaggaacagcgtaccggcaacaccgggaccgctgcaggtacgcagagcgctgcggcacctgctgaaaacgctacggcatcctcttcagcggcacaggcggcggctgccgaagcaggcgggcgcgttgtggtgctgccgccacctgttgcggaatcgtcaccctcaccttccccggtaaccacagcgccagcgccggccgcacagcaagaggcagagccgcggatgcaggtcatggacgtggttaaacataacagcgcggattttggtctggaccgcaactgaggtgaatcatgctgtcagtttcatccgttaagaacgccggcaaggccggcgcctattacacaaacgaagacaactattactttctcggcgagcagtccacggagtggtacggcaccggcgcggaaaatctgggtcttgagggcccggttaaccgcgataccttcgtggcagtgctggagggccagttgccggacggcaccgacatgcgtcgcatggagggcggcgttaacaaacaccgtcccggatatgacctgactttctccgcgcccaagagcgcctcggtgctcgccctagtgactggtgacaccttcctggtggatgcgcacaaggaggcggtacgccggacgctggacgaggtggagaagctcgccactacgcgcaccatgaccgacggtattacagagatggagaaaaccggcaacctggtgattgcgaccttcatgcacgataccagccgcaaccttgaaccccagatgcacacgcatgccgttgtggccaatgccacgctctcgcaaaacggctggaaaacgctctccaccgacattaatggcaaacagggctttaccgacgtggtctggaacgagcaggtcagcatcggggcgctctatcgaggccattatcgatccattattgagcccgctggttaccagaccgaggacaccggcccgcgcggtgaatgggacatcaccggcgtgccggtgaagcctttttcctcgcgtcgccaggacatactcgatcgggtcggcgaaaacgcgacggcgaagcagaagagcatggccgcgctggattcccgacaggccaagcactttgaagatcccgaaaccctgcgtgagcactggcagtcggtgctgaaggataccgggtttgatgcgcagacgttcagggaagagctggcggagcggcgtcagcagcgtgaagccgaaagcgccggtcaggaaaaaaaagccgccacgccgccggtgctggagggcgcagtgcgcgaggctatcgagcggctgtcgtctaaaagcgtgcgcgtgacctacgacgacgtgatgaccagcgtgctcaatcatgtacccgtcagggagggcgtttacgggcaggcgcgtaaggccattgataacgccatcggtcacggtcagcttatcgccgtggataaaaaccagacgctgttcaccaccgccgcccacgtccgggacgaggcgcgcctgtcgcagctggccgccgggctggccgaaaagcagggtgggctcacggcgccggcgggtgaacggggcgtgctggcgcaggtggccgacgccgatcgggcggtgtcgctgattgacgtgcgcggcggcacgcagtttatcagcgacctgaaccgcagcatcatggcgatggccagcgagagcaagcgtccgctgatagtggttgccgcagacggcgccgcgcgcaagcgccagctggcgacctttggagataagcccggcgtacagcttatgacggccgaagaaatgaaggaggccgaattgccggcgcgcccgctggtgctggttgccgaggccgagcgctttaacacctccgggctacacgatgtgctgaagacggcggcgcagcatgacggcaccacgcttgtgaccgatacccacgcccggcgcacggcaggatttgcgtcggaagtgctgagcgcggcgggcgtgaagcagttcaccgcctcgccgaagaccgagaacgtgcgcgtgacgatggtgcagaaggacacggttgaagaccggctgagcgtggcggcgcgctactacgcgcaggaaaaggcgcaggggcggccggtttcgctgcaggcgggaaacgcgcgcacgcgcgaccagctcacggcccgcacccgggaaattctgaccgacgaggggcagctcgggcgggtgctgggcgaggccaccgtccgggtgccggtgtggctggatgcgacaagccgcaacgaccgcagcgtgtaccgcgcgggcatggtgctggagcatcacgaggggcagggacagaaaacggtattcaccatcgccggcgtcagcgagcgccacaacctgctgaccctgaaagacgaaaaagggcagacgcagggcgtgagcatcagcagcatcgacagccactaccggctttaccgggagaaaaagcttgagctgcgggagggcgagcagctgcgcgccacggccgatctcggcagccgcgccggcagcggcgagcggctgaccgtcaccggcgtgaaggagggacgctggctgtttaaggacaccatcacgatggagaacgctaagggagagcgcgtcaggctcgaccgcaacgcccctctgtacgcggattacgcctacgctgaatctttcggcgccacccggcgcaccgaaggcagcgtggtggcggtgctggcgggcaaggaggtaaacgacgcgaccgtcaacatgctgcgccgcagcggctcggacgtaattgcgttcacgccgctggacgaggccactatcggtcggcggctggaggaaaaccgcccggtggtcagcgtgacgcagggcatcaaatcgctcgccggggaaagcgatctgacagacgccctgcgcgagctggagtcccggaagatgtcgcagccggagcgcgcgatgcggctggccattgagaaggccaccggcacagaggtgacgttcacgggcgtccgggcgctggccggggtgattaacactgaccgcagtatcacgcccgagcgcgcgcaggaggagctgtcgcgcatggtgcagcgcggggagatttttgaactcagcgcggagcagggcgcggccgggaagtacatctcccgcgagaattttgagaacgaggtatccattctgcgacacgtcgccgaaggcaaaaatagcgtgaagccattcctggccggcggcctgaatgaggagaaggccaccgggctcacggagggtcagcgcgaggcgggcaacctcattctgacgacccgcgatcgctttaccgctatccagggatatgccggcgtggggaaaaccacgcagtttcgcacagtagctgcagcacttgctgccgcagacaatgccccggacatccgcgggctggcgcccacgcaccgggccgtcagcgagctgtccggcgcgggtatcccggcgcagactatcgcgagttttctcagcgaaagcagccagtggcaggccgcagggcaggcgcgcgacttccgcaacaccgtgttcgttatcgatgagtcctccatgaacggcaacgcccagctggcctctctgatggacgtgatcgccgaaggcggcgggcgtgcggtgctgagcggtgaccaggaccagctgaagtccctggagtccggcgcgccgtttgcgctggcgctggagcgcagcgccgccgacgtagcggtgatgaaggaaattgtacgccagatcccggcgctgaagcccgccgtagaggctgtcatcgccggtaacgtgcgggaggcggtgcgcatctcggcggaaaccagcccgcagagcgtaccgcgccagccgggcgcatacgtcccggagagcagcgcaatggacggtagcagcctggcacaggcagggcctgcaggcgcagatggggaggccgaaaaacctgacctgaccggcatgattgccgacgactacgccggccggacgccggaggcgcgtgacaacacgcttatcgtggcggagctgaacgccgaccgggaagccatcaacaatgcggtgcacacgcgacttcaggagcagggcgcgctgggtgacggtgtcacggtgccgctgctggtgcgcgtgaacaacagcaacgccgatctgggccgtcagacgttctgggaagagcaggagggcaacgtggtacgccggggcgagcagtattaccgggtcggcgaaaccgacgcggagagcggcgtggtgcgtatggccgggctggacggtacagcagaccgctggatccgacccgccgagttgcgcaaagaggaggtggccgtgttcagggaggtgcagcgggaaatcagccccggcgaaaaaatccggctgacggcaacggaccgcgaccgcaacgtgcgcgccagcgacatggccgtggtgtcaggcattacgcaggagggaaagattctgatcgacaccggcgaccggcagctgtcattcgatcctgctgcgcgctacgccgaccgccacatggactacggctacgccgtcaccacctacagctcgcagggcgcatcggttaagtaccttatcggcctgtttggcgaagagggcgccagaggccgcatggcggcactggacagcacctacgtagagctctcaagggcaaaggagcacgttcagacctacttcgacaatctgtccggctgggcggcaaaggtggagagcaaaagcggccggcgccagacggtgcacgatgtgctgatgcgggcggaggatgtgcgggcggaccgggagatgcaggcgtgggacaaaagcctgccggtatccggcacgcggctggcggaccgggtcgatcaggacctcacggcggacgcgcgctttatggccgggaaaacgccggagatgctctggccggtcattaacgagcacggccggcagcgcggaaactggcacgttccggtgtcgccctcaagcggggaggtgaatttttcagccgcccactatgaaggggccgcggacggcagacgtattgttctgcagcgcggagaaaagcacggaaaggtgctggaagccgcggacgtcgcggaggcgctccagctgatgaaggataacccggacagtccggtagttctctctgctgaccacagtgaacgttcaggcgataaaggcgctcctgcagaagctgcaacggccacatcgggcggtgaggagctggatcgtcgcgaagccgaggcgctggagaaagccgtcagggccgcgctgaatcaggaggagaaagagccggagcctgcggtgcaggatgacggcagggagtcaccggaagacaaagaccgcgaacgcgaagccgcgctggcagcggcgctggaggagctgcaggaagaggaggcatttgattaccgcgactacgacctgtcgccggagcgggaggagcgctccgcaatgatgaacgatgaagtcaacgtaatgcgccacgagcgcagcgaacctgagccggagtttggccataaacctcaaaaaaccctggagtagcccctatgacattactgctgattgcggccactgtggccgtttccctgatgatgctgatggcctggatgcctgagttcagatcaaaaggcgcactgcttcgccgctggagtaaaggggggggagagccccgctgcagtgaagctgtgcagagcatagtagacgcgttcattcaggatttttctgacatgcatattctgaccgatgcggaaacagcgcgcatccgggatatgaaaatccgcccgggtatgatgccggtgactctgttgctgcatccgcagctggtgacacgggaaaaaggacgctttgctcgcgggcgaaaccttaccgccgtgtttgtggctacaggcgtaagcgcgcttatcatgccaccgctggccggcatggccatgcataacataagcctgtggctgctgccctttctgaacacggcggtgttttttgccggccttcagctgctgcgtcacgcgtattccgacctggtcctgctgaacgtgctggttaccggcaaggcagactgaacaaacggcctgccgccctgcggttggccggtccctcgcgtccaggattgaaaatcccgcacgctcacgacccccggagaacccttatgaaagtcatttttctgccactgctcctgagcagtctgacgctgctgtcgcctgcggggcacgccagcgccgcacccggtatcagcgtcggtttttccccggaaggcagcgctgaagcgctggtgctcggcgtcatcgaccgcgcccaggccgacatccggcttgcaggctacagcttcacgtcccctgatgtgtccgctgctctggtcagggcaaaggcgcgcggcgttgacgttcgcgtggtgcttgatgaaaaagcgaaccagaatcgcaaaagccaggcggccatcaatgtgcttacggcgcgtgacattcctgttcggcggaatggccggtatgcagccctgcacgacaagtttatcgttgccgatgggcgaacagtcgaaaccggcagcgtcaactacacccgcgcgggtgcccggtacaacagcgaaaacgcgctggtcatcgagggtatgccggaacttgccgatcgttatcttcagcactggcaatcccgctgggacgccggaacagactaccgactgtcgtactgacagccgcagcttatcgtccgtaacgccggagcagtcagttcgccagctgctgctgtggtatcacaaagaaagggcattactgatttggcttatggtattctgcggaaagtcttattttgcagcagggtacgagcatgagcccccgtgattcagaaacatcagctcccgaaaagaaacgcacccgtaacagagagcagccaactccccataaggatcgcgttcgcgcctataaggcgagaaagcgtgaaactcataaagaaatcagcgtttttgtgaggcctgaaattaaagaggctctggtgaaaatttgtgagttaaaaggaataacgcaggccgatttcctggaaatgatgattgaggctgaagctcgcaacagtgaattactgtagccggggtgacgttattgcccaaagcgtttctgagtgatagattacggacagttaagaatttatggctggccacgcctgaaggtggcagggatctgaggcggtaagaccaaatcagaaaagaaaaaaccccgaaaatcccttcagtttggcgacggatgaggattaacggggtcccactcttatagtgcacaggattattgccctgtgcagggagtatagatttatggccagaaaaagacaatccgttctgggcttactccgcctgcgcaatataagcgccggcaggcatgtttaagcagacgccgttcactacatcttcacgacctgacaaacgccaccgtggcgatcattccactgcctgcaaatgctctaatccggagtggtttgcaccgaaaaattacagacgtcttcccggtcagatggggcacgccatgagccggcttgtagccaaagacaagcgcacaggcaaaatgacgctacgccagcgcatgtcccggcatccctattttgtccaccttcgtgatgctgcaggccggaaacgtgatttccggccggaaaagcaggcgttgtatgacgcaatgtggccgctgtgcgtgcagcgcgcagatttggccacgtcagtggtcacctttaacggcagcaaactggctgatgagctgagcccgaaagatgaaaatggcgacgtcattccggaaacacgcgttgaacccagccggatctcccgcctgtttgaggaatgggagcgctacggcctgattgagcgtcctgatctggaaatggacccggttacgggttactgcatgccgcgacatatcgtgctgaccgatcggttctggcagctgtgcagcatcgatatgaataagtttcttgcggagcgcaatgagcgtctcgctgctgaggctgatggcatcattgatccaggcacgcacgcctcagtacgcgccgctcgccggcgctggtatgaaaatatgcgcatggccactctgataagccgtcgcgaaaaagcgtcaaagcagaagcgccgcaagcgcctgagcaaactgccgctcgatgacaggcgtaacgcgatggccaagctgctgcgcaagcgtccggctcacgtctggcgtaatcttccgacagaagactttgaccgcctggtctggaagtgtctgcgacagctggagctgggtctcgactatgagcccgtactccctgaaatacccgatatagtccactgacatacccactcattttaaccgccttgactggcggtaaagtcgtttgtgccgggcactgaatgcccttttctgagccggtatttcccagaaaattcacgaatcgtggccgcaaaacagcgtgctgctttttttagccacagttacccgcaattaatatccacaggttacaagcaattacagtcagcgctacgcgcaaaataatcctgacttacgtcagaaagaaataatcaaaataactagtaaggttttcataccgacattttgcgtggataagtttaatgccttcgcttgcagcggccgcacgcgaccgcgccgctcagaatctaaagattaaggtagctcccgccggcaagcggcgggcagaacatattagttacaacactcaatggtaagtctattaaccccactccgagcagaaccacaaaacaagagcccctctccggcaaaacccggagcagtacctgaaacccggttgcccccactgaacagccgccgccgcccggcccagagggccggaactgcagtggctgataaatgggtgttgtaactagttagtctctcattgctgttagaggagccgctgtttctttctttcgtctacgaccgtcaggctgataagctgctgacaggccgctgcgtaaacggcgtctggcaggaacgggggggaattttgccaccatcagccctgtaaccggctctgccgggcttacggcgcccgatggcatctgtaagccgtccttaacagtttatggcgcctccatgccgctgacgcggcatttaaagggcatgctgcgcatcactgcaaacatggcttttgccggtaaccagtcgcacagctgcgactggttaccatatctatgtgctgaggcagcggtggaatacctgatttcgttccatatacgtgtttaagacacacgtccgccatagatgacactcagcgcccgccttgaataggcgagtagctctccagtcactacagcttcgctatttgctgaggaattagtgtcgtggtgaaatctaccggcataggtattaatttcgttaagctcttgcaccagcgccccagcgtgaaccaacggactgtccgctgccgcatccgcaatttttctcacaatatccccaaagagcaatcctggcgttacgtgaccggggtaacggcggtggagatagccctcgagcagtggacgtatagcgatggctacgtccctcgcaggataatcttcgcccctcagatacccgctgaccattcgatgattgctgtaatacgcggactcgcactcacggttaacgtccaaggatgcaaagtcactataatccccaccgctatgcattacctgcatgcaggcaacgttctgcagctcttttcgcttttcgaattcatcgcgcagggattttaggaagtaaacatcgtgcgccatgacgataagctgctgacttgagtcatagattgttttaagaatgctcagtgtctgcgttcggcgatgccggtcaaggctgcacatcggatcatcaatgactacaattttgtgttgcagatccggatcattcatgacgacagcgatgaaaaaagcaaaggctagggtgcgcttatcgccctcgctcagcgacgtgttaaatgatccttcctcgccgttcatagatagccgttcgccccgcagttcaattgcatattctgacttaggctcaccgccaccgctgtagttatagctaatttcccgaatctgaaaacgtgcaccaaagttatcaagcaaagtattaattgctgtttcgtattgaccgagtgtttgcttcataacgctatttaatgcttcccggcagttttctctttctaactgggcctgcttttctgcgtcctttgcctgatgataagcgcttaccaatgcgctaacttcaattgaaaaacgattttgctgggccattagtgccttcaggcgtcctttcagttcttccacggacatttgcgaaagatgttcccggtattcctctatgcgtttgtttgcggctgtagcgctagtgttatagcgctcaatatgatgattcactacattaagaagttctacaatgcgcgcaattagctgagcgtctggtgccgtcagtggtgatgcctttttctgctcaataagcgatgacagcagattatctaaactgacccggtcggcttcagcttgcgctaaatcgattaactctacagttgtaccggtgacatcgttccagatgacagatgttgattcagcttgctccatgcggcttcgaagtagcggcatgttgattacgtcaattatccggcgctgaagatcgtcaagaccagcgacctgcgctgaaaggcggcgaaattcatcattgaagcactcctggtaataattaatgagttcaataccggcaaggctctgggagcaaaaagggcacttatcatttcttatgtagcccaaacctgtatgtgcccagtttccggaagttagccttatcaatatgctccaagtgttccctgaccgcttcttctgcccgcgagcttaactcttggtgagttgagattaatactgagttaagagcatccagatcgggtgcataaagggggaatgttgcatgcgcttttcgcgcttttactgaggcgatattctcagcctgacgcagctgctcttgtacggacgcaatgtcttgttcaacactgctcactgctttcatctttaaataggcggctaacggtgtactttcacggtgtgaagtcagcttttcttctgcggcttttttgagacgtgttttatttgccgccgcttctgtagcgcagttgaacctggtcatcgcggtaacggcaggtttacccagtgcaaagctaagtaggcgcttgcggtgcgatgcgttgatctctccaccggaataaacgctgctttcgacaaaatcaaggtcgtaaacatgtacgctttcatgctgagcattccactgccctgcgctgaaggtggcgcggtttccgtgggtaaaaagcagttcagcgtgctgcggcttagtctggccaatcgtgcgtcgcttaactagcagccggggctgattatttgcgtaggattttagcatcgcggccagcgttgacttccctcgcccattatcggcatatattaatgagagtttgcaaaagcgatgcgcactagctctgatgtcggcaaacacacctataccggtcagcttctcgattctttcaagcacgtaaatttccttatatggttacagtaaccctttgccgcctgaaaaccgttatgtaccgtcagttgacgtaagcggtgcgggcagatattcgcttttatacaaacttcctctgcagtattcaattagccttaatccccccaaagatagattacgcattttttaaaagaaagagttatgctgatagctgatttgttctgttagaaagaatgtgctaagtgtcacggttttcgactttcaaagacgaagatactgcttaagttagggtttgatagatccacgttggatttacaatatgttttatataaatagaagtttaaatcgtgaagtgtcaagctttagtaaacttttttgacacttaaatacaaaagtatgccattgatttaatggtagtaaattgaaaaggaatacatatggcaaagataataagtatgattaattggaaaggtggagttggtaaatccacactatctttgcatctggggcttggtttgatgcttggatcagatgcgaagccgaaagttctacttattgatttggatcctcagtcaaacttatcgtatcttgcgctaggagttgggaagtatgttaatcatgtttatactcagaaaaaacctacattaaagaatatatttgatgattattttgatggtaaagtatttaatacccgagacgctataataaagactcctatagccgctaatccggggaaagtttggcggaatgttgacttgctgccttctcatcatgaattagttcttattgatatgatgttggcaagggagaagaaaagtgcgtcaactcatcaaaaggaaaccgaacttgaacttgaaaagatggctataattaaaaatgccatagatcaagtttcagatgactacgattacattattcttgactgcccacctaatattaaccttgttacccaaaatgctttctttgcgagtgagttatatcttatacctgcaatccctgactttctgtctacggttggtatatctctaataaaatctgaaatggataagttgaataaaaactttagaggcatgattcaatattcaaactcaaccattgattttaatgacactaaaatgcttggtattatattcaatatggttgatgaatatggagaaaaacctaaagaaactcatgaggcgactataaatgatgtaagtaaacaacatcccgacatggtgtttgaacattacattactgatggcgatggtatttcggttgcatcagaaaataatttaactgtctttagctacgactctttacctcgttctaaaccaaatgctgagaagcagcgcttatatataactcaggtagttaaagagctttatcagaagctggagaatgtataatgaaaacgcacgaattaatttctctggcggaatgtatatctaagataatggcttactatccaaacaaaagtgtagaatatgcattaaatgatgtgttgagtatgttgaataagcgcagtaatgaaacaggctctaataagaagcttaaaaaaaattttcaatctcataaaaatgacaatgccaataaatatttttcaaaaagttctttacatagctacccccatgacgaaagtgcaacgttgagcagtaaacctgacgagtcattaaacgatttacccctcgtcgaattaaagagaatggccagcgaaattggaattagaacatcatcaaggcaaactaaagccatgttggtcatgaatatctcaaagacaattgaaagaagggagattgattcaacaattcaagacaaagataaagataaagataaagataaagataaagaaagttaactattgctaatctgtctgcgcttcaaacctccgaggcgcagatataaaattatgggaggcagtaaatataaactttgtttatttcatttttatgttattcagttaaattcgttatcttataaaaagtgttctaaatagtggaattaataataaccatactctgagtgtaacattttacctattgaaaattaaggagtattttttatagcaagagataactcaggagttgggatgaatgctaattatcagttgcaattaatacaaggagaattcttatgctaatttttaatctgcacttagttctttctggccttagatgccgctagcgaggtttcaacaaatttcacgctcatcatgcgttatatttgagggaattattatgcaagtaactgaaatagaaaaacgggactcagaagaggcataccgtctgctgggtgaagctgtactcatgctggccgatgcgggactcgaaaccacccggatacggcttgcggggatattccgctcggagctcgatatacccggcaaatggtcaccgggcatggcggacgtcttacagatcgttatcgataagctggaaattctcccggatgtgaacaatgcggagccgctcttaaagcccgggccgatatcactccggttatcactggtattgaaaccgatggccgtacctctgttattattcactgtgccctttgaagataagcggagaaacgccaccggtttgcaacctgatgccgtgccggttataaattgagtaaatgacgtaccggttacggagggaggatgctgtggaagaagaacagggactgaggatagcgctttcgccggtgcagctggcagccgtactctctgatcgcagcgtcagtgaaggtgaatcagccagtaaccgtatatccggcgggctggcgctggcgggtggcgtggtggaaatgttcggtgcaggcgccctgtgcgtggtgccggagcccaccatgctgaccaaagccggatgcgtctttgtcggaacgcacggacttgataccattcaggccagtctccggcaggtctggaccggcaggcaggtcagtaccgatacctttaattccgccgtggcgctcgcggaatcgctcggtgctgaccgccagaccgccatgaaggttggtctgacggtcgatatcgccataccaatggcgtttgcactggcggccggcgcagagcgggtcattgcggtacgccgcgggcggttcagaattgctgagcacgagtcactttcaggacgtgcgcccggcggacataccatcgggcgacacatcggtaagtcgccggatgagctgcgtgaaaggcttgtcagggagcccagacttgaagaatccagcagctttaaatcactccgtgaggcagaggcaatcatcagccgggtgctggcggacaataaaaatcagatagcgatgtgggtgaagaacgttccgcctggcatgcgggcccgcatgcgcctgagccggcggtttgcgcaccccacggggattatggtacgcaaagggaatcaggagaccgttacctgttatgccgtccgcgtggtgattgatttcaggtcatttaacggtaaaccctattttattctgactgcgtttccggaggtatagtggaccgtatcagcatcagcgaactggataattttatcggcgtctatttcggtcaggactacgttatggccgaacccgggcatgagatagagcccaaaattcaggcctacattcacgacatgcccgacgcgaatcttcatgccctgctggcagacattgaactgtttctggacgggtgcgacgataccgagctggatttccgggcgcattataagggggagtttgtgccggcgaactgggacaccacggcgcaggcgtttctggcgcgggtacaggccagggtgtctgccgcgcttaaaaaccgtgaacgctgatatccagccgtcgatcccagcgaagcagtcagtattgccgggtccctgttccttcgggttccctttttacaggctacagtgaatgcccggggtggctcagaataacggacatgcagcggacgagccgccagtgaacagccggatatataccgttgtattttaccctgcacgggcattctgtacgtgcgacccacatttttacgattaacgatttcattcatccgggacctgccaggaataacgccatgaacagacatgaagtgacgtctgcgcttttcagcagcgcgggatacgatgcgaccaccggcgtgcttgagctggagtaccggaaacggcgcgtgccggcgctggctggccgtgccggcaaaggtgtatcaggccttctgtgcggccgcagacagcgacacttttttcaggaccagcatcgatggacgctatctctctgtgcggggcagcctcagcctgcggcgcgacgtctgaggccatcatctgcgcgtacgcatcatagttctccagcgcctgctggcgacagtagatgttgatcaagtcagcacgtgccaggcgacggtgctatgagtgaaacataagacgccaaagccagttatcaccgttaaggcctgaaagccataatgctctactttttaatcgtgcttacaataaccattattacattgatgcatcgcactgcccctgctctcgggcaagaacagcctagtagctggtgtagaatgcgtcaatcagctgcgcatggagagtcgaggccttcttcccgaccacgccgaaacgcctatcggctttggtgatagcggaaacctcttcttacgatccaaattccaggtgtcagccgctttgaaggaacttctcttttagatgcacagaatccggcttcagtacgtcaaggcctgcggcattgcgggatagcagcgtagcctgtaccgcctgaaggtggctcagcgcgtaggcaaacagcccggctaagttttactgtcctgaagactgctgatgaagatcgtcaggaacactgaagcagaaactcagttttcgtgagaaaactggaaaggttgcggaggcttacttcagcattccaagatacataggtgggcatgccataaggccggcgtgtactgccggggtgagttcatttgccagaagctcggactccccggcttcaagagaagaaaggggcatacatgcgatatcatccggtgcagctttttcatccggcactcctctgcccatgtcggtttccataaacgcgacatgcagcggcaggacttctgttccctgcacgtttaaatcctgccgaattactttcctaaacacccacattgttgctttagaagcgctgtaaattcccggcaacgcagcccagttgagcgcggaaatgacattgatgaatgcactactgccctggtaattatgccgagcagcgtttatagctatttccggctgtggtggacgccccattaaagcgcctcattcggcgcgttcgtttgctcaaatgtcggaagagagcgcaaggcatacacataaacaggtaacagcatgtctgcaaaacgaagttatggagatgatacctaaaattaataaaagttatttattatcaatagcatatggatcttctaacgaggaaaaattttttggtagagggcctgctagttaaagatcgctaacgcttaaatctgctctatcacgttggttcagcatacgtaaaaacattaataattaatttgtttattacttttgagtcaatttgtgggatgggattcataaaattagcaaactaattataaaaattttaactaaattaaatgtaaatgtctcctacaaaaaaatcgccaataaacaccattataaaaaatatgtaattgatatatatatacttttctgttggcacttgtgagttaaatctcatttatgagaatagcaatcattactattgtcatttgtattgacattaacttacatatgtaggaatttgtcagcgggagttttacgattttagtaaaacatttctaaataagtgaggataaaaaatgtcaaacaaaactaacgtttcaaagccatcccgaaaagaagtgcttgtcagtgtcaaagcttctgttgctacaaatggtaatggatctggaagtctggtagagggacgtcggcgcgtatatcgttgctcaagtttcaagcggtatcggtttcagtgtttgctgatttttccagttgggagtgataagtagccttttttaaaaaaaggatgagaatcatcaatgattctcatccttaaaaattcaacatttaaagacgtgaatgcctttttatccaagggctgcaaatttgcattaatcaataaagccagcccctccttttgggtaacaaatgcatgcgcgtgggtttaatgaataaaacaggtgtgtcatgatgttaagccgagagcgtatttataaaaataaattaaattctgaaaggttattgattgtaaaaaaaaacaatgacgtatgggagagcgttactgaaagtcagatagatagccatacccttgaaatagattatgctaatttaaagaggataattacaggtagacaacctttaaatgacttttcgctattaaaaggtataaaaataatcccacccggctttagtttaagaataaatgaagacaccgaagttgatggtgaaattttctttgactggaatagctgtgcacatacagatgtcagcatgaaagatggcgcagatattttgtgtgaatatatttcatctgtggtaaaaaaacatcctggtaatacaacttatgtcgtgcgattcagtggcggactggattcgactggtatacttcttgctctggctgagtcagtaccaataagccagatagtggcattaacatatacctttcagtatgggtcctgtaaagaagatgaacatttttcaaagaatatatgtcatgaattgggcataagaaatttgttcatagaatatcacccaaatttattgtttaacgagcttgatgagtgtccattaccaataattgatacagcatatgtgagtggggattttttcaaagcagagttcgattttttatgcggtaaacttaaaagtgaatttataatattcgacggtcatggaggggaccatgttttttgcgaaacaatcccagatgacttaataggcgaacttgcaagaaatatgcggccttacgatgcacttaatgcagcaatcaaattaagcaggcttgaaggcagaagctttgctagtgtatgcgggcttaataaaaagaatttaaatattttgcagtggttctttaaaaaggatataaaaaccgtcagaaaagtaagggcgaatactattgaagaagctatttttgaaaactctctcgatgaaatgctgtttaaaaacgcagaggtatatcacccattcacttgtctggaaatgataaagcacggagttaatattgatgtatatagatcttttaactctgaactaagaagacttgattacagaaaatccataaatagaaggtttaatttcagaatttccagggttaacaaaggacacataacaggtgcttatcagcatgcaatcagattaaagcatgataaaatgctggacttaattgagaatggtttccttatcaagagcaggctgtttgatgcacaggatatgataaggagcgtggaaatggtttcaaggggcgctggcggatttagtgtggagttaatgaactttataatagcagaacttattttgaagaaggtttcgaatgtctaaatattatttctcagaaaaagttcatcatgttaatatagaaaatgaaataaccatattagatgaggggagtgatgaatattttttattatcagaatcgcaatcttctgatttaaaattatttatggaagaagggatcttatcttcaatttcatcagttctacttgagcgaggtgtgctgaatagataccaaggaacctccctcaagagtccggaaaactctcctctcggtgcggggatgctaaactggacaactcatttaagagcaagggctaaatgcgatttacgctatcttgctgcagtattgaaaacgttgttttgggtcaataagaacctgaaaaaaaaaggattaggtttctgtttagagcactgcagaaaaataaaggaccttaaagaaccatatttcacatcggatgagcatgatattgctattgcgaatcaaatcgcgaccttgatacgatttgtttctccattaatgtgttttaaagttaagtgtttagagtattccattacgctatatattgttttagtaacgttaagggttaggacagagctgagaataggatttcagcggtatgattttctttcacatgcttggataacagttcataacgttgttattcaggatgacacagatattgaaaataaattagccgttataattagggtatagaaaatgattgatacaattttcgataaatttagatcgggtatttccgactacacgtgtgcctacaatgtagtggttggaacttataaaaattttagaacttcatttttcttgctttccttctttttcatatctatatctgtacttacagctacactgccttattttcttaagaaaactgcagaagcatacattcatagcgattcatatgtcacggctttcttttgggctgcaattacatatgcatttttgtggacgttaaccgaagtgcttgaaaatgtgaaaggaattttttcagcccacgttttgggcaggagcgaagcggcgctagttgaaattgctttgaaaaaattgctttctgtaaagtatgtcattcaaaagaattttgatcagggcaccataacttctaatataagcagaggttcagtagccttttgcgatgtaacggtttctcttttctggactcttattcctatcggatttgaaatattcacagctataatttttctgtatcattctttaggttttgcgtattcggctttttttcttactagtattatatttttggtaattatagcagtttttgttgctgttaaaagcaggaacatacacgaaaacctgatggatgccatgaatgaaatttcagattattctgtttcccgtttaagcatgcctttcgaagtcaggatcaatactgcaaatacgcgtgagaccgtaatacgccaggatattctttcaaattacgttaaaacggttatagcaactaataaaaaatctggttttttattaattatacaagctgtagcgacaggtatcttgttagcactatctgtttttgccctgatattctttaaaaacaagaacggaataggtaccggcgattttataatgattgctgggtatattggaatgttaacgatgcaacttaggctcattgctggtgcatgcatcgatattcaaagacaagttgtttatcttaggtcaattctgcaatacactgaattagaagagtctggttttaagtgtaatataattcaagactatatttcagataatactgtgctttttgaaattaaaggtgttcagataaaaaatacgataaaagtttcttctgataaagtttcgttctcaattttacaaggtatggttactgccttgtcggcaccgtcaggttttggtaagtctacaattttaaattatttggttgggattgaaagtcctgagaacggatgcgtttacttcaaaggtgctcctgttagcattgataacagtgattcacttctttcaatgatatctgttgttcctcaaaaacctaggttgatacctgggaatgttaaaaacaatctaatgtatggtctcgaaagaccagtaactgacgaagaaatgatgagactgctgatggttcttgatttgattcctgattctgaacatattactgactacagttttttatacagagaaacaaatttacatggcaatcttagcggaggtgagatacaaagaatttgtattggtcgtgctctactcagaaagaaggaaataatcattctagatgagccaaccagtgccattggagagtcgctggcaattaagctaatagatgtaattcgtagagaacatgcaacagtggttctgatatctcacaatcaaaaagttctaagtctttgtgataaattgatagatattgataaattagatagtgacaaggcaagcaaaaaaaatcactgttcatgaattttttttgataattatcaatttgatgcctgaatcacacactggtctaatgcattttagtgtagcagaattaactatggatagaataaaaatgaaattcaaatactacttcatcatatttattattttcctcgtttttttaatatttctgctaatgaaattttacatcaatccctcacaacaggtctcatacatcactagcagggcccgtctgggggccattgaaagcacagtactggcatctggacgtttagatgcatttgagcgcgtaaacgtgggtgctcaggtatcagggcaggttaaggtactgcatgttcatgccggagagcatataagaaaaggacaactcgttgcagaaattgacgatgtgcctcagcgcaacgaaacttcgtaatgcggagtcagcgctcgatgtgattaagtatgagcttgaagcgaaaaaggcagagttgagtcaatctgaaaagaatctaaaaaggaatgaggtcttatacaaaaaggagttagtctcgctggatctttttgaatcatttaaaactaaatcggaagttttacgtgcagagtttcagtctctcaaatcgcggcatattcaggctactattgaagtagaaaaaagaattgtcgatttaagttataccagagttacagcacccatggatggtgtagtaattgctgttataactcaacaaggacaaactgtgaactccagccagagcgcgcctgttatcataaagttagctagactagacgtcatgactgtaaaggttcaggtttctgaagctgacattactagggttaaagcaggacaaaatgcatactttaccattttctctgaacctgagcgtcgctatatagcaaaacttaggtctttagatctggcccccgaatctgttttaaaggatgacacccttgtttcagggtcggtggctgaaagtggtggctcctctaatgaatctgtttattataatgctttattagatgtacctaatttagataataaattgcgtatagccatgagcgctcaggttacattgatctcagataaagctaacaacgccattttgatacctacacaagcagtgcataagatcaataactcagaaatatatgtggatgtattaaatgaagataacataattgaaaaaagaagagtttctttaggcctttctaatggagtagagtctcaggtattagaaggtttagcgctaggcgatatggtgattatatctggttcaacggaaggtaagaaacaagtgagattttctctatgaaaaatatcattgagttaaaatcagtgtgtcgtgagtttttagttgcagaaaaaaaagtaaaagtcttgagaaatattgatttgaaaattttatctggacagtatgtggctataacaggtccttcagggtctgggaaatcaacattactcaatattattggatgtctggataaaccaagctcgggtgactgctatataaatggtcaaaatttaagccagctttctttctgtcgtatctcagagctacggagggtgcatataggatttatttttcaacgttataatttgataaaaaatttaactgccattgaaaatgttgagctccctttgatttattctgggatcatacgtgatgctcggagtacccgggcatcagacttgctggataaagtcggtttgaaaggtcgggaacatcataagccatctgaactttctggtggtcagcagcagagagtcagtattgcacgtgcacttgtgaatggtgctgaggttatacttgctgatgaacctacaggagctcttgattctgaagcgggaaatcaagtgctggagttattaaaaaaacttaacgagtttggccatacagttattttaattacgcatgatttgagtgttgctaatcatgctcagcgtatcattcaccttaatgatggagttattgagtcagataagataattaaagaaacacaactggtgaagttatcacctgttgtattaactaaacaaagcagatggaaaaactttattgacaagctttatgactcaataaaaattgcttttatgtccaccatatcacatcgtctgagaactgtcttgactatgataggtatagtttttggtcttgctgctgtcgttacagttattgcactgggagacggagcaaaacagcgcacacttgaaaaaattcaaaatttaggtgtaaacttggtaagtatttttcccggtaaagattatcttgactcaaattcaaagagtattgataccctcacattgcgggatgcagcagcactaaccaaacagagctttatagatagcataagccccgagataaatggttcaaataaagttcgattcaaagataaggcagctgatgcatccattaatggtgttggtcacgagtatttcagggtaaatggcattgttttcctggaaggtgaaaacttcagtgatgatcgaaacgccttgcaggaagttattatagatgagaaaggcagagatttattgtttgataaatctgataccgccttagggaatgttatatttataggttcagtcccggcagaaatcattgcaatagtaaaatcaaatgatcgagattttgattcagaccattttaatgtatggatgccttatagcgcagtcatgtacagaatcgttggtaagacttcattagatagtatcagtgttcgtttaaaggataatgtcgacagctctgctgctgtaaaagcaattacagagttactgctgaacatccaccgtagcaaagattttcatatctttgattttggtgaagttcggaattctgtcgaatttacgtctaaagtttttaatttcctaatcgttatcgtagcatttgtctctcttctggttggaagtattggagtaatgaatatcatgctgatatctgtcgcagaacgtacctacgaaataggtatccgcattgcaattggagcaaggcaacgagatattatgttgcaatttatgattgaagcaatactgatatgcgttattggtggtttgattggcatttttctttcatatcttatagttgaagttttaaattttactgctggcgaaatattgcattcttcttactcttggtctgtggcaatactgacctttttcttctcaaatataattggtttaatatttggttatttgccttcccgcaaggccgcgcatatgaatcctgttgctgcttttagcagagaataaaccgcttcctcaaatgttatgtgaataaatgtcttttattattttattacagctgatacttttttagttactgcattagacgaaatctggtcagcagggccagccggttggatatttactatgggtttgacggacagttgtgtaaaaaaccacgctaaggaaataattcattgtttaaatttaatggcctcaactctctcttcagaatatcctcctgcagcgtgaacgtataatgcccagcatattgatgtgcccgtgcatcagtggcgaaagccgggtaatttattcatcctctggcgtttcccccatcatccttagatgtgaaagcgctttctgcatttaagcgtgttccagagcgctatcgcattcgccaccaagcctagcgcactaagctgatctttctgtctctcacgataacttttctgctttcacaacgctgcccataacagatggcatctgagccgctcctgacagtttctggcgcctccatgccgctgacgcggcgttcacgggacaggctgcgtctgtgaggtacatgctatacaggctactgaacagcagtatgatgaattggaaaaggtttacaccataatcggcgccgtggtcatggcaatggtcggcgacgggctcgaagccacacggctgcgtattgccggattcatccgtgaagaactggtcaaaacagatgagcctgatatgaaaacggtcatgcggtatgcgatcgatacgcttgaaaactatcccgaccaggaaatcgtggagttacaccgcgacggtgatgacagggttctctgagagacgctgatgtcataaaataccggttatcagcaccacaatatactgtggtcaggcgaaaacctgaacgtcagtcaccttgcctggtgcgggctgattgccctgcataccgcccgccaggacgggtttgtgaattcacccgcgcaggacaacctgtttctgacccgctggctggccaccgccgagaagcagaggcgttttggcaggaagctcgccagcgacatcagctggctgctcagggagggccggggaaagggcctgcgtgctgacctccccggtaagcttgactacctgtggcgcgccggcaacggcaacctgcaggcgcagaacgacctgttccggctgcagcatgccctgcatgcggtaaagctcaccggctggatatacatggtgctggcagagagcgagtggagcggtcgccgccagctgaggctcagcccgtccgtgtcaggtatctacctggagcgcagggcgcttgacacaggttttgacgagcatggccggcagcgcattgccctgccggtgcgcatcaccggtgaacttaccgggctggatgtattactgaaccgctctggctggcgccgggtaccggcgggagaggatggccagatgcaccatctgctggctgagagcttcagtgatgcctgaagcatcctgctttcatttgcctgaatttcagccggctgataaagaatgagttatagcttgggcatttgatatttcttaacagtatatgcaaaccagcgaaggcatcgctgagggaagtttatgacggaaagcgagggagctgaattcaggcgccagatggatattgtaatgaaaaagtgcgcaatctggtaccgcacacaggatttcagccagatgaacgttggggcacgcgcagagctggaaagcctcttcagcaatggagagcagttcgaacctatgacaggaatgcagatttgacatgccccctattaatttacacaaagtactgttggaaatgtccgcagaacgctcataacggaccttagcctaccgtgtccgctttatgccagaagcggacactggccactaaaaaataaccagtcatcgcattttggttggcgctgaactaatctaatgcgtaaaaggaaactgcacactcagacgatcaaaatgcgacttgaattccgcatataatgctctggacgtgggggttatctgactccgatgaggagagataaaactaagcggattttttacgcctgtcagatgaggtagtaccggcaccagccggttttcagcaatatcctgatgcacatcaagccaggacttataggcgataccgacgccctcaagagcaagtctgcgtgaagtttcagagtcattacagacatagcgacttttcaccgagagggtatgcttttgctggttattgtagaaggaccagctggcatagggatggccattcagcgtaaacagaatacaatcccggtcagcaatctcctccagtgagtgcggtgcgccgtgatgttcaaggtaggcgggggatgcgacaaggatacgtttattgtattccgcgagtggcagagcaacgtagcttttatccggcagaattccgtaacgcacggcgatatcaacagggtgctgatgtacgtcgctgacagtatctgtaaatatcaggtttaccgccacctgtgggtgtttcttacaaaacgccgtgatcagcggcagcagagtacttctgccgacgtctgacggcattgaaatacgcaactcatccttcagtttccccagtctgattcaccagactttcacttcccgccctgatcacttccagcatctcctgagcatagggaagataggttgctccctctcgcgtcattcttaggctgcgggttgtacgcacaaaaagcctgacgccgagcgttttctccagccgcaatatcgcagcacttacctgtgcaggcattatgcctgactctctggctacgctggaaaagcttcccagctgagtagtccgcacaaacattctaacatcttcaattctgagcatactgcattctaccttcagcagagagatataaacgggggcataaagacaggagcatgcgtcatttacactttaaacgtgtaaatcttactctgatttgttggtttttatatcggaagattagctttagagttttaacaacagataagcagttacttaccgacatccaaaggatcacagtatgaaagccgttgtttataaagataataagttacccattacggatgcgaattcactttatgagaccatcctccctaaaccacaaccgggcaggcatgatctgctggtcagggttgcggctattgcagttaatccggtcgacaccaaagtgcgccgtaatgctgccgtgactgaaccacgggtactcggatgggatgccgctggcatcgttgaggcagtgggcgaagatgtcagcctgtttaaaccgggtgacgaagtttactatgcaggctctcttatgcgagcaggctcctatgcggagtatgcactggttgatgagagaatagctggccgtaaacccgcgtcactttccatggcagaagccgctgcgctgccgctcacctctctcactgcctgggagctgctgtttgaccgtcttgaggtggatgaaggtaataacgacgtattgcttattattggtgccggtggtggtgttggctctatcctgactcagtttgccgccagcctgactaacctaactattgtaggcacctgttcacgccctgaaacctctgaatgggtcaaatcgcttggcgctcaccatattattgaccacacacagccttttgcgcctcagcttaacgagctgggaatcagcagggtacgctacgttgccagcctgacgcataccgacaaacactatcatcagattgttgaagttatggcaccgcagggaaggcttgcggtaattgacgatcctgaaacgcttgacgctataccgcttaagacaaaatcaatttcgcttcactgggaactgatgtttacccgatcgatgtttaccactcctgatatgcaaagccagcatcacatcctgacggacctcagtgagctcatcgataaaaagataatccgtacaacactgggagaacattttggaaccataacggctgaaaatattcgccgcgcgcatgccgtgattgaatccggtaaagcaaaaggaaagatagcgctggcaggattttaaacctctgcatgctttttcaacccggcaccttttgaaacctataccgcccggctgcgcctctccattacggaagatgccgggctttacatgtaaaaaagagagaaaaaaatgttatatctggtttttagcggaaagatcaaagaagggaaggtagatgatttttataaaaatgttgcccgggtcagccagcaggcgacaatgagccaggataagccggttgtctatcagtggcataaaaatatccatgacccccgctgttttctgctgaatgagcagtgggaaagcgttgaggatctgcatgcccatttcgaaacgttatataccctgtttggtgaggccaagccaaccgagcgactgcccgctgcgattctggattatctcgatgaggccagcgtcgcctatttcgagcctgtagcgtaatgagatggccccttttcggggccacttctgatgagcaggctgggctggccggcgagctctcatatacaccaattacgggcacttatggctccgggacatattcctggcaccgcagaaaaattaaaaagagtaaacaataatgctaaaaaaatatacgattcaggctgccggtttattactaagtgtcctgtctgcagcaatatttgctgcgccttccgaacgtttctatggcccctgttcagctggccagtgatcagccatcagggaaagcggaagtggtcgcaactttctggcacgccatgccgaccgggattacggtgtcagaaaagggacgcatattcgtgaattttccgcgctggggtgacgatgtgccttttaccgtcggtgagctcagacagggaaaagtggttccttatccagatgtggctattaatgtggctgacaatacccgtccggctgaacgttttctgagcgtacagagcgtggtggcagatgggcagggaaaactctgggtactcgataccgcatcgccgggctttaaccggccggtagcgggcggggttaaactggttgcgattgatctcagcagtaacagggtagtaaaaacgcttgtgttaccggcaaaagttatccttcccgccacctatgttaacgacctgcgtattgattaccgtgtaggtaaagcggggatcgcctacatcactgattcttccctttccggaactggcggtatcattattgtcgatctggcatcaggtgaggcaatgcgccgcctgaccggcgaccgttctacctcacctgaaaaaagctttgtaccggttgtcgagggcgaaaccctgttgcagcgccatggggatggatcaactgctcccttcagcgttgcgtctgatggaatcgcgttatcggccgatgggaaaacgctctattacagcccgctgtcaggccgtcatctttattcagttgaaaccgcgaagctgagagacagtcacttcagtgagcagagcctctctgctgctgtccgggactggggcgaaaaaggggcctctgacggtcttgaatctgatgctgcaggcaatgtttacgcaggagattacgagcgtaatgctgtccgaaaaatggataagcagggaacctggtccacgcttgttcacgggccggaaattctctggccggacacactttctgttgcccatgacggatatctttactttaccgtgaaccagctgcaccggcagccgggcttccatggtggtaaagatatgcgcaaaaaaccttataccctcatgcgcgtgaaaatcgacgagaagcctgtttcaacccgataatactgagtgactcgctctatgttacttacgggttacgggtgtccgttagccacgaatatgactcattcagcccctgtaaaggggctgctatgtatgcttttcgctcatacgggacatccataatcacatctcctgacctaatggagattgaacatgacaatatccttggaacaaaagccgtatcattggccagaagcgacctcttcagatatctcatatctgaggaattcgcatccgtctcgagctggaaggaaaagtacgcgacctggctttgtttaacatggctctggacagtaaacttcgggctgtgatccggtgaagctgaaggtgtctgatgtagcctacggacattctgtttcgggtagagcgacagtaatgcagcaaaaaacggagaatcctgttcagtttgaactgactaaaagaaccagagaggcagtagctgcatggattgaaatggctcatctgcgcagtggcgactatcttttccagtggatttgaccctatatatccagtcccgcgttggttctgaacgccacatttcaaccaggcaatataaccgtatttttcatggcgggattgagaagttaggtctcgacgattcgctttacagtacgcattctatgcgcagaactaaaccatatctgatctacaaaaaactgaaaaatataagagtgatccagctactgttgggtcataaaaaactcgaaagcacagttcgttaccctggcattgaagtcgatgatgcccttgagatatcggaggcgattgaagtctaactcgcgagggctgcaacagcagccccgtgccagaagcacattggctaatattttatgttaataattagaagaacagcattcacccataataacttcctgaattacactcattaattttcaaatatgtagcatttaaattaaatctatttttgcacttttaattttatagtcatgggcagattcctggcaggtttgcccttttcaaaacgccattttgatacggctgatattacagcattatcgaataagtggtctggcgtagactcgataattctcatctggcttaccctgccttctgcatcaacgtcaaagttaaacttaaccataccttctattcggttcttgaccgcatagtatgggtaatcgggccgatcttgtcgaaggggctttggttgttcaactttaacaggtgaataagtagaacatgcgctgactacaagaacagccagaatcaacatataccgattcataacaatatccttttgttgataaagattatcattatacttaaatatcaacggaaggacatttgttgatcccgacggatatcgggttgtagccctaaaaaagcagtaggtataaccccaataaatcctgccaccgtcttgctgcaagctagacatccgctcctcgctcatagcgggcaggctgtgcttacaggtcggctccgtgccattaacatactttatgggtttgcctctcctccggatgaaaagttgatagtgagatatccttattattgcttaacaggaagatgcatggaaagtctgtttgtctacggaacgctgggaccaggccgtcctaacgctcatattctcgaaaagataggtggtacatggcgcaaagggcatgtctcaggctctcttatcaatgagggatggggaggcgaaacgggttatgccggtattattttttggataactcaggtaatcgcgtgcaaggattcctttttacctctgttaacttgcagcgtcactggcaggtgcttgacgaatttgaaggtagtcaatatgagcgcgtgcccgtcgaagttactacggataatggcgaaaccgtcaattcctgcatatacatgttaaaaaataatggccgtaagcccgctgattagcgggctggcttctttagaacaaacatgtttaaggtccgcttttcgctcatagtggactttagcctgatagctgtccggtttgtgccagaagccttcactaacaccttcatgatggctcgccaatatcatcctttgaagacggtgtatgttcaaatacgatttgggcgcgttgcaaagaagaccaccgctgccccaatagcgacgatgagcgtatcttcaatcaggccgctcctggtctgccccatccctgctatggcctttttgcgtgccgcaagcgtgacataggtaagtggcacagcggcagaaatagcaattactgcaccggttttttcttctccattgggtgccaacgcggcgcccgcaatccctgcactggccacccgtgctgacaagcccaaaaatacagtacggtctggcgctgatttcatcttgtcgccaaatagttcacctatacccatcgctaacgcaccgtatttgaatagtggacggtccagcagcagaagcctgcccgatgtttcatgcccggcaaggcgtgctgcagcgagggccgccattggcgtcatagaaacggcagctggcgacaagaccaatcaaggcggaatagacaaactcagttatttccatcaggtatcttccggataaaaagaatttctgctgccgcagcgtgtctgactctgtatgcaaatgaaaaagttgactacggcgcggcatcctgtgcaaatgaccactgcaatagtcagtatagataaacggcttgagatagtagaaatggtggaagtggaggctgaaaaatgggggcagcactttatttgccgagccaaacctcagcgataattatcctggtgtaaggccgtcaagacaagcggctatgtgcctaccccattaactggtattactgttcatcaggaagagctcatgccgatcatccgcttttggctcacagcagaaattcgtcttatttcagtctgctttgtgcaagaaacggacactgcaaacatatgagcatactcataaacaagcggctagaatcagagcaaataaccaaagttatcatctcatttaaaattaaattatgtttttttcatacagtaacagcagaaagtgctaactatttttcgcctgatgccgataagcactctcagtaccgcatgttcgtttaagcggttctttgaatttttcaataaattaggtggaaaaactatgacgattacacagcggctgtttacattattttctttattggccgtctcgcttattactctggtgatcgtggcagtgctggtgctgacgggttttcagtcacgcttccagtatatacaaagtaatgcaaccccctccattatcgacctcggaaaactggtggacggcagtaaccagttgattatctggatgtaccgccatcagagcgcaaccgacccggccaggcaggccgaagtcgaaaagcggctcgatgagaaggtaagtcagctggagtcactcaatcattattatctcgaaaatgatatttccagcgaagaagacagggtaatgactgaggcagcatttaccaccattaaagacttccgcagcaggctcccggcttttcttcaggcctcacgcttgcagaatgaccccgtatcgcttgcggaaatccagggaaacaatggcagtggttcagccgcccgcgctctgattgccggctatcagaaacagcttaagctgaatgtggatatcggtgaatcgctcagcgatcagaatacccgaatctatcagaattctttgtggggtatgatcggtggttcagcggtcgttatttttgtgctggcctttttcgccgtcagaacgataaccggcatccggagaaatcttaatgccatgcgttccaccatgcagcaggcaagttcacgccttgacctaactctccgggttgacgattcgcgtcaggatgaaattggcatgacggcaagtgcatataacgagctggcgggtaacgttgctgcttccctgatgtccgtgagtacctcatcccagtccgtgagcacggcttctgcgcagatatctgcaggcaatgaggacctgtcagcccgaaaccgaggagcaggcggcctcccttgagcagacagcggccagcatgtcggagctgagcgaaacggtccgtcagaccgcagagaataccggcacggccagccagctctcgcagaacgcccgcagtctttcagaagacagcgctcagaaggtgaccacgatgctccggaccatgtccgatattagaggcagttcggcaaaaatcaccgatataatttccgtcatcgagggcattgcctttcagaccaatattctggcacttaatgcagcggttgaagcggcgcgggccggcgagcagggccgtggatttgccgtggtggcaggtgaggtgcgcaatcttgcccagcgttcatcgtcttcagcacgtgaaataaaagctctcatcgagtcatcaatgcatttcgtggaagcgggcgcacaacaggcggaagaggtcgggaataacatggggagcctgaaagacgccatcgggcaggttacagacctcgtcaatgaaattgcggctgccgctcatgagcagatgctgggcatcggtcaggtgcaccaggcggtgaatcagatggacgacgtgacacagcagaatgcggcacttgttgaagaagcttcagcagcctcaaactcactgatggagcaggcctccgtcctaaaccagcttgtagctgcctttgttgtcggttccagccctgtaccggctctggaaccggcgaccgccagtacagcttttaagtcgtctttacccggcgggcgtgttggcagggacaacgcggcgtcggaggaagaaaactggcatagtttctgatgctggagaaattgcatatacggctacagtcagaaggataggcatcctccattacagcggacactatattcgaatccgatgcatcccccgccacctgacaataaaagcaggtggcggcgagcgaatcaaacctcatacgcagcctgatcatataccgtctacctgccggtcccgttataacgcacttttttcactcgacctgccattaacaaatcgtggaatataaaacccagatttctcgctcgcagactgaaagcaatattatttcagtcttaccacacttttcgatttattccccgatctaacgtccgattttcgctcatagcggaccttgcgccaaagcagtgctctttgtgccaaagcagaagtagcataagcactgttatgttaaacacgtgacggatggcaggtaaaaagaaaaatgccggctgcccttatgcccggccggtgtgtgccgataatcatagtgtgcctcgccaggggagacataaactgattgttgttcgtatctgatttgcttctggctcctcctgtcctggaggagccatttttttgccgtccgcggcgtttgcctgcttgctgaactgcatttttcttccatgctgaagcggagtcgcttccatgctggagccggcccgtttgccgtaacctgtgaacgagaactgattgttcagtccgctccgaaagatggcgagtttttttacgggcaaaatcctggcgcctcaggcaccgccgcatcggcagaggcgaagcgggaatcggacatgacagccagttttttacccgctcacgcttgctgtcgcggcgattttttatatgattaagaccggccggcggctccggctgaccacgataaaagcaagagtcacagtattcctccttgtaccgccgtgatggcggtttttttgccctgaaagcgggcacgctgcggccggcgtttcgctgtctggtgcctgaagctcaggggcttagtcgtgatacagaaggtgagctccggggcagccatccgggacaaacatcccggatggctgaaaaaaatcccgaaacctggccagcggggccgggaaggaaagtaaggcagtgaaattcgcgttaagaaaaaccgccgcttactgtaacacgcctttatcatggatgcgcacgggcagcaggctcgcagcctgttccagccatgggattcgtgacctaattcttaggttaaaagtgagggactggcagagtcatataacgctaccagctggtcgttacttgagaatggccgttaggatactgctgaatacggaacccgttacgaaagctctctccgtcgtgacttcctctttccgcatttccgctagcctggcgagcgcactttcagcataggcagcgagaacctcttcaaactgcttttcccagccagcattggcgagttgagcggatttttccacgtcagttcgttccagggcggcgatatgctcaccctttttaaaaaagcagaactccggcatggtgtactccgtgaacagtattattgaccttctcgacagtaagcctctcaacagcttcaattgcatctggatcaccatgccaagccatgcagcttaaacaatcgccgccacaatcaagattcaatgattcgtgttctaaactgattggctggcgacaagtctggcaattgttcactttcatttgaagcccatccttatttaattttcgaagctaagctggctaacataccctctaatgttttgcttatcgctcattgcggacatcacctatgcacagtccgccttgtaccagaagcggactttcctgacaggctgctatgctcatgcaggagagcatagtagcctgtcaatcaggttcccagttaaggttcaatttctgcaatagttcaatgaagttataaatctggagtgttcagacagtgctgtcttttattctgttttttatctctgtaaatatcgcgcagacagtgctctatttgctccagacttcggccgcgggtttccgggatgaatttcagaacaaaagcgctgcctataacccctacaatgccatagatgccaaatgtccaggccagtccgaaggaagacaaaagtaccggaaaagacatagtgataattacatttgagcaccagagtgcacatacggagccgcccatacatataccgcgaattttagatgggaacatttctgacagcatcagccagataacaggcgagtagcagccctgcataaaacagaggaacagtaacattgctccaagaatgaagtagctgcgtaacagatttatatcagtaccaatttgttccggcataaaagctgatatagcggcaagcagaaacaggcagcaggtgcaccctatctgacccaccgcagccatggtgcggcgaccgatataacccagcaaaacaataccaatcaggaccatgatgacagacaccaccccgttggcaatggttgcaaacagtgaggcattagtgctcatgccggtattctgcagaataatgggggcgtaatacatgatgctgttaacggctgttgctgcgtggaaaaaggcgaaggtcacgccgataaaaaagactttacgcatccagggggtacgtaaatcctgcagcgaacctttttgctgtgaattttcagacatggactcttcgatctccatcatctcccactctacatctttttttgcccgtgtccggctcaggatacggcgagcctcagcaaagcgacctttaagcgcataccagcgtggagagtcaggcataaaaagcatccccaaaaagaggatgaccgcaggtagcgtggcaatgcccagcatccagcgccaggtgttctcgccaccccagagtgcattgagtgcgaaattggagatgtaagccagcatctgacctgagacgatcattaattcgctgatggtaacaagctgtccacgccggtttgcaggggctatttctgccaggtaaacaggcacggtacttcctgcaccaccgactgccagtcctagaactacacgggaaaagagcataacttccaggttaggcgcaagggctgtttcccagcgctcccagtccaaaaatgaccgcgagaataaggataatattacgacgaccaaggcgatctgccagtccacctgaaatcagcgcgcccgtggcagcgcccactaaaagtgaactggttaccagacccgtggagaagggggtcagctttagttcaggccccataaacagtaatgcgcctgaaatcacgccggtatcataaccaaacaaaagaccacctaaagtggcaatcgcggtaatgactttcacgagcggttgggttcgcactttactgttggggccggaggcaggatttttagaaatataatgttccatctggcttactccatctgaagattgggctatgtggggtacattttttaatggtcagttcaggcatgaacatcttgatgacaaggctgccgcttcacggcagccctgaagcaggaattactgactgatagtctgctgcagagcagcaattgatgatgtgacaccggcttcaacggacatggttagatcttccatctccagcgaaacccagtcgttatagcccgtcatgcgcacgacggagaaaaattctttccaccactgaagatcctgaccacagcctacagccacatagttccaggcccggtttgcgacgtcctcaacgggtttggtttcgagcagaccgttaatgttcaccagaccacgctcaaggcgtacgtctttaccgtgacagtggtgtatggccggtccaagtgcgcgggcggcagcgatagggtcggcccccatccagataagatgactggggtcaaggttcaatccgaccataggtcccacggcgtcacgcagccggaacagcgtttccggattccagacaagcattgaactgaagttctccagcgcaaatttttcgacaccgctgctgcttgcttgcccgatcagatcctgccagtagggaatagcaacctcattccactgatagtccaggcagtttttcagagtgggtggccagctgacggtataggtgatccagtttggaatggtgtcatggggactggcaggaggtagcccgctcatcatcactattttttttaccccgagttcaccggcaagccgcagcgcattttcagtatcctgtctgtggcgttgtccaagatctcccggatccagagggtttcctgaaacgttcagagccgcaatggtcatgccgcggctttcaagcgcgtgaagaaactgctgacgctttgatgcgctttccagaagctcagccgttgggacatgcggtgctgaagaccagcctccggtagtcatttcaacgccgttaacacccagctcaagcagcttgtccagcatctgctcataaggcaggtggccgagactgtccgtacagaaagagagtttcatcgtcattccttattcgtagttaacccagccggaaccgctatctgccgagcgcacacagttttcaatccagcgcacgccttcggcgcccgcgttgatgtccggataaaccagcgcctcaagagttttactgtcgccgcgctgagtcgcgctgatggcaatggcgaacttgagatagatgttggcccatgattcagccagcccttcggtatgcaatgccccaaggcgctcatcggccagggcactttcatcaaggtatggcataccatgatgcagcatctggttaggctggccctgaacctcaaatttcagttctcccgggttataatcgctccattccaggctggcccgggagccgataacgcgaatactctggctgtccattgagcctgcatttattgcagaggcccacatgcgtcctacggcaccgttttcataatgcatcagcaccatagcgttatcttccagtggtgcccgggacggaatgaagctctgacgatcgcataacagacttttgattttcaggtcaggaagtacaagctgagagatgtaaaaagtatgcgttgagatgtcacccagcacaaatgacggaccggcaattttagggtctacgcgccatttctgcgcatcgctgaacttgtccgcgttatcagttgcgctaaatccatgtgtgtactgcagttcaaccatgcgtacatcaccaatttcgcccttagcaatcatggcgcgcatctgcatcagtaatggatggcctgaaaagccataggtaacgcccacgatcaggcctttttccgccgccagtgcttttatttcctgcgcttcagccgaggtaaaaaacagcggtttttcacagataacatgaatcccggcattaagcgcagccctggtgatttcaaaatgcgtgccattaggcgtggcaacagtaacaacttcaacaccatcctcacgcttagcttcttcagatagcagctgtccataattctcataacaacgttcggccggtaagccaaggttgatgccgaaactcacggcctcgggtggcatcgacgtcaaatgcaccagcaacaagccggaaggcagtgttatcgcgcagtgcacccgaacgatgtttatagccaacctgactgagccggccgccgccgatcatggcccagcgtagtgggcgggaaatacttttttcaccgtttagcataaatactccgaattaacgctttgcacccgggtgcaaagatgggtttaataaaaatcacttctggttctgctggataaattgttcgtagttggctctggtaacagtctggtaggggatccagtggtaattatctgtcttctgcttattaatcagcgcatatgccactttcacggcaccaatagcctgtgctttagcatcctggaatacagttaccaccatctgaccatttttaataaactggagcccgtcaggtgtgccgtcaatgcctgcaaccatgacatcttttttcttcgcctgattcagcgccatgatggcaccaatggccatttcgtcattattggcgacgatcgcattgactggcgtgccgttaagcagccatgaagagaccacgtctaccgcctcatttcgctgccattttgcggtttgtttctcaatcaccttcatatctttgtgctgtgctacaacctcctcaacagcgcgggtacgttcgcgcgcttcctcatttgaaagggcgcccatcagaatggcaatgttgcctcggtaattcatcagctttgccagtgcttcgatttgcattttgccactcagggcagaatccgaaccgacatagctcattgcccccgtcagcggtacttctggtttacggttcacgaaaaccagtggtataccggcatttttagccgcattgatcatcggaagtacgccctgtgtgtcgaccgggttaagtatgatggcgtccactccctgattaataaaatcatcaacctgctgtacctggagcgcaacatcgccttttgcgtcagaaaactgtcctttcatgccctgcgtatccagctcatggatcatttgtgtacgcagtattgaaacaaaattaaggtcaaaattagccagagctacgccaacctgtgccatttttgcctgcaccggggtggccagcggcagggccattaatatcagtaaacagaaggctttattcattaccggatcctgtgggataaattaatgcaaccttgacgcgaagagcgacagctttctgctcaggtatacttctgcacaatactgaacctgtcccactggatttttttgcaaccgggtgcaaacgagcttatgcttttccagcggtgtcaggacagcatctgcattgaagattcagtgactgtgtacaagacgttaaacttagtcaatcgagttgtaataaaatagcgacacccgatcacattttttgcaaccgggtgcattaaggagagggtatcgcaggaattattttactgcgtacagtgctgacttctgggaaaaaatttaaccataattatcattgattttatgtattcattgttccaataacttaacagccgggtcctgcatgacaaataaaacagtaaagcggcaaaaagtgaccgccagtgatgtggctgcccgcgccggggtatctaaatggacggtttcacgcgcttttattcctgatgcgtctatttctgaaaaagcacgaaaaaaaatcatggcgatagcccgtgagctgggatatcgccctaacctgcttgcccgcgggttatctcaaaagcgcacgcacattattggcgtggctgttgatgaactgaaaaatcctcattcaatgttgatgcttgatgaggtgacgcgtcagcttcagaagcgtggatacatggccctgttgcttaatattacgggtgacaattattacgccgttatgtcgctggcagatcaactgcaggtggacggcattttgtttttgggtacggtacttacgccagagtttgttgcgatagcagtggaaatgcacgatattccgctaatacaggtctgtcgtaacacaggacggcaggaaattgacatcgtggatattgatggttatcaggccggacgggtaattgcgcgcctgttaactgaacagggccataagcgtttcggttatatgtccggcccaggcggtggggaaggtcatctgacccgtaaacaaggttttcgtgatgagttgtgcgcgcagagttttggccttgaacttgagctcaatgctgaacactatgatcgtcaaatgagttataaccttgtgaggcagtatttgctgcaaacatctgcgcctgaacgtattgaagcactgttttgtgagaatgatgtactggcactgggcgctatggaagcccttcgcgacgcagggcatgagcctgctattgccgtagtggggtttgacgacattgatgaagcctccgcacccggatggcaactgaccacctacagtcagcgtctcgacttgctaatggaagaggcgcttaatcgtttgatttcaggaaataaagattcagatggtaactggaggagtggtgagctgcgtatccgtcgttcgcacatcaggcagtaatttggaggtaataaaagcattatcaggtcgattttaaataacgaaaggcttcccctctgcgcgtaacagtcggctacgggactttccgaatttcgcggagcctttacagccctcttatagcattaagcccacaagggcttaatgctgcgcattcttattcagcgtaacagtgctcttctgtcggaaatgttccctctttaacagccgtaacataggctttcagagcagcctgaatactctcctgcccgctcataaagttgcgcacaaattttggcatccgtcctgaaaggctcagaccaagcatatcatgcaggacaagtacctgtccgtcagtgtcagctccggcaccaataccaataacaggcacagatacggctttactgagcgcgagtcccagcgaagcagggactgcttccaccaggaccattgccgcgcccgctttttccagctgcactgccgtatcgataagtgcctgcgcctgcagctccccacgtccctgaaccttaaatccaccaagtacgttaacggactgtggcgtcaggccgatatgtgcgcagacaggcacgccattctgtgtcagctgacgaacagaatcgcaaagccacgtccctccctccagtttgaccatttttgctcccgcctgcattaatcgacctgcgctgtgcagcgcctgctgtggcgatgaataggtcatgaacgaaagatcagcgataatgaaactccctgcattgccgcgattcacgctgagggtatggtataccatatcttccagcatcacgggcagggtactgtcgtgtccctgtaatatcatgcccaacgtatcgccaatgagcagcatatccactcctgcgcggctgcactcatgcgcgaaggtagcatcgtagcaggtaagcatggcaattttttcgccgtttttcttcatcttctgcagatgggtcaggttgatctctggcatctcaatgtctcatctaaatgattctgtcagtaatagcgctgcgataatgatcatcagagcgccggaaatttggctgacgaggcgtgcagcccttggccgggtttgtaacactactttagatccgaaacctactatcagataaaccactgcacagcttaagatatgcaccatacccaatgcggccatttgtaaggagagcggccatgcgccatgcggatcagtgaattgtggcagcaacgccaaaaacagcaggaataccttcggattgagcccacttatgcaaagcccttttacagcccaacgcagcgcattaccttcgttctgtctttcacctgcggtgggaaacggcaggatgacgcaacatgcctattcccagccagattaaatagcaggcaccggccacggttaatcctttcatgagcgtgggcaagtccgcgaccacggctcctacacctgcggcaacaattaacgttgcaatcaagtggccagagagcaatcccaagaccgcgggaacgacccggcccccgcgaattcctgctgagatggcataggcccagtctgctccaggggtaatgacaaacagcactgaaacggcccaaaacgcagcaaaaaaactcagcgccatagttacaccccactcgttgtattaggcatgctgagcacagcgacttcgggacgacttaaagtaattatattgcacacgatcttctaccttaataatgaaaataaacagaatctatctccagatgctaggcggcgtcgcacagcattagcaggtagaaagaatatcctcagctggttagaatgtgctttcaattttaatgcatgatgtcactgataagggaacaatcttgcccatggacagagtcaatcgcaatattcttgctgaacttcaagctgatggccgtttatccgtaactcagctagcggagcgggttggattaagcctgtcgccttgccatcgcaggataaaagcgctggagcagagtggcgtcattctggggtatcgtgctcagctggatcctgccttcctgggttatagcttctcggcgattgtattcgtgacattgcgtgatggcgaccgtaaggccgtcaatgcgttcgaagagacagtgaaagaacttccccaaattatgctggcacaacgcttatttggcgatcctgattatcttctgcatatcacaacgcgtgatttgcccgcttttcagcagttatatgatgagaaactttccgctatgcccggcgtacaaagactaacgtcgaccctggttatgaaaaccatcattaaggatcgtccgttgccgctgtaggcctgctgctaacccgttgttttgagtatggcaatgctatttttatgcgacgggatgcagctttagcggatccattcgtctgctcaaaatcacctccgacgaaggcaggtcagtaatgaccatgtccatgtcggtcagtgagaacatcttgtacagcgcgttgctgccgtaagtgttgttatctgccagcatgatacattttcgcgctgcgttgatgattgcaccatagtaagccgctctgcactcatcatgatgaaaaatgcctttatcactccatgataccggtgcaataaacgccttttcaaaattgagactctgcaaggtctcaagcgcaacgcgttgatgaaaagtattgtcatgtcgactgagtttgccaccaataaaaaaaagggcagcgctagagtgagtcataacatgctgcgcaatggcaaagtcattagtgactatggtcatctcatcgctgtaaggaaaaaacgtggccaactcaaacgtcaattttccgccatcgagataaatcactttgctatcacctaaataacgtagcgcagcacggaccagataatgagccccggggcgtttcaacgggcaaacgtagcggggtttcacgtgatttcacgccaccgcgcgtgggcatgatgacgccacgcgcgctgagctgttcaatatcccgccgtatagtcatcaccgtgacatccagcatatctgacagctcccgcaggctgacaaaatgcttaatggataccacctcgagtatccgttgatgacgctctgcgggaatcatatcgctcctcatcagacaggaataatgccaagaacaacagcggccaacagagcacagacactcatgatccagattttcaccatggagtgacggatatgctcaccgacctgaagattaagcagtcctaaccccagatgcgttgccggaataaccggactaagcagcaaacctatttgttcggtaatgagcatggcgatggtgacgtgcagcggggaaacgtcaaaactttgcccaaggcctaccgcgagaggaaggagtgcaaaatagaaagcatcggatccaatcaaaataacgatcggtacgctgaaagcagccagaattatataaagataaggtcctaaactggaaggaagtactgcagcgagttcattcactaatactttaataatgccagtattttgcaatatgcccacaaatacgccaatggttaagaagatcacgattaccgggaagatggttaacgcgtaatctttaatcttctgttgtgcttttttggcatccggataattgatcatgactgccagcgagaatgcgatcataaacaggaagttacccgcgactaatccagaaaccagaatcacaatggttgcaatgaccagcaaaaaattagcacgcagcagccatggattatgatcacctttgctggtaagcatctcctcacgcatcaccaggaaggcttctttactaatgcccgaaccacttttattttctactctggccatgtaccagcagagaataacgccgagaaacaaacagcacgacctgcaaaggaatgagtttgtaatagacgtcaagaatatcgagatgggtcaccgcaatggctcggttgagtgagcctccccatggggtaatacccgttacgccgaccccaacggtaaccagcatcagcaacgttttacggctgatgttcatcttttcatacagtggtaacaatgcagggacggttaccagcagggttgcatacgcattaccatcgaggctgcagactgaggctatgaccaatgtcgcaagcagaacagaaaaggtcgattgtgtgacgaaacgcaggatgaaacgcacaataacgtcaaacacacctgcttctttcatcagggtaaaaaacatggcgctgaatgcgactagcgtagcggtgccaactaccgatttcagtcctgaagcgacatattcgcccagttccttaaagccaaatccacagactaaagcggctaccgtaggtaagataataaacagcacactgggaggaaacttatttttcaataagcaccatgtcagaataacaaacatgacaatcccggtgataagcatcaaagacatgacttatccttttaattttgagagtagaagatgtaaaaaaacgctgcgcagataaatctgcacagctttaccatggcaatatttatttcatattgaatagcttattgagctcatcaatattttcattagttaatgttttcatgccatagggtttgagtacgaaatagagttttgccgtttcctctaactcttctgcgttaaaaaccgcttcacggatatttttacccgaaataatgggaccatggttggcgagaagaattgaattatgttccttagccagcttttcaacatgcacagcaatttctggcgagcctgggcgaatataaggtaccaccggcagtttacccacacgcatcacgtagtaaggggttatcgccggcagtgcattttcatagtcgagatcgggcaagcaggataatgctgtcagccagggggagtgcaaatgtacgatgccgccacaagcaggacgctgacggtacattgccaggtgcatcagcacttctttagacgccttttgacccgaaaccagctcaccggtcatcgtgactttactcaattcatcagcatccaggtcgccaaaacttgagttcgtcggggtggcgaggatatggccatcaggcagttttaggctgatatttccagcgccaccgctgctgtaaccacgttcaaacagggagcgtgcgtagcgcactaaatcctgacgatattggacttcgttcatttcacactctcctgcgcttttaagaagaaatcactgttaccaaagttgcctgacttgagaattacccacttttcttcatccaatacctgtgtccagggtacaccaggcgcgacagcatcgccgatcaccatgcctttaatattgagcccctgagataccgcacccgacgtttcaccgccagcgacgataaatttgttgaaaccttctttgcttaaattgtgggcaagcgaagcgaagaagctttcgatcttctgactgacaaattccgcaccataattcttctgaataatgtcgataatctgaggcggttgcgtggcatagaccatgggagccaacacatcattcttttgggtaactacccagcccgtaaccgtctgcaggtacgttggttcgtgaaggattttttccacatccagtgccagtgatgaggcgcgctgctgataaaagttcacctgctggttggtcatggaagagcagctacctgacaggacaatgcttgcgccctctttgcggatagcaaatgcaggcttatcatcggatttatgcatcgtatccagtgccgcaatggcatagccaatacctgctgcaccggtgatgaaggcataatctgcggtttcacgcgccacggttaacagatcattattatccagtacgtcacagataacatatttgatcttttcctctgccagtttggctaaggcatcaggaatgtcttttacatgatttttgatggtgtcgagattgatgatttcgcaacggccggtggattgcgcctccatcaatttttttagtgacgactctctcatcggtgtgactggatgatgttccataccgctttgattcaataattggcctttcacaaacagatggccatgcaaaatggttcttccattgtctggtactgccggacaaatcaaagtgattgacgcatttagattcttcatcagggcatcggtaaccggaccaatattcccctcttttgtagagtcaaaagttgagcaatatttgaatagctgacgcttacagccctgtgacttaagccaatttgatgcagacaatgactgttcaaccgcggtcttggtcagaatcgaacgacttttaagggcgatgaccaccgcatcgatgccttcctgatcaaaagcctcagcaggaacgccattgaacagcaccactttccagccagcattcaccatgaaacttgcaatgtcggtggcacccgtaaagtcatccgcgatgacgcccaacttaatcatatgcgttcctctaaatcggtaacaaattgagcccatactgcttttatgtaaatataagtgcaatcatggttgatgttaatttgtgctttagatcacaaaataagaggttatggttaacaaacgggtgtgagtagaatctttggacaggctgttacaacgggtaataatcctaaagcccgcagggattcttcataacttactgaaaagatgaggtaatgttgtaatgtgttttttttgtatcagaaatgtgatctcaatcaccttgccttcagtgcatttattggtataaaaatgcaatcgaaaattgaccaaccatctggagtatttatgcgtattttggttctgccttgtgacggtatcggccctgagatcacttctgctgcggtaactgtgctggagtcactggataaagcgtatggcctgaactttgagttcgactacgaagacgtaggttttaaaagcctggagttacacggtactacgctgcgccaagaatcactcgaccgcgccaaaacctatgacggcattattctgggtacccagtcccacgcggattatccagctccagaaaaaggcggccgtaacgtttctgctggcttccgtattggcctggatctctatgctaacgtccgtccggcgcgcactcgtcctttcctgacgtctaatatgaaggaaggcaaatccatggatctggtgatcatgcgtgaagcgacggaagggttctatccagaccgcaacatgactcgcggctggggtgaagtgatgcctagtccggatatggcgctgtctacccgtaaaattacccgtcattgctctgagcgtattgctcgcaaagccttcgagctggcgatgcagcgtcgtaaaaaagtgaccgcaatccataaagctaacagcttccatatgactgatggcctgttccttgaagccgtgcgtcacgtggcaaaagagttccctgaagttgagctggacgatctattagttgatgcgtcaaccgcccacctagtacgtaacccagagcgttttgacgtactggttgccactaacttctatggtgacatcatcagcgatctggcgagtgaattgtcaggcagccttggcctagcaggttcaattatggccagtgatactcattgctgcgcgcaggctcagcatggatcagctccggatattcagaatcaggataaggcgaaacccggtgtcgatgattctttcggttgccatgatgctgcaatggtatgcagagaaacacaaccagccaaaattcctgaaagcggcggaagagatcagccgtgccgttgatgaggtgctggaaaatccagaaacccgcaccccggatctgggtggcaaatgtggcactaaagcctttgctgacaaagtggctgcttctgttcgcgcctgagtaaacgtcatgaggttgccgcactttagcggcagcctgctttaatggagccgaagatgactcaacgtattgttttaatccacgcgactccactggcggttgagccgatcaaccaggcttttgcccatcagtggccagaggctgaaatcagtaacttgcttgatgacgcgttaagtttggatcgccggaaggtgacggttttgaccgatcgtctgtttcagcggatcgactcactggtgaactatgctgccaacattgatgccggtgcggttctgtttacctgctctgcatttggtgaagcgattgacgccagcgcagcgaaaaacactataccggtacttaaaccaaacgaagccatgtttgaagcggctttagcaaagggtgaaaatatcgtcatgctggcaacgtttgcgcccgccgtcgcagggatggaagcagaatttaatgaactcgtacgcaaaggttctcgtgacgccacgttaaccagcgttttggttaaaggggcgcgcgatgctcttgagcaaggtgatgtcgagcgccacaaccagctcattgtccaggctgctcgtgaacatactgaggctgatgccatcctccttgcgcacttctcgatggccattgcctgggagaaggttcagtctgcagtgaactgtccggtattgagcagtccacatgcagccgtttcaaaactgaaaatattaatggctcattaattaattcagtcgatttcattttaaaaaaggcatcaacgtggaaagccgagatatattggcggatgtgaaatatagccatatttcacactcgcctgagatcgtattgcctgaagatagctgtgactgtcatcaccatgttttcgacaggcgttatccctatgcaacggatgatacgcgtaatttacctaacgcaaccgtcaacgattacaaccagtttaaaaaatggttgggacactctcgtcatattctggtgcaaccctcttcttatggaacggataatcgttgtctgacagatgcattacgtgcttttggcacccatgcgcgaggtgaagccgtggtagacgacgctgttagtgatgccgaaactggatgcgctgcagcaagctggcgtaacgggggttcgtttcaatcttggtgcgggcaatgcaacgacacctgaaatgctgctccccgtagcgcaacgcgtggtggaacgtggctggcatgtgcaggtccacgccactgcggatcagttgtggcaattgcgatcaacgctacttcagataccgggaaatctggtcatcgaccactactttcgtttaccgcagcctgaaccgatggcccatccatgttggaagctggcttgggagctgattgaaaagggccggtgctgggtaaaactttccgcgctttatcatcagtcacattgtgatgatgtgtctgatatggctgctctgattaccgggtttcttcgcgatgcaactgaacgtgttttatggggaagtgactggccacatcccaatttaataagtgctaataaaaatatgccagatgatgcattgatactatcgaaaatataccactgggcgcataacgatcaggttagacacaaattatttgtggaaaacccggctgaactttaccgatttaattaatcgtatgccagacaaggccgaatattatgattactctgaactccactgctaaaaagaacagacctacgcattatcgctatatgattttgcttatggtattcctcagtattgctttaaatcatggtgatagagcgaccttctcgattgccggtacggatatggtgaaatctgccgggctggatattgtggcgctcggttatttgatctcaaccttcacctgggcatatgttctggggcaatatccaggtggttggttacttgatcgctacgggtccaaaaaagtactggtaaccggggttttcacctggtcactgttcgtctttctggtgggattcagcacctcttttgacaatatttgggtgacacgcgcactgatgttcggcttcatctttatgatggggttgattgaagcaccaacgctacccgccaactctcgattccttgcggcatggttcccggcgaaagagcgtggtaaggcttccggattcactaccgcagcacagtatttcgcgctggtggtcttcttaccgttgatgggctggttctcctattcgttcggctgggagtcagtgttctggtttatgggcgcagtcggtattctggtctcgctgttgatgacgagggtactcaccgatacgcctaaagttcacccgttggttaacgatgctgaacttgaatatatccagtccggcggcggtctgaccaacatgaaagccagtaaaaaaggcgataacgctggcaaaggatatacccgtaaattactgaccagccgattggcgctgggtgtgtatatgggtcagttcttctttactgtgctttcctactttttcctgacgtggttcccggtctatctggtgcacgaccgtggtatgaccattctcaaggcaggatttatcgcgtcactgccggcgttatgtggatgtgccggcgcgttgttgggcggcgtgttatccgattacatgctggcgcgcggtttcagcctgtcagccgcacgtaaaacaccgatcgttatcggcatgctgttagccgttagtatggttatttgcaattacgtcgattccgcctgggttgtggtggctatcatgtcgctggccttctttggcaaaggatttggtgcgatgggatggtgcgtagtctcagacttctcacctaaagaggcggtcggcctgagcggtggattgttcaatatgattggcaatatttcgggcatctttacgccaatcatcattgcctacatcataaaagataccggttcattcaatggtgctttgatttttgtcggcgtctgcgctttcctcaatctgtgctgttatctgtttgtggctggaaaaattcaacgtctgaattttgaaacgccgaaacaggatcacgatgatgacttttctggagaaccgcatgtcagccaccgataacgcaaccccactacgttttgcaatcaatttaggtaacgccgtattggccaaaacgctgcccgatgggcagcctggtgggattactgttgagatcgcccaaaaaattgcggctgaacagggaagagtcgcgcaatttgttacgtatcccacagcaggcaaggtggtagatgatgcctctcacgatcgctgggacgtcgcctttttggctatagacccgaagcgtgaagaggtgctgcgatttactcagtcttatatcaccatcgaaggtaccgtgatggtaagagagaacagcgactggcaaagcgtggccgagatggataaacctgatgtggtcatcaatgtcggtaaaggagcagcctacgatctgttcctgagccgcgaattaaaacacgctgcgcttaatcgactagcttcatcacaggccgcgatcgatgcgtttctcgatggcgaaggcgacatggcggctgggatccgtcaacctttagagcgtgcagtcagtaacaatagcggttttcgcgtattgcccgataatttcgggcagattttccaggccatttgtctgccgcatgcccatgaccaactttatggtgaaatcagccattttttggataactggcgggaaaatggcgctataagtgagattattaaccgaaatcttaccgagtcttaaacttaatgcagtgttctcaaaaggagaacgctgcattggttaatgttcaattttcattcatccgagggcatgagacgttatccaacgacgaacataacaaggttgctgtgacggaaggtttttatgacattgcccttaacgctgaaacgctcatcgctggttattcataaccgcctatatcattatattgacctcacccagatcgtaccgctggagcagttgcagacattgccttacagcatccgcattctgctggagaaacgttgcgcgatgctcaccgcaaacgctgcctgaatttctcaactatctgtctgcaaagtcctcccctggtgaggttgagttttatcccgaccgcctcatgttccatgacactacctgtttaccggctttggctgactttgctgccatgcgcgatcttactgctgagttaggcggcgatccgcgcgctatcaatccacacattcctgctgtgttaaccatcgatcattcggtcatcgttgaaagttatgccagtgctgatgctctggaagataacctcaattttgattttcgccgtaacgctgaacgctatcgtttcattcgctgggcagaaaaaagtctggataacttccgcgtcattccacccggcaccggcattattcatttaatgaacctcgaaacgattgctgaagtggtcacggtggatgagcgtgaagccatacctttgctgcacgccgattgcatgattgcaaccgacagccatacgccgatgatcaatgcacttggtgtgttgggttggggcgtaggtggtctggaaggtcaggccgcattggttggcgagcctgtcacgttgcgcttcccggacgtggtgggaatttgtgtttccggtgagctgtcgccgtatgttaccgacagcgatctggctctgcacatcacgcgcctgttgcgtgaaagcggtgtggtcggcaaatttgttgagttcactggtcctgcactccacaacatgccgctcgaatcgcgcgccaccattgccaatatggcaccggaatacggtgccaccgtggtgttcttcccgtttgatcagcgtagcgctgagtacgtcaacatgaccgggcgcagtgaagagaaacaggacattattcgcagttatatgcaacatcagcacctttggcgtcatccggaggatcgtcagccagatttcacgcaacgcattgaactggatttaagtagcatcgaacccagcgtggcggggccttataatcctcatcaacaaattccgctcagtgattcgccgaaaagttttatggagacattgaaagccggcgatcgcgctttgaagtggcagcatgaggattaccctcaaccgattcaacaaggcgccgtggctatcgcggccattaccagctgcaccacaaccgctaacccctggctggtaattcaggcggcattgtttgcgaggaatgcgtcaaagtacggactgcaacccaagccgtgggttaaaacttccttttcacccggatctcgggcggttaccgattatcttgcagagtcgggcctgcttagcgagttggaaaaggttgggttcaatgtggcgggttatggctgtatgacctgcattggcagttctggcgcattacaaccggcaatggaaaatctggtgtgcgatggccttcaggcggtgtgtgtgctttccgggaaccgtaactttccccggcgcgttaatcccagcctcggccatggttatcttacctcgccagcattggtgattgcctgggctatcgcaggaaatatgcagcatgacatgttggacgatccgcttggatacgatgagcatcatcagccggttttaatgcgcgacttaatgccagcgcgtgaagaagttgaacggtgggtaacaagggtgatgaaacgtgaacattacatccagcgtcgcgatcttatctggcagggaaccccgcattggcagcaaattgaagcaccgggtagcatacattatccatgggaaccgacctcaacctatctgcgccggccaggctatctggaacgtttacctcgtgatcctgccaaactgctttcgctcaataatgctcgacctttcctctggtttggcgatgacgtcaccaccgatcatatttcgcctgcaggtgcgatttccgcagacagccttgccggtcaatggctgctagaccatcatgaggatccacaggacctgaatctttactctacgcgacgcagtaatcacgaggtgatggtacgcggtgcttttacgaataaagcgctatccaaccgtttgttaccgccagataaacgcgtaggcggtggttatgcatgggatgcgtctcatgagcaaattcttccggcttttgaggctgcgcaaacatggcatgcgactgatactccgctggtagtgctggcgggtgagcgctatggagcgggatcgagccgtgactgggctgctaaagcgcaggcattaatgggggttaaagccgtcattgctaatagtttcgaacgtatccaccgcacaaatttgatcggaatgggcattcttccgctgcatttcattgccgatgaagcgaacaaattacctgagatggatggaacagaagtccttgatattacaggcctggaaatgatctcgccgggtgcgacgccgctggtgctctgcattcgccgtgggggcaggcagattgctgcactgaatcttgaggcagtgatagactcccagcaagaactgcgctatctgcgctatggcggtattttgccttttgtcattcagcaaacacttaaagagtagggaagttcatgcgctacgacctggtctcactttcgctgtttgttgctgtgtctgaggagcagaatcttacgcgtgccgcacgccgtaagcatctggccgtctcagccgtgagtaagcgcataactgaacttgaacagcaaattggcacgccattgatgctacgtctgccgcgtggcatcgagctgacgcctgctggtcactcgctgctgtttcatgcgcgccaagtgttccgcaatctcgatcaaatggaagaggaactcagtgattacgtggccggcgtacgcggccacattcgcatttttacgatctccgcggcgttgatgcattatctgccgcgtgccatcagtcagtttccttgctcattacccgcagacagatatcgatattgaagaacacactggcattagcgccgtgcaaggcttgctgcaggggaacgcggatgtcggtttcttttccagttggacacccgctcccggaattgaagtatggccatggcagcaagaccagttgtccgttctggtgtggcaggggcatcctttggcggagcgcccgaccttgcaattagtggattgcgtcgatgagaaaatgattggtccacatcgggaaagcgcagttagccacattctgaagcgtgaagcgagaaagctgggtaaaacgcttaatataggattacgggtcagcagttttgtatctatggccgaactggtcgggcaacagttaggaatagccatcttgccagttaatgaaatcgctcaggtggctaatcatgacgcagtacgctgtattccacttgtcgagccatgggcgaaacgtgagttatacgttggcgtgaagggttatgccctatcatcaccctcagtgaaagcttttatagaaaatgtcacgccattgaaacgtttaacgggtgccgaagaggggccgttgcttggggccagtctcatcaatgctgacctcaagcgctgagttaatcggaaaatacaatgcaggttgggctagcagtaaatacctctttacccgtgtctttaagcatgcccgagtcctgatcaatgctgaaaatgctaatagaatcagagtcctcgttagcgctataaaaatacaacccatctgcagagagcgttgtaaaacgcggggtcttaccaccgcaaaagacccacccaacaggtgctaagcagccatcaagaggattaatgcgcaacaccgcaatactgttatgaccacgattggcggcatataagaagcgtccggacggatgcacttcgatttcactggcatcgttacgtgcttcaaatccttccggtaggctgctcaacgtttgcttgagcgcaatgtttcccgtctcttgttcaaaatcgtaaacggtaattgtattcccgagctcactcaggccataaagccacttcccctgtgggtgaaaatcgacatgacgcggccagcttccagacggcaacagcacttcatcattgatcaatgattgtccatctcgccagtgataaatacgcaccatatcaatgccgttcccggcctgtctgccctggatgggcagagcgtaatagtcgctatctggcgcaaaaataatttcatgcggacgtgacaagctggccgcagcgtcatcctcatctgcgtggccttccaccatcgccaaatggtgaggaggccgtagcgcgtcatcatcagcgaaacgctaatgctgctacgttgccgccttcatggttagcaatcagcagatggcgcccatcgggtgagagagcggcatgtaccggattattgtgtcgcagtggatcaaggtcgggatgtggattctgtgggcccgttgtttgcttagataacagagtcagcatgcccgagataggatcacgcgcaaatatggccacctgactgccatctccatgcagcacatacaatcggttccgtttctcatccagagtgagccaggaaggattttcctgtacagagattacacgttgaacgttatgccagttacctgactcatcaatgcggaatacttcaattccctttccacgtgccccacgccactcggacgtacggcaacccacataggcaaacttattcatttacattcccgatccacaaatatgcatttatataaacacaagtgcaaaatactgcttgtgatttacttcacaattttatggttttcaagcattgaaagtagcacttatgggagctttctggctattgggaagctattcaaaattgcatcgcaattccgatacattgcatttgaatgcgtttaaatgcagaaaattaacgatcgtggtcacaatttcgacgccaagagattgctaaaaaaaaccgcaggtagcttactgttaacaagtcgtgaaaactgttacataaatgcatctgggagaagggttatgacccaacgtattgcgtatgttacttcagggatgggaagcctcggaaccgctatttgccgtcgactggcgaaggatggttttaaagtgattgcaggatgcggccccaattctcaacgtaaaaccgcctggcttgatgacaataaaaagatgggatttgatttcatcgcatcagagggaaacgtggctgattgggaatcaacggttaaggcatttgccaaaataaaagctgaaatcggtgagatagacgtgttggttaataatgctggcacggcacggaatgtattatttcgtgatatgcagccacaggagtggcaggccgttattaacaccaatatgaactcattattcaacgtcactaaacaagttgttgatggcatgatgtcgcgtgggtggggacgtattatcaatatttcttcagtcaatgcgcaaattggtcaaactggtcaggttaattactctacggcaaaatctgcagtgcggggttttactcgcgccctggcacgcgaagtttcggcacgcggagtaacagtaaatacggtatcgccgggctatctggctacatcaaaactgaaaacagtcacgccagtacaggttattgataaaattgttcaggaaattccagtgcgtcgcttgggctctccgcaggaaattgccgctatatgctcctggctggcatctgacgagtcaggatttgcaacgggtgctgatttctctatcaacggcggcctgcatatgggctaataaaataacagaacaccctgctcaaaatttacgtcaaattaattatcgcgcatattagcaataatatacgctggaggctcttatgctctcgcttttgggatatggcatgattgtggtctttatgatcctaatcatgaccaagaaactttctgcactcgtcgcactgatcattattccaataatatttgctctgatagccggattcggcggagaaatgggcgagatgatgattgaggggcttaaaaaagtcgctccaactgccatcatggttatttttgccattctctactttagcaccatgtttgataccggtttatttgacccgattattcgcttttttttacggattattaatggcgacccggttaaagcggtgatgtgcagtgccattctggcggcgatggtttcacttgatggtgatggctcaacgacctatatgatctgcgtaacggcgatgctgccattgttcaaacgtattcgtctggatccactggcgctgacctgtgtggtcttccttgcaggaagtatcaccaacttgttgccatggggcggtccactggctcgcgttgctgcgtccctgaaagttgagtccagcgatctgtttattccgttgattccaactatggtttgcggttttgtaggagtactggtgctgtcatggtatatcggtattcgtgaacgccgccgtttaggcaagctgagtattaataccagtagttatggatcagtcaatgaagatgatgcagaaagctatctgccggcaatcaatgaagtcaatgaagaactgcgacgtccaaaactgttctggctaaatgcgggtctgacattactgctgatgggatcgctggtgatggagttgctgccactgtcggtgctgttcatggtggcgtttgcactggcgttgctgatcaactatccgcatattgatgcccagcgtcagcgtattgcagcgcatgcgcctgccgcgctgaaccagacatcaatctttctggctgcgggtattttcgctggtatcctctcgggtactggaatggtcaccgcaatgtcggcatctctgctgaatgtgttacccgattcatggggcccttatctggcaccgattacggcactcatcagcttgcctggcaccttctttatgtcgaatgatgccttctattacggtgtactaccggttctggcagaagcagcgaaagtgtatggcattgacccagtcgaaattggccgtgcctcgttggttgggcagccaatccacttactgagtccattagtagcatcaacctatctgttagtgggattagctggagtagaattcagtgaccatcagaaatataccttcaaatgggctttcctgctctgcatgattttcctggcatcgggtttgttattgggtctttatccactttactcgcctggcgagtaaaggctctgatgaaaaaatggcccattagggccattttttatactccgatactacgttgttttttgttatcaagcgcgacagcgaggtgctgtttcatcatatatgacgcttcgatcagttgcccggtctcaattaatgacagcaaatgcatatgatctttaacttcagcgtagtagcggctgcgatcatccataatgcggtaatccattaaacgacgcatgcgattgacgttgcgcagtgatatttcaaaaaacggattgtttgaaaaactgatgaccgtctcatgaaagcggtaacccgccagctggagttgagttggcgataaacgctgaatgccaatctctaaaagcatctctagctcgcgcttaatctcatcgattttactctgcggggctttgaaagtggattctaaaattgccattggttcaataaccatgcggaagctaaagatatgctcaagcgcggctttagttttggctactggtagaaaacgccagccataaccctgtttacgttcaacccatccctcactgataccgcgcgcaagaatggtcgtgagctgagtcttcgaaaggttataacgcttaagcagataaagttcgtttacttcagattcaattttatcctgcagccagtcttccgctaattgatagtattcaggaagatcgttatccacttcactttcatgtgaactttgagtctgaggcgcatagtcctgctttacaaaaaaaccacggttatgctgctgttgcagaatgcctttgtgttcaaggtaaactaaggcctcacgcacgggtgaacgagaaacatcaaaagattctgccagctttggcacgctaaggtgcgcaccaggcgatagaaacaccgctgtcgatcagcgtgattattttttgagaaagcctttccgtgagaacacttattttcatgaagaaagccctaaaaaatgtatgaagaagtaaaaaattaacaatattattgcattttaattgtgtgaaatgcaattatgaaatgcaggtttgtgtgtgaataactgtttttatattagtgattattgagcataatattttcataaatccatcagactttaaaagccatctgccaaaggtgtaaatttagatgatacctctgttttcactcattcatccaacgcaactcaacctctattcccgtagagtttgttaaaccgattttacaagcggatacattaaatggataaattctgcacgtagttcctcataactatgaataggcttaaaagggtcaggaaatattaattctacctcagtacatgacacacagcagcaagctatcgatgcaactcgcactattacacaaaatcaaggtggcgaattgctgattcatgaacgggatggtcaaatccgtgcaaaagattcgcacggtaaaaatgccccccaaaggttagccaaaactattataagaaaagccgattggctcttatctatatttttattcagtttgttaaattatctaaagagttatcttcatgtgcccttcacgcgttcgcttttcggtcctggcggacctttcagcatgcatgtccaccttgtacaagaaactgaccttccaacatcctgctttgggaacatgactatctgccagggcgcacctttcagtacattccgggtatcgatagcgtgccctttccgcgcaacaagctagagaataaatgccgccaccgcagcgacctgattgaccggtccgccgagcggcaccagaccaaaaaagcccgccaggagcatgagcagcaccagccagctggttttaaaagtacgcatgtcactgatagcttcccatggcattttcaacttcgtcagatcataagctgccaggatgtctttgcagaaaaacaagtgcagcatcaccagcgtggccgccatggaagcaatattcaccggcaccacgacggaagccctgcttaaagaagaccgccgtcaaaatattgaccaagttggatacgatgagcggcaggctagacgtgtccgcgataaagccagcctccatcacaaatgccagcgtggcacccgggctaaagcccagcgccaggagcatagcgataacgattggcgtaaggataagcgccgcgccgtcattggtgaacagcgacgccgccaccgcacccaacagaacaatatacgtgaacaacaacccgcctttaccgcctcctcagccggaaacgtgcagtgctgcccactcagcatcaggctgaggataatgaccgcaataaacgtggccgtagcgttccagacaatctgccagatgacaggaatatcgctgatatgcacttcgccggtcagcagcgccagcgcggccacgataacggcacctcagccaatactgagtcattttggctaccaaataaccagtgccagcgtcagaacaaaaatcgcatccgccagaaacatactttcgcctttaatactgaacctgtcaggccgggcgcagcgaactcaagcaatacatacgaaaatacatatataatgacggcttaaccgaagcgtctcgagcagatgtttttatgtactgttatcatcggttcactggcacgctgagcaattgcatgacgcaatggccgcattccagtaaacgaagggaaatattcactactcttccggcgttgcgcaaagcatttttagccgcgaaggcaactcccgttcgatttttttacgatgaaaaggagaaagcttgcgccattcacgtgcttcctgcagcgtacggccacagccctcacaccagcctttagttttactgaagatacagatatcagtacagggagactttgcggacataactactccttagattgagaacaggctgaaacaccggaccagtcgctacctggtctcccaggatattgacgacaccctcagcgcgttaatgacgatttttcagccgtcttgcctcaggcgtactgaatgttcatcgttccctgtttggttcggttgattgaggcatcgacctgccaggtagatcgaataagcgctggagtaagcacgtcagccggatcaccggtggccacgatctgtccttcgtgcaataccaccagatgttgacaatattttgccgcgagattgagatcgtgtagtgccacaatcacggtaaagggcaacgcagagattagccgcatcagttccagctgaaactgtatatccagatgattaatgggttcgtccagcagcaggatatctggttgttgtgtgagtgcgcgggctatctgacagcgctgacgttccccgcctgacaggcgatgccaggatctgtgcgccagggcatcaagcttcatcatcgatagcgattgttgcactgcatcctcatcggcctgacgccatggagtgaatgcgctgcgatgcggtgtacggccgagacgcacaatatcaacaacgctcatctccgcctcagactccgcatgctgcggcacaaaagcaagcgtacgggaaagctgacgtcggctcagattccttgtcagtgtaccgccaatttttacgtccgagtaagcgcaggcctgtacgccagccatcgcgcgaatcagcgtggacttaccggagccattcgggccaagcagccccactgtttgcgatcgtttcacactgaaactgatatcagataaaacgctacgagcctgaagcgtcacactcagcttctcaaccacgacatgaatcatcatttctcccggttgcggtacagaatcagggcaaaaacaggggcaccgaccaaggccgttaccacaccaatgggtaaaacctgatgactaatcagggtgcgtgataccaggtctgcaaggatcatgaaatgacatccggcaagaaaggcgattggtatcgtgataaggtgccggtggccggccatcatgcgcgttatatgcgggataaccagaccgacaaagcccacagcgccaatagcgctgacgataactgcggtaattaaagcggtggtcagcagcaaaataatgcgtaccagcagcactcgtgtgccaagcgttgcagagacgtcggtacccacattgaacgtatccagtgagcgggcgtagcagatcactatcagtaagcctgctgccactactacaaggcacagcagtgcatcagcccagcgtacaccgctcaggctacccagcaaccagaacattacgccgcgcgattgttcggcatttgccgccgtactgacaatgtaggatgtcagtgcattaaacagttgcgtaccggcgataccggccaggatgatgcgtgatgcgttctcgcgcatgccgcccgataacactaccatcagcgaaaaagcaacacaggctccggtgaacgccccggctcctgtggtaattgcgccgctgccaataccaagcagcattacactgacggctccggttgaggctccggcagagatgcccagtaaataaggatccgcaagcggattgcgcaataacgactgcaaaaccagtccgcataacgccaagccaccaccactgctggctgccatcagcgcccggctcatgcggtactgccagataattccggcttcgacagggggcagattgaagtgagttataccaaggccattggttattgcacgagcggtagtggcaaaactcactggtatatcgccggtcgcagcagccagcaccatcattacaggcagactcaatatgccggtaaaaattatcaggccgtttcgccagtaaagaaaaggatgacttgtcatctggagtgatagaaagcatggatctgttgcccaatcagctctaccgcttctacgttacgtaatgacggattgagcgacatagccggaaccactacaatatggccttgtttcaccgcaggcatttcccgcgtgacagggtcggtttccagaaaccttttttttatcgtcacgtcatcggcgggataaagccgcctgtccatgctcgcgatgacgataatatctggctgagctttgataatgtattcccacgtcaccgaaggccactcttcgtctgaatcgatgatgttagacagaccaagagttttacttatccagcccggtgcacctttattaccggctatccacggatcgcctttcaggcgagtgcttgaaaaccagtaaacaactttaagcggtgttgacggctttatacggctctgcttcagcacagcagcaatacgctcagacagcttttgcttcagagcttggccacgttgaggtacatcaaaaatgcgcgacagcgctgtaatttcatcaaaaataatattgattgagtaaggttcagaacgtgcaccatcaccgttcgaggtagaggtgactgtttttgctgtgcagtcagctggtgatacccagcttttgattcccagctgctcaaattgctggcgggtggcgacttcgccctgtggcccaacgtgccagctgtactgagcaagaacaagctcgggccgctgagccgccacggcttcgaatccaggcgcattctcagccagccgtttcagtttttcaccctgctgtttcagatcatcaggtagtgcgccaaaccagacggatgtacctgctattttctcttccagtcccagcgccagcatcagttctgtttcatgctggccaatggtcacaacacgtgaaggtgcctgactgaacttctctttaaacccacagttttcaactgtgagcggatagttagtggcgcccaggctgaccagagggaataacagtattgcagacatgattagaggggaagtcagtttcatcaccatgctttaagttatgttataacgtaacaatatgcacaatgaaaaaatttctgtcaatgcatagagaacgactaagcaaagagcgcagcctgtgcttctcttctattaactccgtcagaatcataatcagcgtcactgcgcacaaaacattctgtaccaatcaatcgccgatatgtcgtcttaaaaccaccagcctgtatcggaaaaaattacgttaacaacggaaagtattctgagcaactctggcacagggcggatgctcggcatgtttttttactaagtaactattggcgtcagggcaagtatgtaaccattcatccactctcacatggctcacacttattacctcacatcccgctgagagtgacgtgaggctggaatctgatatctgacattttatgccagctccagacacagaccttttcaaatatgcagcagatccaaacggccgtgctgcatcccagtaaaatgtccgtttctggcacaaagcggatacggcaggctagggtccgttatgagcgaaagaggacatccgtagttgtcattacactttgagctcttgcttccattgtcgtgtattcattaatagggggcaggtcaggaggattggtgtttcttgtaaacctcaattgtggataaaatagaatgcgctaaacgcattgttcaaaaggaaactgaaaatgaaaaaaacgattgctctctctctggtaatttttccacttacgcaggcagtggcagccagctgtggcgaggcacagattcagtcagaaatgaatcagtgcttttctgcggactacaaagaagcagacagagctctaaatagtgcataccaaaaggtccagaaactcacatcaggtgaacaacggaatctgctgcaatcctcacagaaaaaatggatcagctatcgcgacgccgattgtaagttccagacttataaatcaagtgatggctcagtaagcccgatgaatactgccatttgtcttcaggccaaaacagaacagagaactaaagagcttgaaagtatgctgaattgtcctgaaggtgatgtaagctgcccactataaaactctctgtccttcaatcatcttttaggcttaaaatcattcagctcccttcatgtcctcattctgaaatagccccctgatggaggctatttctaattttatggctttcagctgatatgcgccttgataatgaatctagtgtgaggttaacaatgtccgcttcttgcacaaagcggactgactgaaagaccgatgtccgctatgagcgaaaagcggacttctaaacaaagcatataaagctgctgtcttgacgagttgtggccatgcgttttgcaattctagcaggttgaccgtaacaaataacctttgcatcatggcatggagatgtttcccactcaggagaaggttacagtggtgagtatgaaaaaaaggatcgtcatcgtgggtgccggaatcactggtgcttcaatcgcatggcatcttgcccaccttgaatttgacgtcactgttattgagcaaaatatgcctgcatcaggggcgaccggcagcgcgttcggctggttgaccggcgtggtgtgtgatgatgcgcctgatgtgcttctccggcgcgccgcacttgaggactggcacaggcttgaagaacaaattccggagcttcagattaactggggtggttcattaaaatacggagcaacgtctcaggcctgcctacctgaagaacgcctcctcgacacagccgaaatagccagtcttgagcctgcgttggtacttcctccctcagaagcccgttatgctgcaaaagatggggccatcgatgccatagaagcgacacgtatattactggataaggcctgcggaaagggggtggtagtgcaaaaccaaacgactgttgagggtttttgcatgaccaaaggcaaggtgacaggtgtcctgacctctcaggggcaactggaggcggattgcgttgtgctggcctgtggaacgggtattcccgctctgactaagctgatgggtacccctgttccggttctggcatcacctgctgtattgctacgttttgcagcaccccagtgcgtagtcaaaactctcatcgcaggtgatgatatagaggttcgacattcccgtaacggggatttgctagcagctgaggattatccggcaaacggcagcgtcagagaaactgttatcgctgctcaggcctcaataagaagcaggctcaggggcgcagagtcggcttctctcacccaatactcaataggagaacgccctgttccgcaggatgagtatccagttcttggcttcactgatgagagcgagggcgtctatgtcgcagttatgcacccagctgttacttgcgcagctacgatcgggaggctggtttctgaagaattacgcaacggtaagaacgatgagatcccggagatttaccgtctatctcgcttcggaaataagcctttatagcaaagttaataacttgataagcactaatctgcgacctgtttattagcgtccggaatgatatttaagcccacttcaggcacaactcggacgaaccccagactcataaggtccgttttgagcgagaagcggaagttatttcttagagaaggtttgataaaacggagttagagccgaacagttgtcactatccggctatgagcaatgaatcaaaggccgaatatagcctcaatttctatcgagaggtcaggtgagaacaggcggctgacttctacgagcgagctggcgggcaagtgatcgccgtaatttcggtacagcactttgcgtagcccgtttatctcctcaaaagaggtaataaatatagtcaccttgattagtgctgaaaaatctatctcttctacgctggcaattttcctgatttggctgaatatttcttcggcctgctcaacaatgccttcatgttgtgccgctgtgccaaacgcggtcaggccggaaatatagagcgtgttgccatgctttactgaatggacgtaaggagcctttacttcacctaacgcacggtaattctttcttaccagattgctcatgcagatggcctttttgaaagggaacaagccacaaccttaccattccactgtgaatgctcaacgttgattggcgtatcgtaaagtatgcaatgtccgcctttgacacaaagcggacggagtcagattgacgtccgctatgagcgaaaacggacattagccaagctaactagtttagccaagtctgtatatcgtaagaagtaattagacacttccctcgcaaaagctgtggccctggcagtcttcattatgctgggcatgtaaagaatattcagcggcctcgactgcagtgagaagcaggaaatgtgctgctagatgtaaattcgatttattcgaatccggcgaaaaataatgttatgccatgtgttaagttgcttgagtaagtcatatatgcataagatgtaaaccaggtacggaaaaattttccaatatattgttcgcacacacttgtccaatgagcagaatagaaaaccaatctgacttatcacaaccctgattaacttcatatttattgtgggtaatggatttactcatttcttcgaagacatctgaaaaaaacgatgatattattgcgataatcaatcgcacggagtgtatgtcatgagtgattctaagttttcgaataaaagtgaaaaagaaaattttggatttatcctaattgctatagcattctctattttctacatggcattgacaagagtagaactgcttatatcttactggaagattttcatatccctggaaagtgattccatgttaaaagtttttttcattctctcaatgatttcgttatctttagttatatttttatcgctattgtttctcttatttttctttaaaagaaaaaaagtagctaaatatgttttcttgactcttgtgttaatatatgtaactatttactcagtaacatatatgtatggagtttatgttgttggcatggatattaattcgttaactcctgattatattggtcatctaataacagaggcagcattctatcttcttatctgtactccatatttatttatttcacaaaaatccaagaatgtatttataaatccttgatttatatgtattatacaaggcggtagcttcccgccgcttaagaaggctgatgtatcacggttttgtattgatgtcagccaggaaaaccattatttgtttataacatgattagatgttttcatttgttatatacttattttaaaaaaggaatagaggattgactgttggaaattattttaagtgcctgccatgggctgctttcattctttctgtggtgctatataatttttatttagatcctgatagtttgatgtggagggttttatctggaatatctatgattagtttcttactttatccagtttcaaagatggcaattgaaagatttgctttgatctataccaaaagggaattctggagtcgcgggatttttatggagacaccagctaaaaatcctgtatatattctctattatttgttctgctttattatggcaatcccggcaagcttaatgtttctgattatttttctgtttatgaaaaaggcctctaagtagaggcctgatgttgaatcataaaccaaccagccgtttaatctcaagcattacagtatcattaacgaaagcgcttgttgccgttaaaagagccacgtaagctatgattccagcaggagtagtcagaagtgctccgaaggccaaagccgtaagatgtgcggcctgaacaccaagatatattcctcctacggtgacaaagaaaggtctccagtcacctgttctaagcgcttttggaagttcaaccccaacaatgtcataaccatctattaattttgacgtatatccaagccctttactcaggcggaccaaattttcagaaagcgtttgtttatcgacagcttcaagtgcctgcgctatagcctctcgatcagcgacgctgtacttattattcagtacattgccgtactcctgaaaggctgcataagcctcttctgcatttcggatttgcttgccctgtacgctatcggctaatgttttagctgcctgtgaaatttgcgctccggctctttctgtagccagctggtaaaaatccactacggctttggcagaatctttcagcttattgtcatcaactgtgagctgcgcctgcgcctgttgctcagcgcgacgctggagctgtgcagcaggcatacttgtagtgaaggctacataaagcggctccatgccactttcagccgggaaaccagacaataaggtcctgtgtatttgcaccagcagtcgcccccgcaggtaatagctccccctgttcaactgaagtattccagggtcttgttccctctttactggtgctgtaaatataaaattccaggaatccaagcgatcccggcatcataccggcaaagaacgcttctgtattggagcccttgtaactggcttgccgtaccggcacgttaaatgactgctgcctctggtctcctactgccgctagatattgcacgccattgcggacatcatcggtaattctggtgtgtaacatcaccgatgctggcgccgcacttccagcagaaactggtgtgtgggttaattgtttcagaggcagcatagtgatgtagggattaactgtgttatcaggtgttggatatgccagagctggtgtaaagcgccagaaaggtgcgcttatgaaattatcccactgtggagaagtaagcccctgggtaacctgagataatgcagtctgcatttcagggaaaagtgagggcaggggattttcccagactccatcgactgtcggcacaaagccgcctccagtatcgggattaaatgattcaaccggataacgtgcgctgctttccggccacacagtcagagtatcaccaccaatataccctgttgttggatagacccaccctcctccatcccaaacaagtccaggctccggcgaaacgccattgttgtaattttcgtaagacataatctctccttgtattaggtgcaaccacacgcacatttgtttaaatacacagtatttttttgtacatatgttaaggaaaccttatcgaaacgataaaataaatgatagtgatcatcattcgcatttacagtaatttactgctgtatgaatgctggcgatatataaaaggaaaatttttaatgtgaatgtagagccggttaagcagggtcaaatagcccttttattgcggactttaatgtttgcgcttagagattcaggaagtttataaccgggcatgattaaccatcagtcagtcgtgtatttatgcgttactggctggttcatcatcttccgcggccggttccagatatctatgctctgctcaatactgttattcttatgcttcgcggctgaactagctatgagcacaggatagccttgcgctggcagtgaccgtctgctcctggcacaaagccgacggaggtcgctaaaggtccgctttgagcgaaaagcggacattcattttaaattttttcccataatgtcttcttgcgttgcattaccagtttcgccaagaagggtgaatctgctcggccccttacgtagcaaagtgtccgactaaacagcagcctataattatccccacactattgccgtgggagtcagcatatgtttgaaggatttacacatacacgagtcagcctttcagaagcagagctcaatgtgcgctatggggggaaacggaccacctgttctgttattgcatggacaccctcgtacccatgtaacctggtcaaaagtggctcccgagctagctaaatcatttaccgtcgtatgtcctgatttacggggtttcggccagtcgtcaaagccggctgatcagcgtgatcatgctggttcttctaaaagagctaaagcaaaagattgtattgagttgatgagtcagcttggttttgagcaatttgcgcttgttgggcatgacagaggaagttacacagcttacagagccgctcttgactatccagagcgaatcacacggcttgccgtacttgattgcattccaatactagaagccctcaaccggtgtaatgagaagtttgcacggcagtggtatcactggttcttctttgctcaaccagaaaagccggagcgggcgatactcgctgatcctgacaagtggtatggagggcagcctgaaacaatgggaaatgaagagtactttgagttcagaaaagctattcatgatccggaaactgtacatgggatgcttgaagactatcgtgccggccttagtatcgataaagaacatgagctccaggatcgccagaaaggaaacatgattatgtgcccaacgctttgtttatggtcgaaatatgatgatctggaagatatatatggcgatgtattaggtatctggaaaacctgggcacatgatgttcggggaaaggcgatagcaagcggtcaccatatggccgaagaaaatccaaaagaagtcacggctgaattacagcgttttctgttgcaactttgctagctgtgtacagatatatacttatagtggaatgccaacgtccgcttctggcacaaagcggacgttgacaggagttgaaaaaaaccagccatagaatttttgcttaacgttcaaggtttccgtttggctgcgacctttcccggagagcaaccgacggtccgcttaaacgcttttgcgaatgcgctttccgactcatatcccgatgctgctgcaatctgggcaatcgtctggtccgaataatttagttgctcacaggcaagcatcattctccactgtgtaaggtattcgacaggagtggtgcctacggtctgcttgaagtgttttgcaaatgctgcacgggacatccctgcctgcccggcgagcttagctatcgtccacttgtattcgggattctggtgcatactggtcagcgcagcgctcagttttttgtcccttagagcaaaaagccagccagtcctgattttctgattttcatttgcatacagccgcagggcctgtatcaacagcataaatgccagttgctgaacaatcagtgcgctgcctggctgcggctcacagatctcctgaaccattctctcaagtgcccactgcatcgctgccttatcggatgggttccgaatatgtacaacggccggcaacgcctctaaaagcatctttgcagcttgcccggccagaagaaaatggccaccaacaagcaaacagcatggcttttcgccagcctcttcggctgagaccattgcggtacggactgtcgtaaaatctaccgcctttgctgataattctgttgccagtctgaaagggggacctggaggcagcaggaagcagtcccctttctgaagcctcaacaggtgcatattaccttccacagacagccagcactcgccagatacaatggcatagcacttaacgccgtcatgagatggccattgtaccgatgatttggccgcaagctttaccccgcctgaaacataactttccggtctgagaagcgagagcagctgtgaaagtatatccatataaatcccagactatcagacataaaaaagcgactttatcacatagatagtagtgctggccgctcttaaagtgacggtactggattgacgaagcaaccctcatgactgataaggcgaacacaatgcgtatatttctcacaggagcaactggatttattggttctgcagttgcaaaaaaactgatcactgccgggtaccgggtaacagggctcaccagaagccagcagggagcagctatgctggtcgcctcaggcattgagcctcttttcggcgacattactgagccggaaagcttgaggctcggcgcaatggcaagtgacggtgttatacacaccgcattcaatcacgatttttccaccttcaccataaattgcgaaatggaccggctggcgattgaagaaatggccggggtattaaaaggtacaacaaagccgttacttataacttctgtcgtaggtctgggttcacaaaaaacgggtgcaattgcggtcgaaaaccaatttaatcatgaacatatgaaccctcgtaaagcatcggagttggctgggatcgctgcacttaaaaatggcgtcaatatctctctcattcgtctttcccaggttcacaacactttaaaacagggcctgattacgccgctggttgagattgcccgagagaaaggcgtttcggcatatatagctgggggagagaatcgctggtcagcagtacatatcagtgatgcggcatctctctatatcctggccctaaaacgcgcgataccaggcagtcgatatcacgctgtggcggaacaaggtattacattgaaagccattgccgagaccattggacgtacgcttaatgtaccggttaaaagtattgaatcatctgaagcatcagcacattttggctggttgagtaaatttgtcgctgaggatatgtctgcatcaagcgcaatcacacaggagcagctggaatggcgcgccaaaggaccgaacttaattaccgatcttgagaagatacatatttaactgaaaaagaggcagatccgctattcgctcaaagctgcctatgattcgttccgcggcaggctgtttgcccaacgcctaacggccgcgtagtaaactgccaccaatttggcattatacggtgccctggccataatgtacggaccggggcacaacaacaaacccggaaagccagtgaagtatttttacctagtgcctctggcaagtatccggcctttccccgtaaatacccgcttagagccaacatctgcgcgaaatctccccgcatgcacgtccgtgcatagccatacagttgctcaaaacttatcagggactttttttgcggatatcgggacggggaaaaggcaggacggcgtagaaacgcactgagggcccctgcgggggcggcaagagatgttatgaatacgggtgatgtactgactgcaaaaaataaaggatacgtatgaaaatcgagatttaccgggattcgggcattccagatctggcgagagtttttttttcgaaatggaattttattacttcgggagtgaggctgccagctatgactaagtgctctcttatctgaccaacagcattttctccgcctattcgggtgtgaccgttctaggcgcatggaaagacggagcgctcgtcggatttgccacgtttacgctgatgtttcctgcgccaaagttttccgggcaggcatacatgaaagatctcttcacatcagcagcagtgagaggccatgaggtcggtaaatcactcatgcgatttattgcgactttagcagttgaacatggctgaacacgttttgactggactgctgaaacaaccaacccgaaagctgccgaattttacttgtcactcggggcttctacggtcgaagaaaagcagtatttccgattaaatcatcaacgtttagctgcgtctgctatgcagaacgcacattcctgaagcccattccggctgcgtagcggcactacctggccgggatgttatattaaaagcgaggggctctgagcaataaatagaatgccgccaaaaaagagtcatggaaatgaggaaggatccatcaattatttgttgagtgggaatcccgccactgtttaaccatatctttagttaattcttttttgtagcagatcggtgaataaccgtcggccttactccatgcgctgcgaccaccataggcgctgccatttcttgcgctgttaaaggggcatgcacatgttccggtataggccgctattgattcatcaataatgtcctgctttacctgtgcgtctgactcggttccttttgctgcgggtatattgctcaaaaggggaagcatgagaaaaaaaggataacaggcatagccgtacagtcttaagcatttgagttgaccccttagaagcaatcctgacaagtttaagcctttgtataaaaagccaaccggagccagcttcttatcataagctgtgttcgattctgtcgtgtggcggatatgaatcaagaaaggtcgccccagcgggcgacctccgtctatttttttctgggcttaccagcgtctgaacgtttatcacgaacggtgccgtcattattgcgatcccttggctgtgtgccgccgcccggcttgggaacaactacatttggattaagtggtcttctgtctgccattttacatttccaaagtgattggcaaagatgccacttactttgatacgccgcatttcgctgcttttcaattttgacaagacaaaagcttgttcatgatcaaaatttatttttatatagtcgttttaaagtcataaaatcatgctaaatttgtaattaatctattgatttaaatgtttttttgcttattcattcaggtgcgtcaattggataaagttgctacttaaattattctgattatcgtcgttattatcgtggctgaaatttttaagcccaaacgctgcagcgtctgtaacagcccatttcaacgcaaatattacaaatggaagattgccggtaagaaccagtatctttgccctgcctgttctgcccgtatggatcggaaggtcagtaagcaaaaattcgagcagaagtttggaaagtgattactgtcaggaaacttgctgcccgaatgttatgttcaatccagagtagagtcagagttaccttgggaaactgatttaacaaaatgcagtgcagcgcacagtttcttcctgctccgtgccgataacagaagtgacagcacccaaaatgcagcgccagagaaacaatagcaactcatgagaccttgctctgccaggcactccgtccggattgccttttttcattgtggatccgtcagctcttgcctctaagcggtacggttcgccagccggacgttatgttcaatccaggtgatcttgcaggttaccagcaagtacggtgcatcgccggaatgcgaaaggggggcgtccgcttctcgctcagagcggatgattctgccgtggccggtcttcgagctattatagtaaatcaagtatgctcgcaggcagaaattccccggtaccttttatgctggcgcaaatccggcaggcacttatcgaatctttcagctggttcacattaaacttaggcttctgtacctgtctggcacccggacgagacttttttccagccccggtatatgccgacttgcggaaccgcatttttccaccatgcttgagacgtgccgttcccctgttagatccggcgcgcttgctgtaaaatgtgaacgctttttattgtttagcacgctcaagatggcgtgtttttttggttaaaattccggagggaaagggctaagacatatgcatgatgccagaagtgaagaggggaccacgtataagcctcgttttctaatgctaacgcttgctgccatggagatcttttttattaagaatggccggcggctccgccgcaccccgataaaaataaccgtccctgaattcctctttgaaccgcagttattgaactgactctataaaactggacggttcctatcaggcggttgatcgggccttttttcggtactttacgtgactcagcctgtttagattctgttttattccttcatgattgtaatagtcaatacacttggcaataccgcctcataactagcttatttttttaaactctctcaggcggcagcattccgttttcagctgccgaagaagcttttcattatcgcattgcacagcattttgctttgcgggacatactatgttccaaccctgcagcttcaagcctcttctgaccgtgtggcatctgatactactatccctcaactgagcacagcagcggataccggtatccggcacttcctgcatccggtacatctccctgacttagccagtcagaaaagaccgtttagcttctgcaatttatcggtaagctacattcctgaactctggccttatgataacgtcagcgcatgtaaataactgcgacaaacgttcctgaatcaggccggaaccatctgaagtgctcacaataaatcagggcttgtcagctgcaaataatatgaaggtaccgtttttcgtaagaaacactgtcctgcaggtatctgtagatcccctgctcaaagtgctggacataataatatttttaagtgattcggcccgttaataggttaatttaactaaacttttttagttttaaagtattaggctgaccaccagtcattgcagctgcttctcatttttttcggtggatacagtgactgcttttgcatctttacgcaggcaggtcccgtgactttctgccaggcatgtgcgcaggattgccagaccgggtatcaggcgacctgctgcctgtaggggaatcagcccactccgaagtcagggctccgggggcagctgcgacaggaatattatgggcagggccctgttatttttatgcgcgaagccgatacagtctgtatgtgcctctgaaggcttttgtgatttcttcgctgctcactgttgcccgtgctgcccgtgtccggcaccgggcaacagcaggcagccgatgacaggcttcatccgcttacgttctcatgctcattttaggataaataacgggttatttctggcaacaggcaggtattgtgcgggaagtacgccccagtttggatagattaaaaacagcacaatgtttactgattatactgacgggagtccccggatgcgcctgaaaattttccggctggccatgattaatatggttaccattgttttactttcatctctctgggaattcgggctggaaaagcatgttttgggagtacttggcctggactatgacgctggctttgaaacgagtgagaggctgagatttattctgacgtcaacggtttttgccgggctggcaatgataattccggggctgctcatcgccggcctcatgcgcaaaagtatcgcagcagagaaaagtgcgctcctgcttgccggaacggatgagctgacgggaaaccggtaacaggagggcgttcagcgtccgccttgctgaacttgacgctggcgggacaccctacacccttaccctgattgacgttaacgactttaagagcattaacgaccttcacgggcatcagcagggtgacgccgtactgatcactctggcccgactgctgacagcattcgccgggcctgaaacgcaggtattccgcatcggtggtgatgaatttgctattacctccggacattgttatacggatgaagccattgagacagcccaaaaccttctcagacgcgcggcaggcatacggaccggaccgggaatgttcctgagcctgtccgtgggagtggccagccctgcctgcagcgccggatatgacatcgtccgggcggccgaccttgccatgtatgaggcgaaaagggatacagcgcatccagtggttcgttttacgctcggcctggagcagcggttccgccgcagggagcggttacagaatgacgttgccatggccgtcagaaataacgatatcgtacctttcctgcagccgctggtctgccttaagacgggccgcatcagggggtttgagatactggcgcggtggataaatgcttccggacgggccgttgctccggacgtatttcttcccgtagtggagaaactgggattgatggacacgctgaccgcccggctgcttgaagccgttgtcccgctgaccccagggtggccggcaggccttcatctggcactgaatatcacaccggagcagctgcttaagccggcgcttacggcgtgcgtgtcccgtatcatgcagcgcgccgggccggtccggctggagatcgaaattactgaacagcacgtgatgatgatatccgaagatgcccggcgggctattctcaccctgaaagaatcgggcatcggcgtggtgctcgatgattttggcaccggctattccaacctatcggtcctgctggggctgggtatcaaccatatcaaaatcgaccgatctttcatctctgattttataaacagccccagaaaagaaagggtggttgagaccctgctgcagctttgtaaggacctgggggtcaaggtaacggcagaaggaattgaaaatacggccacgcttgaatggctccgtaggcggggctgtgattacggccagggctatcttttcagccagcctgttccggcagagcatgcagccggcctgactgcatctggtctggccgctgacttgtgttccggcagtatcttgcccgcgcagcctggctttatcgcctgtggcgatctgcctgggcgcgattttcatgagaaaaagctacctctttaaaagcaacgtataaaaataattagcctctcagccggcttaactaatttgcattgcgcaagcaagcctttcagctgcgcgatatccaggctatatgatatgcggcagcgagcctgattacttcctgctgtaaacccgtacacattatattgtgtgcaattctgttgtgctcagcactcctgaatgcgcgctttctgccgataccccttcatcaaacaaatgtttcccggagaaacgatgaagatttcaacgcgcctcagcgcaggctttggtctgcttattctgctttttgtcctgtgcacgggtatcgccgttcacgccctgtggcaggccagggaagggatgaacgacaccgtcgacgtgaagatgaagcgctttgcactggtggtggacatgcggaacggcgtacgcgacatggcgattgccgtgcgcaacctggctctgctgtctgatccggcccagatgcagcccgagtggcagcgcctgactgcacagcgtgaggcctatatccggaagcgtgagcagctggaaaaaagcatgtcagtcaacgtttcagcacaggggaaggccgcgctggagcggacgctgtcaacggagggtgtcgcactttccacgctgatgacggccggaaagctgggactggataaccgccagcaggaggctaccgtctttctgatggccaccgcccggccagcgcagaggatcctgctgaacgccctggacgatctgacggacattgagatgcagctgagccgtgatacggtgtctgaaaacagcgctcgcacctcccggaccgccgttatcctgtcgggcctggctgtactgtccgtcttgctgtcggtggcaacctgttatcttctggtccgcatgctgacgcgccagctgggcggcgagcccgcgcaagcgcaggcgctggccgccgccattgccgccggcgacctgacctcgctggtcacgctgcgccgcggcgacaccgccagcctgctcgcctccctggacggcatgcaggccaacctgcacggactggtgtcgcagattaaggacgcgtccgcctcggtggcgctggccgccgacgaaatttcgcagggtaataccgagctctcctcacgcaccgagcagcaggcggcagccctgcaggagaccgccgccagcatggagcagctgaccgccacggtaaaaagcaacgcggccggcgcacaccagaccgctggcaccgcgcgcgagacggccacgctggcccgtgccggtgaagctgacgtgcagcgcatgtcggagaccatgaacgagatttcgctgagcgcggtccgggtacgggacataacctcggtcattgagggcattgcttttcagaccaatattctggcgctgaatgcggccgttgaggctgcccgcgctggcgaggaggggcggggatttgccgtcgtggcaggggaagtcaggacacttgcccagcgcagcgccagcgcggcgcgggacatcaagctgctgattgaacaggccgtatcccaggtggaaggcggcgtcgctgcagccgccggtacgggagagagtatcctgaggattgtaggcatggtgggagagctggccgacgccatggacagcctttccctctcttccggcgagcagatgcagggcatctctcaggtgagcatcgccgtcagccagatggacggtgtgacgcagaacaacgccgcccttgtggaggagtcgtcttcagcatcgcagtcgctgtcagagcaggcccgcgccctgcgcggcatggtggagaccttccgcgtatgaagtacgatagacatgctgtattcgccgacacggaccgtattacttctcttaaggtcgatgtggacacgctgctgcggcagctcagcgagggggaatacctgagcgtggacacgtttgccaacaactgggttcacctgatggccctgtacgccagaattcaggaacagatgaacgaccggatcctgatggaccggctggttcgcacggacctgctgctgaccgcagacctgatggctgtgggccggatgattatggtgataaacaattttctgcgctgcactgccaccgcgcactgaaccggcccgccggttctcgttgacatcaatttaatctgactcaatgctgtgcgccctgaacggggcgcagaaccgctgctgtccgcccctgactgcctgagtccggctcccttaacaaacgtgcctggtccggccgcttcgccggaaaaagcggcccggccggaagatatgatgatatgaaagatgaaatactcgggaaccacgatgcggcgccttaaaccattggccaatttctgtgctttgcgctttactcgacgtcgtttaccatgacgaagctctatcaaaccggctgaagccgctaggactgacctatccgcagtacctggtgctgctggtgctgtgggaacaggatggcctcacggtctccaaggtcggcgcgcgtgtccgtctggactctggcacgctcagccaactcctgaaacggctggagcagaccggctttatctgccgacagcgcgatacgctgcatgataaaccgtgcgtgctgattttcctgacggagcagggccgccggcgtgcctgcagatatggtgtcggtgatggacacgacctgtgataagttgagtgtgctgactaagcgggtcgccgctctgcgggaaaggctggtgcgcgcgcaggcctgacaccgttttaccgcttctcgcctggtacgggaggtatcataaccacgctgggggagctaaatgacgtcgttgccggtgatatacagcagggcgcctatgcgtcaggagtatgaagtgtgtaccaaccgtccggataatatggaaaaatgttaagtcagtgatagggcatgccgtctcagctcttatgaagtgaggaaaagaggtgagcatgcaggagatacgggtctttctgaagcagcaggaggcccagtctgcgggcggcgtaaaaagctttacggccgggcaatcagcgtcgttgccggtgacacagacttatgatgccgggtgcttccgtgttttaataccgcgccggaccgcgctaaggtatccgcccggtccgtgacgcggccagctgcgtcctcctgtttccacatgctcagtgccgcgtcatcttccctgatgacgcctgaggagcagcgctgactcattaaccggcgcgccctatctgagtaaaaaaaggaccgcctcaccgagcttcatgtctgcccggtttttcatcttctgttctgtacattaacattgcaccgcattcctggtttcagttatagctaatgccggcgacacgagaatctgccaaaggaatccgacatcaatggtcgcctctgcgacagtatgttcaaccggaaatttatgcaccgcacgacaggcagtctcacggcatcctgttctgcggagaaacgacgatacatcctgaggcgggtatctgccggccagaggcggaacagcgcgggtgccggcgcgttccccccccgcgccctggcctcctatcagctggttgccgtcctgaattgtcatcaggcgtgattaaccttttgataaactgaattatttttttgaagtcagaatgatatcgggatattccccggaatgaatttccctgccgtcggcgttttttgcctgaaatagtgctgtttgatgaattctgcagccggtccggcgagcttgctgcatgaccggctctgtcaatccggcgggttcgcttgcgtatccccctttttgtatcagaattatcctgtgcctgtttcaacagatccggggcacgacaagttagtctgaacctttttactggttcacccgtcgacgaggcgggttttcttgtgttttatggctggctccgtcacggtcacgtgtacagcattccgttttactgccatcacagcccgtcacgcagaggtgcgccggggtcggtaaaaagggtaaggggtaagcccgtactgcggcgcccgccgaaaatggacagagtgctgccactccggaagcaggattaacttcaggatacgccctcactgaacgttatcgctcctccagggacttcacgccggtcagtttatcaagcgcttcatgattgatttcttcatcggcactgtcgaccgccgttgaaatgctcagcagagcctgcagctcgcttaacagaatggcggcatcggatttaagcagttcgtcagactcagcagaatcaataacggtattgatcgccttgttagcactttcgatcatttccgttacgccgccgtcccggctaacagccaagacgagtgcgctgattagcagcgactgtgcctcaatgcgcgctgtcagctgtttcatgttggcatcaatatgtgaaattttagccagcatgctcagtaccacgtttttcatagcgtccgctcccgctccggttaaaaagggcgattttactcctccttgccagccctgcctacagcggcgctctgaaaatacatacggtaatcctgaaatgcgtgcggccctcggctcagaaatggtctgtcttagctccgggatgctgagccatccggaaacacaacgccgccctgtcttttacaccccgtgaagaagcggagcccctaaaaaatccaccgtttaccgaaaagaagaatgtctttactctctagctggcatgttatgcacactgtgctttgacgccattcgggcgttacctgcacggcttcccggacctgccggttaaaatataacgatattaccagccccggcggcgaccggcatgtcgcaccgtctgacactgatgcgcgggctgcagtaccggacggtgcaaatgccagaaaaaaggcggatgccgtttccacctgtctatgttgtgacggggggaagaggatctaatgttcagaggccgctgcctgctgggggcttttatctcatccggtataagcccgccgccaggtctgatggtgcccacgggagttgtacataacttatccaccatttttgtggataacgtaaggggcgtgtcagaattcaacgggagtctgtgctatatatcccaaccttccagcggtcaggtcattacatgcgtgctccccgcaggtaagatggattccggttaaaggaaaggtgccagcatcagtcagacgcctgaaggcctcctcagtggcggatcagagcagaagcagaagacggcgcaccgacgcctggccctgttgcgctgacaaccacaccgtcaaaccggataccgagacagcacccgtcccgcgtggtcatcagaataaaatccacccgcttaaggcaagtgacctgcatccggaagcagaagttaagttgtctctcccgcccataatacggataaaggcgtgcatatacgactgttgttcagtgtaatgtacagttctggagaggcctcactgaagagtcttaacggctcattctttgtagccatgaatacctgaagccgctccagaaagtcgtcgctattgtaaccggtgccgaagatcttattgaacagaatcgtatagtttcccgagcccgaacatctatgctccgtcattgaacgggtttcgtaaaagtgattgtcacacccccgcccgcctttttcggcggccatgtccggtaatgtgcagaaaaaacaataaagtttagtcgtaaacttcctgtgcatgggatcaccatataatgaatcagtctagggaaacagaacagctcaccggagacgccgtcctgcagataaataaattgcgtgcgacgctggtgtgagcccgctgtaaatcctgtagttcaggatgcaccggaggcagttgtgtgctgacggtaaaaagtatagggcaggctgacaggaaaacgcgaagttacgaaaaggcaatcagggtactacggccctagatcatttattaccggagttctatgccgggtatttagacggaatataacgctgtttaagctgatgctcatttctgaagtagtcttcgccgcattcagcagaacagaaagccgtgcccgctacagcagcttcatcccggcaccagatacacctgccgtccggactcgtcagtccgggtttccgtgcggacagggctgaagcaatcagcgcctcctgtacttcatgtgctaaatctgcatcatccatcatcttcccctgagcgtgaattattgtcagttgatacacctgtgaaaaaagtcccctttataaccaagtgttatcagtaattatagttcatctatatgtttttgagtaaacagcattcgctgacagcgtctgagtaatacccatgttcctctgccttaataggaaaaccccctcgtcactgtgcaatgctaaagttttagctggtccattacagacatcgatcatcaagtctgtgtaagcagctggtgtcctgcccctcaaagatttctatagctatcaataacctgatatcttatgacatctcattaattgagaatgactctttatagggcgccatttcttgcgagctcatcatgagctgctggctgaggctgtagtttttgaggtaaaggaaatcagcagatattattaatgcatctaagaacacctgtaagtgataaaggtacaagacctgtttagtttccgccggttatgctggtctgcagagtgggcagttgaggcaatactcggcaggttttgtcgccttgtaataaaaacagcaggtgcgacgaaagcgcacgggctccccctctgcgttttgctgaaacggtctgtaaaagcgtttaagcgggttccagggcaggccaaagagggaaggggaagcctgaccggtcagccagttaaagtcggcatgctgacgctgcgtctgctcttcatccagcttattcatccggccctgataaagcgaaaagacccgaacggcggtattctcccagagtatctgcacgggtaatccgcttacctgtgccagactctgccagaccggtgacagaaaaccgctgaaaagtgcctctgcaacgttctcacgccacgcatcccgctcaccaggaaggtaacctgttgccgtgatgtctgtgggcagtgacgacgtccataatccgtcatcatgcgcatactcaagccggcaagatgagagtgacaatggtaagcccttatcaaatacgctcatcgcatagagcacattgcccgttgcgagaaacgccagacgctttgcgaataatgaggcggcaatggccatatccggcgcccccgttaacggcataacgcgacgtaacaactcaccgcaacattgcgcatcaaacacatattctaacggcacactacgcgcatcggcctcagctagggcacgtaagccaaaagtcttctgcaaaaatccatgttcctcaggcgtcagcatgcaatgctccgggaaaaggaatgcacagcggtgagtgaaagaaaggatcatcaataatccggcactgcagattgaatactttattcaccagcggttcagtcataatttcctttggcgcgccctgtgcaaaaattcgtccgtcgcgtatggcgacaagatgatcagcatagcgacaggccagattaagatcgtgcagaaccataatgatggttttgccctgtgtctgatttaagctgcgtaacagctcaagcacttcaacctgatgggctaaatcgagataggttgtaggctcatccagcatcaacgtatcagttgcctgcgccagcgtcatggcaatccagacgcgctgtcgctgcccgcccgataatgaatccacaggacgatgctgtaatgtatcagtgctggtcaggcgaagtgcctcatctacctgtttttcatcttctgctgaccactgacgcagccaggtttgataagggaaacgccccaggctgaccagctgacgtactgaaattccttctggtgggacgggcatctgcggcagaatcgccagcttgcgcgagacctgcgccgtactgctggcatgaatatccatcccgtccagtatgatcgtgcccgactgcggtttctggagtcttgccatcgcccggagcagcgtgcttttaccacaaccgttactgccgataagcacacaaactttcgctacaggcagggtcagatcaagcgagtggattacctgttgctgtgaatagcttacgttaagcttatgagttgaaagtgacacgtctgctccatcagtttacgtacgctgccggagcagcaacgccagaaaaaacggcgcgccgaccagcgcaacaaaaatgcccgccggaagatccgcaggccggaacagcgtttctggctaacaggtcggcagtaaccaccattacgccaccgccgcatgcagtgacaaacgcctggccaaaaagaccatgacgtacgaccagccttccgaggtggggcgctatcaggccaacaaacgccatggcgccgaccatcgcaatcgcgccgccggaaagtatcacgcagcccagcaacagcagcacccgcatcagaggcacccgcacacccaggcctgtcgcgagggcgtcgtccagcatgagcgcattcagataacgcagcgaaaacagccatagcggtaatgcggccagatcaatgacgagaagacgccacactttttcccaggtcgcagcgtaaacgctgccgctgagccatacccaggcagaaaaggtggtcgtcagcggactgaaaaccaggatcagcgtgaccaccgcacccgcgattgccgatacgcccacgccggtaagaatcagtcgtaacggcgtaaggccacagcgccatgaaagcaggaatatcaacccaaccgcgcaggttgctcccgtcatcgccgccactggcataagcgtggtgccgaaggaaacgctgaaaaacgaaagccacagcagcgccccgacgcttgcgccgctggtgacgccgagcgtgtccggagatgccagaggattacgcacaagcaattgcataaccaatccggcgagtcccagtcccgcgcctgacaaaagcgcaagtgccacgcggggtaaacgcagctcgtgcaggataaagctctgcgcgctggcatcaggttgtacaaggagccgcaatgtctggggcaccggcatggaaacatcgccggcacttaatgctgcaagcataatcaccagcaaaataaccatgcagagtagcatcaccagcggcaatcgcccggcatactggcgtgaaaatgggccacagcgaaaaacgcggttatctgacattatttaccctgcgctgcgccagcactatgaaaaatggcgcccccatcaaagctgtcatgacaccaaccggcacttcctgcggcaaaattatcacgcgcgcaacgatatccgccgccagcaacaataatgcgccaagcaacgcacaggctggcagcatcaggcgcaggtcgctgccaaacagctggcgggcgatatgtggcaccatcagtccgacgaaaccaatgctcccggccagtgcgacggcatttcccgccagtcccacgaccagcaggctggcgatcagtcgcacccggacgatattttgtccaaggccggtggcaatctcatcaccggcactcagtacattcatctggcttgcaaacaggcaggcggcgactatcagcagcgtgccgggaagcaacattgcatagatatgcggcaaatcgttacccgtcaggctcccggccagccagaacagcattgtgtcgagcgtctcctgatcgataatcagaatcgcctgggtaaaagcattgcacagcgcggttatagccaccccagccagcaccagcctaagtgggttgtgtcgtccattacccgctctgctggcgaaccacaccagcatactgacagtgctcgcaccgaaaaatgccagtaaaagtgtcagccaggggatgctaagggtaaaaatgctgctggccagcacaatcgccagcgccgcacctgcattcacgccgaacagccccggcgatgctacaggattgcgggtcagagcctgcatcaaccctcctgccactgccagaaaggcacccacgcccatcgccaggcatgttcggggcaaccgggaagtgcgaatgatggtgtcagccacacgggcgggatcggtgtgaaacaaagcctccgccacctgcgccagcgggtagaagcgcgctccggacatgacgctgagcagcatcatcagcatcagaaggctgcaacaggacagaaagcgggctttcacgttggcccccggctcagcgccagctcaacatcattgaggatctgatttgcgccaataaagccaccggacaggctccagggaacgctgtccacttgccataactgccgcgctctcacggcgcgcaattgctgccaaagcggatgtgcggtcataatccggtactgacgcagaatagccgggctatccgctcgcagcagaataaaaaagatgtcggcatccagcagtggaaggttctccatgctggaaaaacgtaacgacgtgctgttcgactgcgcaacctgctcattccagtcaaaaccgagttcggatatcaccgagccgggaaagctttgcggagcgtagctacgaatgtggtcggggcgcacttcaatgacggacacccgggtttctggcccgtgcgcctaaccgcatacttaacagggtctttagggcggcaatccgtaagtcccatcgtcgaagcagatctctggcctcatttaactttgcgagtttttctgcaacgactgtcagcgtttttttaaactcaaaaacgtcatccagcagcaccactggcgcaatcttttccatcaacggcgcaacgtcctgatgtcgaaaacgggaggcaaaaatgatatccggcctgagcatcactattttttcaagcgcaggctgggtttccaggcctaactgcggcacccctgaaaactgctgtcgtaagtaacgatagaccggcttttcagcccaggattcaacgattccactgggcatgatgcccagcgctgccatgctgtctgtggcgccctgaaacagtgaaatggcacgacgtgcaggcggttgtacggcctgcaggctgggtgaaacactgcataacagcagcgcctgcagacagcgccggcgaaagggcgaaaataataattggtttttcatcgtcaggttaaagccccggtgacagggctgccatatttagaaatcgagactatagccgagcgtggccgtgcggccccgcccggcaaaataccggtcagggtcgacggatgcactttgtgaatagtaagtgatatattttttattaagcaggttagaaatgcccagactcagctgcccacggggaagtttgtaacctatggctgcatccaccagtgtgtagccggagaaatccttttcctcatcgtcgaattttttgctcatagcccagttggcctgcaggaaggtgctcagctccgcgttccagtttgccgaccagctggcgataaggcgatccggtgcgatattcaggccgtcaagctttgcatcaaggcttccgttgtcatcgctgtcgtaacggccacgcatatgcgaccaggcgagcgtcagcttgtgatccgcattaaggttgtaacccgtgctgacctccacgccatcgatttccgttttttcccgtcgggccacgaatgcatcatcaaccagctccacgcggctccccagttttgaagaagaccggtagtagctcgcttcaaaatcaaagggcgcatgctggatacgaaagcctgtctcgctgtttttagtgacgatcggtttcaggccgccgtagttttccagtctgatgccaggggtgtcgatgccccggagcacgcggcccacgtcaggcacggtgaaaccttcgctgtagctggcaaataagctgagcggttcaactggcgtccagacgattcccgcgttatacagcgtttgttcaaaggagggcgacccaccttcaacgctgacgcgatcgtttgcccaggtcgtctggtaattgtcaatgttcagacgcgcgtattcatagcgtacaccaccgctgagcttcactgactcaacgggcgcatactcaagctgcaggaacggcgacaggtcggtatagttgatttcgggtacataggtccgaccggttgaccataaatcctgctttgaattgtcaaaaagcgtatcgaaccctaccgttgccttaatgtggtcgtcccagatatcatctttagtgagagcgattttagtgccgtatttgtcggtaaaggcgcggctctggtcgtaaagtgtaccgagaggggcgatcgcaggatcctggaaagaggatgagtttgtcgcgccgaataacgcttcgtagcgctgataataggccagcgcagtcagcttcattcccgccagattataattatcgtaggtcgctcccatcgtccagacatcgttgcgcggcgcgctgccttccggcctgcctttttttgaagtggtcaatatgccggcatcgcgatcgccggtgacgctaacgtagtggtctttgtttttcagctggtagcggttgaggctcagctgtatgcgctggtcattatccagccagtaaccgaccttcgccagcaagtcccaagcacgagaatccatgagatcgccctgggtattatcaactccaatcgcatgattatctgcgtccctgaacagaccttgatcttcgtaactcagtgcgaacaaataatcgatgtattccccactgccgttaatgctgtaattcgttttgtaggcaagcgtatcgcgctcaaattcagccgtcggcgtcgtggcttccgcgctgaagtgctgattgacagtgccgggctttgcgcgttttgtgatgatgttaattacccccccggtcgcaccgataccgttactggcgtttgcgccattgatgacctcaatacgctcaatcatggaagcatcaacagtatgcatctcgcgcccggtagggcgcagaggattagattgcggaataccgtcaatcattaccagcggcatgcggccgcgtaacgtttcgccgctgccggacattttctgccgtgcaggggagaatgacggcagcaggttacttagaatctgggacgtgtcagacgtgatttgtcgctgctgactaatctcattttcattaatcactctgatgacctgaggagagtcattgcgagaaccttcggtacgagttgcatcaactatcagctcatcatctgcattatcctgtgcataaagcgttgatgtagcgagcagcgttaatgcaatgcaccgggaagaaaccttcatacaaatgatcctctgctgtaaaaactgttcatgtaaaggttatttactgtcaccgcaccgcggcgtcgttaatgagaactaatatgataatggttatcaatatcatagtgtaagggtaaagttaagaaattatgcatttcacttctgaatgttaatggcacgctcgcttcgttaacttaattgccccttaagcaagactctatgcggggacagagcggaaaattcgcttagctgaatagttaccgtgcagcatttagctatcagtgacagcgtggggttacctcgacgccataacaatgtgggaggcatcagttctgaggcttttgaaaaggtctcgccgtgaggccagagaatgtctgcggaaatggcgggcactccgtattccgggcggatctttaagtagtgagtgtcaggcactctaaaatgtatgccagagagaagaactttgacgttatggttgagcgcatgatgcggtagctcaaaggtgatgaggatgcacagttaccaaagcaacagatagtcaactcgcgctcctttcggtagtgcgtcacccggcttgaggatatgcggcagacggtagtgctctgtgctgctcgtgaggcggaaaagctcagggagtagcattcacgctgccggtgtatcagcgtgttgatcgtcaccttgcgtcacgataatgagccgcagtattcaaacacggcctgccgcatctacgattatccgacgaaacgacacgcgtgacattatcgcgtcagcgcctggaggactgaccagaatctggcgggaaggctaccggtatgcaaaagctggcgtcatgccgtgcgatttcgataagccgggcgaggcctattatgacatgttcagcaatagtgataaccagtcagcccgcctttgcgtgctttatcatgtcctgtgagtatgctgagataaggtctgatgaccgttcagcctagaaaaatgaagtttatctggcgggtgatgcatccgtcgtcacgagatacgcagggcggaggtgaatgaatgctaagtcatcacgggaatatgaattcacgcctggcagtataacgctctgacagccgtgcagatcttctccagccaaaccggcctgagtctgccggggtcgcatctggcgcgaaaccctgaggatatgagcaatccgctagcctcacgtgaggtttgcgggcgcgtcagaaggccataaacatttcttcctgctatgtcactattattttctgactcctaagcctgctcttcatccggagtatcttccgctgctgagggaatggtgtctgctgaagactctgccagcttaatcgcgattatatgttacgtgtgctgaaatcgttattcagccagtaggaaaatgtagagactctgccgacaaatatcatgatgttgccgcgcgggtgatgactgatgctgagcaagtaatccatttttatccatgatttcatcaggttaactcggcatccgaaaaaacacctatgttagcagcatgtcaattcttccgttcagatgctacgcagtcagaccccgcacagatatcaggagcctaactcatgaaaaagtacaacacctgccgcagatattgattaaaagcaagagcaaatcatacactagcttaccgatttaacatcagcaggtatgctgtgaatgggtgaccgtaatttacaactcactataattacttagttttctgagtgaacatacccagcactaacgggggtaagcacggtgaagaatgagcccggaaaagccgggagctggcctcaggcaaaattatttttaatatgcaatttagcattaaaatccatttcaacgggaggtggccataccggcgtattttttaacaggcgcgcagcagaccagattaatcctcatcttccatcagcgaaaccatggcccctttatgcgcctcgaccatgcggatataccgcatcaccgtctgggtctgcgtccacgtgccttcctgcatgatctgcgcaatagatacgccttttctggccatatcctgcgcggcgccgacgcgcgcgctgtggccgctccagctggcgtaacgccctttattggtttccgcgcgggacgtctggccggtctgccgccttgcccggtaccaaatgtcttccaggctgggcgcactcatgggcgcggtcgggacgccgctcaccttatttgaccggtgaacggggcagaacagcacggcctcaggctcgtccgccagacccgccgcgcgaatccattctatcagccgttctgaagagcgcgcgctcagcgccttaactatgccgccagaatgcaggatggttttagtccagcccacgtcgagaataacgcggccgtcggccgcgcgcgtgacgtcccgcacccgcaaacgtgacaactcgctcatccgcagcagtgtgccgtatgccacgtggacgaaagccagatcccgcaggtgctgcaggcgggacgaatgctgccatagcgcatccagacggtcgaggtccggacggcagaagggcacggcctgtcccgtacgctcaccagacatgatggcggtacggttaattttttttctggcgcgcaccacgtcaggtgataccgtcggcgggaccagccccgcgttacggtgtaacattgaaataagcgcagcgtgcacagaaacggttgacgttgcccggccggtggcctgcaggtgaaagagatagtcctgcagatcctccggcgacatgggcaggaacgagcgccggtttgcctgcgcccagcgccagcagatccgcatgacgctcagcatttgtcgccacgtgttgtgcgaaaaggcctctcggtgacgaacaaaagccgccagcctatcggtcaggtcatcatccggtactgctccggggatgaggccggtaaaaacggaaagatcgttcatcctgttcagttttcctccatgtaccctctggcgacgatacgtgaattctgaagaaaccgcagggtggttacccgccagatttcacgtagcgctgcctgtttttcagccgctttcatacccggctacaacccgtataaactacacaaaggtcaggatccggcccggatccgcatgatacagggtttcagagcgcctgtctggccttatataaaggtaattatataaggttagcttcggggtccggtaaacattgaggtgttacgtaggtatgagaccgtcagagttcataaatcacctattatatgaagttgaatctatctatggttgtcaaacgacaactatagattttaagaaatttcttatataattgatgaattatattgatatttgctattttaagatgaataatgatccataaattcttcttataaaaaagagaaatttcgatgagagatcaaaagtttattagcgagctttttttagagaatagccaatttatacttgttgggttaacaggacggactggatcaggttgtacgaccacagcaaatattcttgaagaaaaaaaaccaaatttccctgaagttaataacctctcaggattttatagtggccttgatgtcaacaggtatgaaattgcaaaaaaattcacagagaaaaactgggatagtttttactcgattaaagttagcgatttaatctcagtttatttattgatgatgagtaatgctgaaattatagatttcataacatcttcatcggaagggaaagttaatgtttctgatgttagaaaattaatagatagcggtgtgttttctaaaaacttgatcaaaaagttttacatggatgtagtcaagcatctccttgatcataacaatcataataaattagaagataaaaacctgaggcgttttattagaatattgacaatagttagaaggttcacaaagaatttcaaaaaggaattaaattatgttgatagtagcttatatgtatcaacatatcaagccgcaggaaaatcgataagaaggctaggtaaagttgaagagggttacgaagtaaaagattttgttcccaagtcagtattccatcttcctgagacgatcaatcgagcaattaagttgataagggagttaagtcatgggaaagcatttattgtcattgacgctattagaaacccttatgaggctaaatttttcaaagacaggtatgcagcttttcatttaatatcaatcaatgctccagatgaacatcggacaaaatatcttcaaaaactacataaattctcacctgaacagattaaaagaattgaagatgaagaatctggaaaaggaaaaagtgaatataaacacttaactaatccaaacattaaaaaatgcatcgagatttcagacattcacattttcaaccctaagaacgaatacgataataataatatacttaaagcacaactcgcttggtactttgctttgatgaaacatccgggcttaatatctcctacctcaatggaaagggtaatgcaagttgcatataccgttaaattaaattctggctgtatatctaggcaggtgggagcagtagttacagatcaggataactcagttaaatcagtcggatggaatgatgttgctaaggggcaagtaccatgcgcaatgcgttcactcaatgggttaatgcatgactttgatccaatgaaatatagctcatatgaaaggaataatgaaaaattcagggaaaaagcaagacagaagttaattgatttcactcagatcggcaataatggtatcgctttatcaggaagaaacttatcttattgctttaaagatattcataatagtatcgaaaaacaaagtaatcaagttcacacaagagcattacatgctgaggaaaacgcttttctacaattagcaaaatatggtggccatggaattaccggaggtagactctataccacagcaagcccgtgtgagctttgtgcaaaaaaggcataccagcttgctatttcagaaatagtttttatagacccataccctggcattaccaaagatcatatattaagcataggtgaaaactcacctaaattggttcaattcagaggggcaataggaaagtcttatcatagactttatgaacaagtaatcccaatgaaggatgaactagaatatttgcaagaataaataacttcttaaaaacctcttcttttagatgattgcgtgaaatttaattttattgaaaataatatatcttatggagtaaaaatgtctttaaaatttataacccctaagcctcaagaacttttaaacatgtttaaccaagcaatcgatcagaccgaagcaaaaggtaaaataacaacttggattagaagtaaagataagatatattatactcataaagcggaggagtggaattctgaagcgtggttcaagccatccctacatgatggcgctttgattttcaatattataaaaccacaaaacaaaaatatatcttcaattgcttatgcttattaccatggacatttgactgaaacttttttaaatcattttgataattttttcagcgagtcaattagctcagcaatgcctacaagtaatgataatgtatcatgaattttaagcgttaactacgttatcactcaagatagtgaatgtaagatgccaatgctgtttaaagtgattattcaaatatcaaataaggcgcgtgattttatgccccaaacttaaactaagtattacatagctagtattatatggactttggccttaatcatagtatagccatggccgtaataagctaaacggccatggccgcatggactaagatattaccggtttcttctcaggtaaatgctcaagcgtcaaaagttcattattcgtcactctgcggcaatgtgtcactgcttcctgcagtttctcctcgtgtgctgtcgtcatagtctttatctaagacctgatatttaagactcttcctccatggctctattatactcaacggacaaataagtctgatattgcctaaagaatatagtttaactgcttgaagcaggtaaaatctgccatcttctgaacgtgcacctttccaatcttcttccctaaaatattctgatggatatgaattgacaggtacggccataatgtaaggacgtaagtccattattcccggtgttctcaggaacattgtcaggatcattgccgggaccatttgtacaaacaagcatattacaaaaagaatcccccccataataccacctgttatcgcaaacttgtagagcaaaccagttcgtcctcttagtcttagaaagacaacacccggtataagagaaaaaatgataagaaccatagatatggcaatgatggttagtgcctgcctgaactcacttgtaccatctggaaattccagagtgcgaagaaatagctcaacaggaaatatccagacgctggccgccagggaaaaaagcgcaggctgcagaacatgtgtaaaaagaaaaactccgattttctgcaaaaaacccatttgaatggttcgggttcgggtgagggaagcgtgatgatacactgaaattaaaatactgcagagccagaccaatcctaattgtattggtacctttggcgttaatatccggctagaaaaattcgatatgaaaaaccagccaaaaaaaatcagcgccgatagtatagatgtcaggaaaacattacgaatgtttttttctgttaaatcctttgatggttcgctgctcttactgtcactatatataaagagtcctgtcagtagtgagggtgtgaacagaaccacacagaaacagtaaaacgctgacagaggcaaataccatcaaatagccaaaaagtgaagaaaaactgacactatcaaagaaaagttccggtaggccaatacgcgccaggtgtgcccaaataaataacgttgctataaaagttgaaattagcgtaggcgttaatagcgacagaaaccatggacgtatttttatgagccatttctggcttttttcacttttcatgttattcttaccgtttaaaatatgttagctatgaataatgctgtttcgttttcaaccttacaattaacattaaaatatatagcatgctttgtgtgttatatgccaagattttcatcttaggtactatcaatagaagatgattgttaaaattatgaataataagcatacaattaatctttaaggttaatagtttcaccagtaattattttacactgtacctttaatattcactcgtttatttcaaagttgctgacgctatcttctaaagctctatatcccatcatgctcctttaaacaggctttatagcctttttccctgccttaatcccctcgttgtattttttgccctcctgctaaagtagcgcacaataaccattctattcacatactctagggatagcccataaattcctgcttttgttatccaagtatgattgcccggctgttctcagctgtattaatgatatcagcggctccaaccgcgtttgcactgtcgaatggctgtgcagccatcaacgtgttgtcaggatctatgtcactctcctttagtttcaataaatatcccgcgtcggattttatggcaggagatgttttgacactgagctttacggacagcggttctgcaaatggtggaagcccataaacgcggatagcgtaagtcttgtgcagttcaatctcagtaatgctcagacctataatgcggtaaccaactccactagcagctcatcatattctgtcattgtcacagcccctgtcggcggtctgtaaccaatggctttgccgcccgcgccaatacgaacatggacaaatcagtaatctggtttttaaatgtaccagtgcctcataatcttctgccgatgctacgcttgcaagcatcacactgtcttccgagcagcttgatatgcttatgacgcagccgccagcttatgtttcgttggaaaaatgggattttccgggaactggtatgacgatcctctctagacccgtaccgctaatctactcgatcatagctcccgactagatctgcctgaaagctgagaagcctatgctttcgcagtacaattgccagacataaagcgaggatgcaatgaaattacttcctgaaagcctaagattcgattggtcactacagcaggatgagttgccggccgacgccatgaatcgcgcgtctcatgcccgctttctgacctcactgctgctgtcaaaaagtgaaacgggttgctacgtactgaacctcaacgctagctggggcgcgggtaaatcatggtttctgcgccgctggcaggccgagataagcagtgtatatccgaccgtctacgtagacgcttggaaaaacgaccatctgcaggacccgctgctgaatgttgtggccgaaattcgtcgcagcctcattgcccgtactgataaagcggcgcttgattcccggctgcttaagggaaacgtggcgcctgtttaaagccgttgcgccagaagttactaaagcgctactcaaaagccgactcggcattgattcagatgccttggcaaaaattttgagtgacgatagctcagcagacgttggcgcaaagctggtcgaagcggcgctacaggcgcacgatgaggctggcaatagcgtagaggagtttagggaaggcatcgctggctggctgcgcgccgtcatcaataccgcatccccaccgctgagctatccactatttgttttcatcgacgagctggatcgctgccgcccaacgtatgctgttgagatgcttgagactattaagcatattttcagcattgaacacgtggtattcgtgatagccaccgataaagctcagctgcagcactctatcagggcgatatacggtagtggatttgactcgcggctatatctggatcgcttcttcaaccgttctgtgacgctcaatgaggtcagccggaaatcttttatcttagagcgctatcgccagctgacgccgttgcgacattattgcgccagcgagcccggtgccattcttcttgaagactcacccgagcgagagggcgcggtgattgaaatcctgaccggcattgcagatggattttccatgcaactgcgcacggttgatttatggctcgatcggctagccgcagcggttgcggccacggtaaaaaagccggacgtgcctttcatggcgtttctgatggcgattgagacacacgcacccgaaaagcttgaagaggttgcgcgcggacgtcccgtgtttgccacgcaaggggtaacgccacatgatgctctgtcgttcaaggccttcacgctgaagctacgatggaactatcagctgtgcgaagagcacatcgcaggcgatcacgaacgttttgccggacggctgcagcagatgtttggttcaaaaatcggtatggtgcactattttcaggcgctgatggccggactgatagattctgacaggggacagaacgattctgtggcgtttctcagaagcagttttagagaatatctcagcaatcaacatccgcgcgcctcagtttatcagggcgacaacgcggccaatgcatatcatcaggaggttacgcacattctcaggctgaggcatgcaaaaaatactctcacactcggggactactatgccctttgtcgcctggcaacccatctcgaataagcaacacgacaccagcatcaacgatggttaaagctagaggaaacgtgtctcctaatgatgtaagtactttatttaacataataagtataaagcgactcatgtatgccagtagctgacactactaacgaatttacattttcaaacattatctgttaccgttacgtctcatacagagcgccatgtttagtatattgcccccgcaaagtaaaaatcctccgtacatgatttattgcgcagagagtcgcattagaataccgaatacgatttctatggaggacaaactcccatgacactgacccaaaaatccggtcatttggcttggtgcgctttagcggctcttgcatttgcacgtcaggacggcactgtttgttctgctgctcaggaaaatctctttctcacacgctggctggccacagccctgaagcagcatcgcttttcccgggaggtggcccctgacattgagtggctgctggaacaggggcgtcagtatggagttagcgcaaagcttgccggtaagctcgactacctctggcgttccggtactggcgaattatctttgcagaatgacttgttccgactgacatatgccctggagacggcgaaagatatgggctggggttattggctgcttaacgaccaggagtggtcggaaaggtacgcttctgtccttaacgctgccgtaaacggaatttatatgtcccggccaagtctggatgctgcctttgacgataacgggcagcagctcacaccgataatggcgcgaatgaccggactcgtacaggggctggaaacacttcttaaccgctgcggatggcaaatggccctgagtggagcatcaggtttatataagctaactgcagaaaaaaccgattaaacagcaactaagtagaaattagcaaagctgatgatgtcttccactgacaataatgacagcctttaatgactacagtggatatatgttgtaaagaggaattgaatacggaacgtaaagcgacgcgaaaaagattaaggtgcttcgaaaccttttactgcgcgttaagagggaactatcactaaggggttatggcagtatcgttaccgataacatacttcctgaacccgctaacatgattgaaggtacacaatagcatgcgtgtgaccgcaaggcggggcagtgagacaacaggaaggctgagccagttggctcagcagtacgtccagaaagactatcgaattactcagtggcgaatttgtgccagatcatcttccgtcaggccggtcattttaatgacggtgctccgatcgatgccgttatgaagcatggtacgagcaacttcaagtttgccttcgtttcggcctttttcaatgccgcgctgttcacccagctgtataccttgctcaataccttgctcgatgcccttctcaatgcccttttgctctaactgctgtgcgatggtcatgagtgcgtctccgtgttgcggcacacgctgtgccagttcgcgtacaaatgcttcggcgtccgatgtttcgcctgcctgtacaatatagtgtaccagcgatatcacctgtgatgaagacagatatcctgccagcagaataggggcaagcctgtcgaccagttcagccaggtcccgctgatgaatatgcttttgcagcagagtcagggcagccatactgcgatggtccgcgatttcatcatccggaataactgtgacatccaccaggggaaacgaggtgccataaaggtgttccgccagtacaggatcatcgaactcatcaagccatcgcgttgagtgaggataagggctgcgcctgccggtatagaacagcaccggtatcaccagtggcagctgtttatggcccgcctcaaggtgacgctgcatggcggcaacagcataccgcataagcctgaatgccatatgtctgtcaggagtggactgatgttcgatcaggacatgtatgtatccatcgcctgcagtggtcttcaggctgtagagcacatcgctgaaatattgccggaggtcgtcttcaacaaatgaaccagattccagtttcagcgtactaaggtcacagatagcacgcagctttgtgggcaggtgaagttccatgaaatcacgggcgacatccggctgtgtaaggaactgccggaacgtggcatcgtgaggagttggtgtgctgtttttcttcttcatcgataccggctctgaaaaataatgaccgcatgttatcacaggcagaaaaccgtctgtatccaaagaggatagagccgctactcatgcagggagtcatcatgataatttttatcgattaaaaacagacaactccacagcacgaccgctaatatccgaggcataatcatccataatcgtaagtcgtaaaaccagaggagtgatggaatattaaagcagcatttgaaacctggaaagttgttatggctatcgtcaacttaatttaacataaattacattgtgcgatctttaaattatgcataaaaataagggcagaattccgaagtgcttgatacacccccagacccgtccagttttcgatcttcccctataccttcatagagttacgcggcagtcgccacccggatcagaggcaggcgtcccgttgtttattccggactgagcaggttattctttatatccgggagaaaagctggaaaacagatccggaccgatttgttcccgtggttttcgctggacatacaggggaaaatacgttccacaccggcagacaacggagaatgaaagttttggtactttgccccgcaaactgacacagatttcacacagcgacgccagtggtcataatctgaccactccgggcgccgcacgctattttgactaccagagcgcgctggcgctgcgaaacctggcagccgcctacggcacctacatgccgcgctacctgctggcgcccgaggtgaccgtcctgctgtccaggatgctcgatctccgcaagcgcctgttcatcaatgcgctgtggaacaccgcaggccggctcgatgaaatactgccgcttacgcgggaggacttttcgctggacgatccgctgaccggcgcaccgctgtcttccctgtttcgtggtgctgcgcacgctcaagcagcgaaagcttgagcgtgcgcagccgccgacgcggccgaccaacgaaggaagagcagcaggcggagcgggaaaccgaggcggagatacggaaaacccgccgcgcgcgatgccgctcaccgatccgggattcgtacagcgtttgagggagtggtttacgacggcatgcctgcctgcgggtgcgcggctctgggacatcaagagtgaggacacggcgcgcagcaggataagccaggcggtggcggcgcgtgacggtgtgacgttttccatccggccggtgacgccgaaaacgttccgggactcgttcgcgatgcacctcgtgcagcacctggtgccgcagaaggtgatccagacgcttataagccataaggacgccaaatccaccgagtggtatacaagagtgtttgcgctggacgtcacccgccagctcggcgtgcagttctccatggatgtacatgaggcgagccggctgctgctgccccgctgatcttctcctctataacgcttactgtctaaattgacggtgaagactttccggtaaaaaccagatgcgcccccgggcgcgcgaacaggccacgtagagtttgagacaggcctgtttttaccgagcaggatggcacttcgaagctccaggcgcgatgagatatgactgctgtgcgtggccacaaacagttgcatctgccgtttcctgcgccagcttactcacaagtttcttcaattttacatggctgaggtgtttttccggctcttcaagcagcagcacatccagctctttatgctgttcacgccggcgcaatgcaaattcggtttttatgaagcactgtctgcctttgccgcgatcacggatggggataccgtcttctataatatcaagactggcttcaaggccggcacgcatgcctgaccggataccaaactgacaggtttcgatctcttcaataatggccgagagatgcagctcttggaaacggtctttctgctgacgccaggagttttccagccggtaccgtctgagacagcgacatttaacgttgtagagggtgcgtgtgtactcctgtgcagcgtgatcggtgtcaatgcgcgcactgtcgagcatcagatgattgacatgacgactaaagacggcttaagggccacgtgaaaaattttaccgcataatattcaaacgggaagctggctggatcctcttccagtacatgactgatgtcctgaccatactcttcaagcatcgagggcaatatgcattctcagaccgtcagcatctctttccatctgattttgtcgcccgttcagatcgggattgcctgtgtaactgagaaaaacattagcgatgagttccggcagtgaatctgcgcggctctgccccgcccgaaacgccataactgcctggcgggaaatcagggattcaactcccagcatttccacccggcgctggctgccgcttagaacaggatccagtgcgagaagaacagaattcttgccgcattcattatctccgctcagaacatttgttgcgggctggaaattcagtctcagggaatcgaattttctgaagttcttcagcataagatgagtaatggtcggcatctttttctcctgatttgtcgtaccgcaatttatttcagcaaccgggaaaagctatcccggtcctgacatacccctgcctcattaacagtaccgcggaggatacaggaaacgtgagtaatcaatatgcctgctgtatgtgaagggttcaaaacatgacgtaactcctgaaggaaggcagggattagaattttatgacgtacagcaggttctgtttcaggtgaagcggagtaaatgaataaacttccaggatggggataaagttgaatcagctcgggtgggccagacacaccatcttttctgttcaggctcgcagagaattgtttttttagaaaaatgagttttatacgataggtctcattctttcatcatgcttaatgttggtcagctttgatatcactgttgctttgaccagaaccggccctgtcagctgctgacaattaaaagaaatattatttcgggaatttcagactgaaattttcatctttttattttaaaaaacataaagttaattgattttttttgcgggaacccccttctgaatttcccgcaactggcagtaagttatgcgtctttttcattcacaaccatacgctcaatgacgcttctaacagcggcatcaagttcagcctgacaggctgcagaaaggcgcgagaattcataggtaaccacccgtttatctgaatccgttttctttctggcaaactgttttttatcagcaaattcagccagttttacagtcacgactttcttgctggccgatccttttttgggctctgcgctttcagcgcgaaaataactgattatctttgccttataggtaggatcacccctgtcgtgatgcgcgtcactttcgatacgtgcacggacgtggccagttaacgcctcggtgctgatgcctctcgtccgagctctctcagtcacctcaagcagaatctgatagtcactgatggagaattcactgaccgaaggaaaaactgcaataatctcttctggaactgcagccgcctgaaacgcccgggtgaccttagccgcagaaagtccttctgcggcggcaatatctgactgattcatctctgctggatacatcagctttaatcgtttaccgagttcacgcagtgtatgttctctggcagtctgaatatcagcggccagctgtctggcatcagaaagagacaacgcatcacgcgtcaccagcacttcaaaggcggtcccgttgtaaaggcaggccgcccgacggcgtgaaccatcgagaatctctgtacgtccgtctacctcccggccaatagcgggaaagaaactgctgcagtctgatggtacgggaaatatcactgaccgattcgcgcgtcagaaaggcctggtcacgaccattaacggttgcgtctacaaaagtctgtgcttcaatatcatcatgcagaaactttgtcagaacaaaatgggcctgagcaccagacttcagggtaaacacccgctcgctgtctgactcactcatcattttcgaaaaacttgagttacccagctgtcggcccagcttcaccatttctttcttcatttcacacccctgatgaactcgatccttttaaatacagcctgagtaaagcgttctgcttcccgttttgcctttttgagcgcctcaacactgcccggataagaaccgggatcggcgctgatgatagtatcaaagctctctccacaacgttcaaagccatccagccgtggcagtgccgcatcaagaatgtaagacgtaaagacgtcgcgagccagaccatgtgtcatctcatggtcacgttttgaggtcattttcgacataaagccgatattcccttttatacgcggtgtgattccctcttcttcaagctgttcaatcatttcaggcagtcgggtgagatatttcagagttgagtgaaaatccacctgtgccggcggcgtgggtgtgagcagtaaatcgcttgccgcgagagcattcagcatgaaggcatcaaggtgaggaccggtatcaataaagataaaatcataatccccgccaacacggtcaatgatagtgcggcgcagaaacctctgagggtaacttgtccggcagatgttctctgacgagatcattccactgactagcaatgaaaccatcgtctatggaagcagggatcacatccacaccaggaatgattgtgggtttgataatgtcttcacggagctgctcagcgtcaagatcgttaagcattgcctgtgcagccgtctccattatggagccaatgctgttttgctggctgagaaacatggtgctggaggcctggggatcaagatcaaccacaagcacacgaagatcatgctgtagaaggtcctgatgaacacgtaaaccatgtgcaagagtcaccgtgctcacggttttcgaaacgccgcccttcagattcacaacaaagacgacaaaggggccttccccggcgtgtaaatcacggtatttaggcactttgcggtgagcgtaaatatcaacaacgtctttaatggtcagcgcatagtgtcgggtattaccggcatcttttctgccgaagacatgcccctgtgtttccatttcatcgatcgcctgctcaactgcacgccggctgagtttaggaaggttcgccacagagttacgtgtgaatgtctgatagtactgatccaaaccaaactcatttcttctgagagatatatcgtcgctcatactgcgcaacattgcgctggccctacgcgcggtctcgtccacgccaccataatgacttttcatttaaccgttccattgtcaatttttatgttgattgtacatgtcagaagcgccagagcaacatttttcgaaaagacatgattttattgtacatgagcaaaaaatatagctcacagtataactgtcttttctggcaaaagtgatgtcctgatagtgaattaatcacagtctcagcattagtaaaacacttaaattcagataaattttaccccacaccttataacgtttatccatctgtttttattgaattttattggtttatttcaggctgaaattccctttatctcagcgataataagcaatgtctttcagttactcttcaggtgatgcctgtacagttttagaagttttaaaggtcattcatacgtgcttcaataaatttggcggaggcacaattttaattaaaactgagtacggtcattttgctaagagaatgaaaaatttcatttactcaacatttaagacaataaaatgtctgccataggagacttacagcccagagcatctacaattaagcaatagatcgtgtgtgctggcgggatgtcattatcccaaaggaaaatgtgtgctggcaggtattaaaaagaacaggacttaaacatgtgtgctggcggttctacttatgggcagtccctctaaaagacatctaaaacgagctatatgcggcaactgactaataaggtggacgcacatttactgtgcagaagccaagagatttaagctggcaggctattttcttctttttggatgcagaaatgtgtgctggagggatacgagctcaagtaaaactaaaaatgtgttctggccggttaagcccgtccgaaagtcacgatcatgtgtgctggcgggaaactgagcctggaggacacaaaaaaagatatactggcaagatatccttttctgaatgtttcataattatgtgtgctggagggatattcatatgcggcggagtgaatcagttgcgcttaaaatactcgatagtgtgtgctgacgggctgctattcagagtaaaagccctcaatatgtgtgctggcgggaggttcatatgttccggaagggatcagttgcgcttaaaatacatcgataatgtgtgctgacgggcttctattcagaggaaaagtcctcgatatgtgtgctggcagactcctgcaacaatgcattgcctgaacatgtgcgctggcaggataacatatatagttattatgaagtgaaaggctgtgcagtgatccaaatagcacacattcatatgtcagctggtttgagttttggattacgcttatgaataataacgaaattttctcgcgctttacgaacgagtgaaaattccagataaccgatcttttgtaactgctcaagggcttttttaatcgtgcggttttgttcactcacagaaactgctgagagagagacgctcgcgtaaacgtgaaaagctaaccggaataggattagctggaaggctttcaataaaagtgtatatagcctgagccgcttctttcttgggtagtgctttgatggcatgttgctgaagaaggactctataatccagctgaaacagttcccagagtttttcatccgcttcaagctggacgatatccttttcagcatcaaagtagcctgttttcaaaagccctgtctgataacttcccttagcatcacgtccgcgtttgaaagatattgatttattgcgtaatttccccaaagactcatggatcgaaagccgcagcctgccgtcgatacgtttagcagagaagccacaccctttagcaaactcggtgaatttcagttcaattttattcgatgtcagtccgtatcggctgaaagcatagataactcctatccacactttaaagtcgctatccatatcgagtcgaggacctgaaatattgatgtgatcgtaaccttcagcccgggcaatctccagctgtgaaaacaattcagaagcatcaacaacattgttttcgcccggtgatttcgtaggcttaggcacgaaaacaccaaggcgcatcagtgccactggctgaacagtattattagaattaactgtgagctgtttatctttactgaccatgtcactataaagtgcatcgccgatgaatgacttatctgtcatatagttatctcaattctgagtcacaggatcttcctgttaataaaagtggcttctatcccaacagcacacacattacatcccaacagcacacattactagcccaccagcacacacgaacttcccgtcaggacacatgtttatcccgccaccacacatcataaaagcccttcagaccacatgtggtgcggcctcagaggtagcgggatctgttaggagctataaggatctaaattggtaagttattggatcgaacctgtgtaaatgtggataaatgatcttattactaacgcgcctgcggcttgttcaactggcggcgcgcgcacaaagaatttgtgcgcgcgccgccagttaccagtaaaatcttactgctacattacacaggctctcattcggctaatttccacatgtgtgccggaacgcgatcgaacaacttttccaccgtcaattcagccttacgatgatcgtatgctgaagtaattgcgaactcttctttcgagtcacctttatatttcaggtgttcatataaagtcttcagcgtatctatcgatacgataacgtctgaatcgcattaaccattttttttgtcattttccttattctgcatatgcaagcgctgacatgcagttgagctttctctggactacaccgctcggatattcattatcaaccttatctgctcaagagccgattctaccgacgcgtccctgtacgaatttacccgtgtgcttttagcaaaagcgcttgagaagctatcattacggggcgtactcgtaagagttgtgatagatgaaaagaaaacttacagccgctggtcactgattaatgaactgtccggtttcgggtgttccggtcagaaaggatacacagtaaagtattgtgcataacgaatttattatgacaggaaaaaacggcgtgcaagtgggatcgtctaattacacatcatcggctgaaaatgccctggttatccgaggcaattcattcctgagtcagcaatatcagaatgaatttaaccacctttgggccgagtcatcgcccgtacagtgcaactattcatgatctacagactaaatataatctgctgagcggactgtatatgacaacgaaaaaagtttatccggttcacttcactggtcagcggggccagcaggaggcttctgacactttccagcagaatgaaactaccacctggcagcgctggttcaaacactcccgggataataaaaaaaacacagtagtgaccttcaggtgtcggccggcagaaaacgatcctgtcaggagacggctgaaggttcattactcccgggataccgaacgctgctggctgtcttcatacgccttcacgggtaatgagcataaacctgactgccggttttattctgtgtggtctgatgaaggtcaggcagagatttatcagggggaagcggtccgtgctgctgcggatggcaccattgtggtcagactgcccacgggcctccagaaaaaggcaccttctgatgtaaaaccggctgaaaacgtctcagacgacgaacctgtgaaacgcaaacggcggccatcgatgagcttcctggggcttctgcacctgctgtgggagcagtctggtattaatgtctggcaccccgctttcgataaaaagaaacgctcccctagctgggtgagctggcgcctgcagcagacggctgcccggattcgtataggtctcatgctgctggaagaatctctgttgctgatggccatgaaagatacgccacaggttattgctaaccggtaacacctgagagcggccgaaaagaaaaaaaggcgactcattgtggttttccatgtcggcaagctggagtgaggccggtgaagcacggttccaggcaatgctgccgctggggctattttctggctttcccgatctggttatgcctgaaaacgttcgtcaccgccttgagcgaagctttagccgcgagctcggcgactggcgcagaggaatgaaattcgtggttattgctgaaacggagccgcctgagacatcgttcagaaatgtagacgggcgtaaccgcccgtaaagacataatttggagaggtgaacttcagcgcgctgtagaggagccgttcggtcagcgcgttgaccgaggtgtcctctacctgggtggagggtttttacactgcctgaacccatagctttaggtcgaagctggcagctatggatcaatgcctagatggtattagcactcgcgctcgcgagacactggatatatacagtttaactgtatatatttaggtttctatgcatccaggcgtaaggggtcattatgtcggcagtgaacaaagctatcgtccgccgtttcaatcatcaggttattgagaactgcaaccggcgcgaatttgaaatgctcgttgcgcaagatttcatcaatcattcggcagcggccggtcagaataaagggagggaaggtctatggcatacctttcacaatgttctgcatccggggttgtccagtctccaagtcgaggtgctggatcaggttgcggaagacgacaaagtgacgacccgaaagcggattaccggctgccactccggggcatttctcggtatatcggcaacggggcgtgcagtgtccattgatgtcatcgacatcgtccgcatccgtaatggccagtatgtcgagcactgggggattaattcgttgcccagtttgctggcggctttgcgctcaaactgattgaccgtttgaggtggttgcaatcagttgctccagaattctgaccgcagtttcaagcgtttgcagctgggatgctgtaattttttccttgagctggcgagccaaccagtcactgcgctgatgacggctgtgttcaagcgcggctcgaccttggtgggtcagctcaaagagctgctttcgggcatcgctcggatcaagacctcgtgtcaccagttgctgctgctccaattgagcgataaccagccgcatgctttgatgcttaacgtgacgacgcgcagcaatcgcgcttatgctcgcagggccatgacggtcaagcagatctaaagtttcagactgtgctgaagacggcgtatgcgattcactgcgcacttcccggacaagattgccgaccactcttcgcagatcttcggccaactgttcagttgcctcctcagatgagacagagtaacgaccgggagattctgaaggggaggacaatgggctttctcttagttttcgcatggggcaagcatatcgcttgtggccggtcgaatcaaagctgatgaccatgggggcagatgttgcatattactaaccgtcgacatcactcagatcgttgttcgaaaggacgactacgggtgatgtgtcgctgtcagtcaggcacttttataaaccattggacgtggattttttgccgtaactgattgcctgatgatttgaaatgtctgtatcccggtacatcctgagagtttatccggaacgcccgctcctggatacgggttcaggaacaggccgattaaccctgccctgtctctgaataagcatgaaactgttttaaaccgaaagtaccattacggcctgttctgggttaagtttttaaggaccgtataaaagtataaaacaggatattctttgccagtaaatacagctgtcgggaattgtgctcaaaaaatcaggcagatagccggaatttatcagtgcggcggaaacctgaaggatgcaaagtgcagtgtcgacctcgccctcagtgagctggggtacctgaaccggaaacagcctgagttgcaaatcataagctggggacagctgcgtttatcgctggagtcacaccttaactgctgcagtgatatccgctggttaacagtcatcaaatacgccagagcaaaagcaggttcacgccgggctggcgcagttcacaacctgaaaaaaacagttagcccgttacaaccttaagcgtcagatgagaccgcataacgcagcgatgttccgggatacacaccgttcaggcgacaggtgcccatcagcgaacagaggattgccgcatgttctccaccttcatcttaacaggcgaacagccggtttttccggcgcgacgggcaaagcgtcgtttaatcgcaggctgagtgtggtagttaccccgggccttctggtgtaaggcgtattttgtacatgttaatctccctgttcgcgaaagcatccatggcagaaagcacgggcagaaacggaaggcggtgtgaacgtgacgcttacacaacagcagggattttagtgaatcaggatgccggctgcgggccagtaaacactgcagagttgtgcagttgtaagtattttcctgcgctgccagcgcatgtggtttactcaatggcagtatgcctgaactataatcaccgataatgcccggtttataacgagtgttttttcaccggtgtaacaactaataacaatcatgctcagggaaatatgatggatgacgcagatctggcacatgaagttcaggaggcgctgattgcttccgccctgtcagcccgcaaacccggactgaagagtccggacggcaggtgtatctggtgcagggatgaagcggccgtggcgggtacggctttctgttctgctgagtgcggagaagactacgtcagaaacgagcatcagatgaaacaacgttacgtcccgtctaaatatccgtcagataatcccggtaataaatgattcagggccgtgctatcctgtcggccttttcgtaacttcatgcccctttttcagcctgcccgatacctttaccgtcagcagatactcccctggtgcgttctgaaccttcggggaccacagcgatatgtacgccctcacccgaattatgggcgggaagatgcctgcagcacgtcgattttatcctgccggaccgctattgggcctgatgatgaggctgcctacgcactcagcgcaacaggttaatacgctggtgtcaggtcttctgctcagaacccgccaccggggaagccttaaggcgtccggctcctttcctttaaccggaatccatcttgcctggcggggaggacgcatgtaatgtcctgaccgctggagggtgaggacattgcataagcttccggtgaattcagctaggttctgatgttatccacaaaaatggtggataatttatgtacaactccctgcgggccgcatcaggcctgacatcgcgcatttgccggacagcaggtaaggcccccggccggatgtggccgcggacaataagtcccttttccctccactgagtatacagcgacaggcggtgtgtcagaacgcttacggcccttttccatcctgcgctgcagctcgcatttcggctgcaggtcagtcaggaagcagacagagatattctgacccgcgctctgacgtacccatcacctcaaatccgcgttgtttgcgcattctgttcaccctggatggtgccgaatagcacctggctgttaactttttcagaaaatgtacgtcaggacggcactcctctgaagataacagaaggtcgggcggccatttatttcctgatgactgcgcacattccaaggctgccgggagtattttcagagcgtgtccgtaggcagagccgacatgggggggtaacatcagctttttaaccggagcggaagcaatgaaaaacgtggtactgagcatgctggctaaaatttcacacattgatgccggcatgaaacagctgacagcgcgcgttgaggcacagtcgctgctgatcagcgcacttgttctggcagtgagccgggaggggggcgtaacggagatgattgaaagcgctaacaaggcgatcaataccgttattgattctgctgagtccgacgaaactgcttaaatccgatgccgccatcctgttgagcgagctgcaggccctgctgagtatttccacggcggtcgacagtgcggatgatgaaatcagtcatgaagcccttgataagctgaccggcgtgacctccctggacgggcaataacgctcaggaaggcaactgccagcctttacgcccgctgccagacccggactgaagaccatctgttaatgtctgacgggcgcggccgtacgggcatacccctcgcttttttgcctgccgctgcgcctctgtgcgtgccggactgcgcgcaggggcaggctgtacacgaacgtcgcgaagccgcgccataaacataaaaaaaacccgccatcttgacgggcgaaccagtaaaaaggttcagaataactcgtcgtgcccggggtttcagaaacaggcacaggataattctgatacaaaaagggggatacgcaagcgaaccggccggattgacagagccgatcatgcagcaagctcgccggaccggctgcaggacctcaccggacagcgcgatgtaaggcaaaaaaaactccagcggcgagggaattcgctgagagctcaaaagattatagagaacacgagttaagctctacttcggaccgctttgcgaggctgctgctttgtgagccaggagctacataagagcgtcgcggtagaaagccaggtcgtactgtatcggggcccatttccagcagataacggacttttttcatagtagcccaatcgaccatagccttccagagcggcgaacgcgcagccttgggctgcgcgttcgagggggcggtaacgtgtccgtgcattgccagctcggcttcggcgacgcggccttacttccgcctcccttcctgaatccccggtcgccggcgatgaacgcctaagactcaacttccaagtgcaacatctccatgccagggcgttgccatgtccagaacctaccgccacctgagtccagaagagcgcgccgtgatcatgatcgagagcctgacctacgaccgcggcagcaaaatggccagctacgatgaactgagccggcggctgaagatggacatctggttatgcgatccgcatgcggcgtgtcagcgcggaagcaacgagaacaccaatggactgctgcgtcagttcctgcccaagggcagcgacctgtcgatcgccagccagacgctgctcaacgacatcgttcgcctgctcaatggccggccacgggaaacgctggggtggaaaacacccgaagaagcccaagcggaaaatatggcgaaattctcatccggtgcagcgcttgcaagttgagaccaagctgccaccgccaaaggatcgtgccaaaccggctcagccagaatgccatctcccacttcattgctctgggcaaagccaacgtcgtacatatcttggtgcagccctttgatctgtttcgccagcgacacctcgaatagacgaatatcgacttcgggtccgtcctgactgccctgtgccaacaacgtgggcaaacgtgctggcatcatcccatcggacaaggcaatgcgcaactgtgcatgaaacccattagctggcgctgtaacactgccacgggcctgatccaaggctgcaaatacgcgcggcacgtgctccagaaatggcttgcccgcacggcttattcgagtgctgcgtgtggtgcgcgcgagaagcaccactcccagctcttcttccaattcttttatggcacgcgacaggggcgaccgtagaatatgcaggcgttttaccgcacgagcgaaatgcagttcttcagctgcagccaggaaacatcgcaggtggcgcaattccatgatgctgtcctttcatatgcgcgtgtgcatgggttgtgctgtatgcaggctggcgcctcctactgctttgtgcagtgccaccacggccaaggcgtattgctcgatcacttccgcgcctgccagttgcgcaccacgcaaggcgatggctgcatccagtttgtcggaaagcgaggtcatgccacgccggttcaacatctccgcgtgggaatcagcacgttgcgcggcttgcaggcgaacggacgcctcgctcatccggctgcgttgcgtctcgacggcgttgagtgcgttttcggtttcttcgatgccttccagtacggcctgccgatagcctccaatggtcgccgccaatatggcttcacgggcattcactacggcgcggcgcgcaccccagtccaacaatgggatctgaatcgaaagcccagcgagcgcctgcgaggttcggcccggcagcacagttccgaccaggttacccgtggcctgcaaggcaccggtcaagctcaggcgcgggtagaggtcggctactgcaacacccagatccgccgcggcctgcgtcacggcgtgttcagcgcgccgaatgtctggccgtacccgcaacaggtcggcaggcaacattggcatcgccgtcaacccggcctgcggttgaggcgcggccagcaaaagtgcgtcatcgacgaccggctgcccggtcagcactgcgattcgttgcgcggcctggccaatcagcaagccctgtagatgcaactgcgcagcagtatcggctgcgatcgtcaggctgcgatccacgtccaggtcgcttcctattcctgcatcacgccgctcacgcgccagtgcgaccagacgattttggtcgtccgcattcgctgccagcagcgcctggcgttgctgcgcggctcgcagttcgacatagctgcgcactacctcggcgaccaccgatacacgggccatctctgcttccgcttcggcaccttctgctgccgcccgtgccgccgtgactccggcagaggcccgtccaaacaggtcaatttcccacgccgcatcgaacccagccttccaatctccgccgctgcgtccttcctcgcgcagcagcaggccgtctggagatagctcactacgctgaaagtcgatgttgcccgggccggagagccgttgctgccactgtccgctggcactggctgcgatctgcgggcgttgctgagcgagcgcaggtcgaaccaaggcgcgcgctgagcgcaaacgatgaccggcctgtgctaagttcagattcgacaccagtgtctgcgtcactagcgcatcgagcaccggatcgttgaaggcactccaccacgtggccgggtccgcgcctggggcggtggtcagcacaccgcgatggcgccagtcagccgccacgggctgcgcagcatcaggtaacggccccagggtgacgcagccgctcaatagcgcaacggccgtgaataaatatatgtgtcgaaacacgccgcgcaacgagaaagggggtggatagtacatggaggagtccttggttacgaaagtggttgacacgttccggattgaccgaaataatagatcgactacttagtctagtaaaggtgaagtgatgatcagaaggttctcgcagtgatgcgtgattccgcccgaatggcgactcccggtgcgccgcagccagcccatgctgttcagacggcagtcaatcttctggggggttggcacgataaccgacaatattgccgtgatggcgaggctgctggtctcgcgggccagtaccgacatgctgacctgactggtcgttgtgctggtctattcccgcctgctgtggcaggcactgctcgacgcgcagtacctgaagctgttcaagaacgcggtagaagaaagtgctgaactattaggctatgtgttgatcctcgccgctagcatggcctatgtcggcggtcaactggtcggtcagcgacaggagaaatcagcactggcccctaacaccaaggagtgatgcaatgcgaaagatcgaccccgaaaaacaggaggccaagcgccgccagatcctcgatgccgccgtgacctgctttgcccgcaagggtttccatggcacctcgaccaacgagatttgcgctgcagccgggatgagcccgggcaacctgttccactactacccgaacaagccggccttgatcgccgccattgccgaggaagatcgcaacgaaatgaatgcgcgcttcgctcgcctgattgatgaggatgatgcgatcaccgccatcgaaaccttggcgattgagttgctggaacagtcggccgatccagtctatgcccgcatcagcgtcgagattgccgccgagacgatgagtaattcggagaccggcagcctgtttgccgagaacgaagcacagatcaaggccaacttggcggcgctgttgcagcgcggtatcgccaagggccaaatcgacccgacaattcagccggcgcttgcagccacctggctgattgccttggccgatggcgctgtcggccgtgcgttgatggacccggacttcaaggccagcacgcatacccctgtactgctgcgcatggtgcgccgtttcctggagccgcctgccggttaagcgactcaatgcgcctttaggcgctttccctcgactgcccaattcttcctccggcacccgactgacaggcggccgtaggacccgctttgtctgtcaaaaccgaaggaaacattcatgaagacgtttttcccttcctctccacgccccgtacgcacccgcaaactgctggcgaccgcgctggtaacggggggctgcatggcaaccgtggccgctcacgcgcaggatgtcccctccccgcccagcctgttcggcgaaaaaaccgaggtcatcgtcggcctgggtgcaggcgtgataccgcgctacctgggagccaaggactccaaggtgctgccggtgccgacggtggcgatgtatcgcggcattttctttgccgacagcgtgcgcggcttgggtgccgaatacatgaccgaatccggcttttacgtcagttcggcgctgagctatgacttcggccgcaccgagaaggacagcgactggcgacccggctcgaagaaactcgcgggtatgggtgagatcaagagcagcacagtcatcaacgtgctggcggcgcaacagctcacgtcctggctggccgtcaatgccgaagccaacttccgcgtggcgggacagcgcgatcgtggcaataactaccgccttggcctggaaagcaccgtcttcgacgatgcccaggacaccatcaccgtgggcatgaacgtgcatgcggccgaccgtgactacacacagacgtacttcggtgtgacccaggcacaaagccagcgcagccgcttctcacacttcacgccaaagtcgggcatctacgcctactcgctgacggccgactggagccacgactttaacaagtactggacgctgtttgcggccgtcaacgtcatgcagttttccgagcgtgccaaggacagtccagtggtcgaagaaaaggccggcgtcaccggcaccgtgatgctgaactacagcttctgatcacgggctcaacgaaccatacgccatgagcctgcttcccaagcgccatcgtgcgcccatgctgggcgtgatcgccgccagcggcatttcgctgttcggcaacagcgtggcagcggtcgcgctgccttggctggtactggacatgaccggcagcgcagcctggacgggcgtggctgctgctgccggtatgctgccgctgatcctcggatcgtttttgggcggtgcgctgatcgaccgcttcggtgcgcgcccggtggcggtcattgccgatctggccagcgctggcagcatggcgctgatcgtctggttggcagatcaccaatggattgggctggcgatcctgctggccttgattgcgcttggggcattgtttgatggcccgggaatgaccgcgcaggagtcgcgctatcccgaactggcgcgactggcccgcatgccactggagcgcgccacagcactgaacaagctggttggcagcctggccaacatcgtggcaccggcagcggcgggcctgggtattgcactgttcggtccggaacgcacgctgctgctgacggccggatgctcgctgttggcagcggtgttggacagactgtctctgccgggccgtcgcctgcgctgtcgcagccaggacgccagccgatccgtcgacgtgctggctggcgcgcgctttctgatgggtgaccccttgttgcgcagcctgctgctgcttggttctgccgtagtcggtctgttgggcgcgctggatgcggtcgtgatgccggtgcgcatccgcgaggccgggctggtggccagttcgctgggctggtttctggccgcagccggtagcggtgcgattgtcggcgcacttgcgtttggccgcctcggtccgcgactgtggctgcgccgcatcgtgctgacctgcctctcgctggaggtcatggcgttctgcctgctcaccttgaccaatgacgaaggcctgcggttgctggccggaattctggctggcttgggctccggcccactcaaccccttgctgaccaccgttctgctgcggcgtgcgccaatcgccatccgcagccgggtactcggtgcttcgaccgccgccgcgctggtagccacgcctttggcagtgctactggccggtggtgccatcgacctgaccggcagtcgtccggtgctcacggcgatggcccttgtcgccattgtcctgcttgccgcagccgcatggctacccggactgcgcgggctggacaacctgacccacgtatccgcttccgactttcccttatccagatcacgagataacgccgatgacacgccgaaccgctgaatgctctcccccacatggtcgcccatggtcattgaggcttgctgtcttggcgatacttgtcctcgttatctggtgggtatggccaggcaccacggatgcacctgacagcgaaccaccgttgcttgtgagcactgcggtggcagctccgaccaaggtgacgcccacgctgcgcctgagcggcacgctggtggcacgggatgacatcgccatcggcaccgcgttgcaggacctccgcatagccgaggtgcatgtggatgtgggcgaacaggtgcgccggggtcaactgctggcgcggctggaaaccatccatgtgctgacgcagttgcaacaggcggaggctgcactgtcgcgggcgcgagcagcgttgcgcgagcaacaggcacatgaagccgaagcccgcaccacgttggcgcgcatcgaaccactggcgcgctcgggcgcggtcagtgcgcaacaggtcgatgagcaacgtgcgcgggccacctccgccgctgccaatgtgcaagcggcgcgtgccgatgtgcagcagacccaagcgcaggtcgccgaccagctcagccaacgcggcaaagccgacatcctcgcccctgtcgatggcttggtgtcatcgcgcaacgcacgtgtcggcgcattggcgggttccgatcccctgttccgcctgatcggcgatggagtgatcgaactcgatgccgacgccacggcaaccgatctttcctggcttgccatcggcatgaacgttaaggtgcatgtgggcgatgcggaggatgacctcaatggcacggtacgactgatcaccccggaactcaatccgcgcacgcgcttggggcgcatccgtgttgctctcgatcagtcggacagcaggacgcaacgactgcatgccggtagccatgccaaagcccacttcagcttgcctgtgcaattcttccctgtggcggttccagcacgggccgtcacaatcacagccgagcaccaatccagcgtgatgcaggtcgatgagcacggccgtgtcgtgcggcgtttgattacactaggccgccgccatggcgacctgctggaagtcgttgcagggctggcgccgggcgagcacgtggtgcgtgaagccatcgcttttgtgcgcgaaggcgacgtggtgcgaatggccaacggcgctgataaaggatacacgccatgagcttccagttgtcctcttgggcgattcgccgtccgatcccgaccatcgtcttgttcctggtgttgtccatcgccggatggatggccttcgtcaagctgccggtcaatgccaatccgcaggtgacttttcccatcatcaccgtgtccatcgcccagccgggtgccgcgcccagcgaactggagaacgcgatcacgcgccgggttgaggctgccgtggccgggctggcgggcatccgtcacctgagctccacgatgagcgatgggttatcgctgaccacggtggaatttcagctcggcatcgaccccgatcgcgcgaccaacgacgtgcgcgatgccgtggcaaagatccgctccgacctgccgcaaggcatcttggagccggtgatctcacgtttagatgtcgaaggcggcgcgttgttccattacgcggtacgtgccccggccaaaagcctgccggaattgtcgtggttcattgacgacacggtcagtcgcgccttgttgacagcacccggtgtacagcaggttcaacgtctgggaggcatcggacgcgaggtgcgcgtcgcgttgctgcccgagcgactggaagcgctcggcatcacggcgggacaggtcaatacgcaactggcgcattccaacattgacgtgcccggtggccgcgccactctcgatgggcgcgagcgggccatccgtgccttgggcagcgccaccagtgtagaaggcttggcccaacgtcccatcgccttgtcggatgggcgctgggcacgcctttcggatttggcgcaggtcagcgatggcggcgccgaaccccgcacccgcgcccgactcgatggcgaggaagtcgttggctttgcagtgttccgcacgcgtggctccagcgacaccgtagtcgcagcaggcgtggaagcagcgatcagtgcattgcaacgcgcacatcccgatgtgcgcatcgagcaagtttccaacaccgtggactacacacgttccagctatcgcgctgcgatgaccacgctgatcgaaggcgcgctgctgacggtgttggtggtattcctgttcttgcgcagttggcgtgccacgctggtcgctgcgatcgcattgccgctgtcgatcctgcccaccttcgtggtgatggcctggctggactacaccctcaacagcatcaccttgctggggctgactctggtgatcggcattctggtggacgatgccattgttgagatcgagaacatcgagcggcacctggacaagggcaagcgtccgttcttggccgccatcgacggcgctgactccattggtttcgcagtgatcgcgatcaccgcgactatcgtggccgtttttcttccggttagcttcatcggcggcaccatcggccagtacttcagccagttcggcgtcaccgtctctgtcgcggtgctggcctcaatgctggtggcccggttgggcacacctctgctggcagcgtacctgctaaagcccaaggccgaacacacaggccatctcacacaatccgccggtggcttgatgcgccgctatttgcgcctgctggactgggcgctgcatcaccgtcgtacgacggtgctggccggtgcggcgttcctggcgatttcgctggcgttgttaccactcctgcctacaggcttcctgccggtcaatgaccgcagtctggtgcaactggacgtgacattgccgccaggcacgccgctggccgaaaccgatacccgtctgcaagcgctgactgacaccatcgcacaacgtcacgaagtggccgcgatcttcgccaccgcgggcggtgacgacgtggcgcaaggctcgttgctgatcaaactggtgccaccgcgtgagcgcaagctggatcaaaaatccttcgagcaggccctgcgtcaggaactagcgagcgttgccgatctgcgattggccattcgtggtgaaactgccgcccgcgaaatctcggtaattctcgtcggcgataaccccgacacgctgacagaagccgcccacgcactgcgtcgccagatccacgtcgtccccggcattgccaacgtgcaggtcaacgagccgctgctgcgcccggaattgcgtatcgagccgcgcctggacgaagccgcgcgcgccaatgttacgccgctggccattggcgaaacactgcgcattgccacagtgggcgatcttgatgccaatacggcgcgattcaacttcgtcgaccggcaggtgccggtacgcgtggcactggccgaatctgcgcgcgacgatctcgacactctgcgccgcgtacgtgtggctgcggatgacggcagtaccgtgccgctgcatgcggtcgccgatctgcgctttgccgacggaccatcgcgcattgagcgcttcgaccgccagcgccgcgtctcggtcgatgccgatctggtcgccggcaccacgctgggcgaggcgctggctgccatcgacgccttgcctgcgctacgtgaactgcccaacggcgtccgtgaggtcgaatacggcgatgccgaatacatggccgaaatgttcgacaaattcagcattgccatgggctttggcatcctgatggtattcgcggtgctggtgctgctgttccgtgacttcctgcagccagtcacgatcctcattgcgctgccactgtcgctcggcggcgccatcggcggactgctgctgtacggcgcagcgctcgacctgccggcggtgatcggcattctgatgctgatgggtatcgtcaccaagaactcgatcctgctggtggacttcgttatcgacaagcgtcgccacggcatgccgcgtgcgcaggcgctgctgcaatcgggtgccgagcgtgcccggcccatagtcatgaccaccatcgccatggccgcgggcatggtgcccgctgtgttcgccagcggtgccgatgccgggtttcgcgctccaatggccattgccgtgatcggcggcctggtcacctcgaccttgctcagcttggtattcgtaccagtggcctattctttgatggacgacttgcgccaatggtgtgcgccgcgactggcaaagatgacctcggtgacgaccgcagacagagaggctgccgatgacgcatcgacctgaacacataacgagtcatcttgaaagggacaaggggctctcgccgagtgttgccagcaatatcgcattcaaccagcgcgacaaggtggcagtcgagcgagggcaccaggacggtattgctcatttcgttcgcctggccccgttgtttggtttcctgcagccgcaaataatcggcggctttttgcagatgcttaccccattcgtcaaccagtggctgaaactcagtgtgatcattgacgcagctagtgatggcaaggactaggacccatgagaactcccgtacataccggtgggtgcttttgcggccgcattcgattcagcgcaaaaggtgaaccacgattttcgcatacctgctcgtgcagcatgtgccaacgccactcgggcagtctgacgctgtgctgggtggagttcgacaaggccgacgtcgaatggaccggcgaaggcgatataccagcgctgtatcgatcttcggagcagtccagccgtgcgttctgcccaacttgcggaagtagtctcggcgctatcgacgatgcgcccaccgtcggcctgatgctgggctgcttcgatgtcaagggagacaaggcattgcgtccgacctcccattcattcacctcgtccaggcctcgctggtggaagatcaacccgcaatcctgagtcgacagttattcgtcaagacattcgccacaaggagtgtgcacggccccgatacccacccagtgatctacaaggcccggatgctgcagcgtattcgccagttgctcgacagagaaggctagctggagatcatgacgccgattctgcaaaaccgtcgtccgacagcttctgatgctcggggcacaaaccccagccggttgccatgtggcgctccactctcgtgcgtaggctgcgatccagcaggatggcgccggtagccgcgctacgtgcagggcttgttgcgccgctttgagtagtactccatgaaggtgtggcagaaatccttcatgagcggtggcttgcgggcggatgaatgcacaatgtatgaaagctgaccaaagtaatttgtccagactgcacttctgacaggtaaatatctggataatcattactgaatattattctgacaagtgagactgccatgtcatgaattgaggggcaattgatggactattcactctaaaaccacctgactggccagcgtcaacacctgtgaatccatcggtttcgtatgtctttgcatggctaacctggccaattcatttgcagatttgggtaattcctagttgtgatcactttatggctcgcacaagagcttactaactcccgtttttcacagctaatgcatgcataaagcgtgtatttacttttgcttcatgttcctgtctgcagtcaatgaattacgattaccactgtagttttccattccacataaagtaagttaagtggaatgcaacattgagtgagtaaactttatgcagctatattgctgcctgaggtgaatgcaatgctgatcccaccgaatgaacatgtcctgttgctggctgaaactgctgtccgacacttagcgttagccacccccccctcctgcagccgggttttaagccgtcattttgtgtttcaacagaaggtccgctttctacatagttgagaaataatgctgcttctaactgtttcctggtcagacagtgtcttagagcgaaaaaatagataacaaaaaaaccttccagctattgctgttttcacgaattaatattattaactaaatctttactgatgcattacaaaaaacttaaggaatggaaatgaaaaaggttcttcacacgttaatcggagctgtactggttgcaggaatgctatcttcatccgcgcaggctgcaacggggggtgcttacaatagtgcgccaggaaaatcaatgactgttacgtcagctaatacctggtatacctataactttccaattcgagctggagctatcatcccttcagataatgctataatttcaattatttattacgagtatgctctaggtcaggtaaacgtcggtaataaaggaacgctgaacgttcagctttgtcaggggtcaacagccaactgtacagacatttcagccgctcagtctggttcaaccactgcctttaaggggaaatcagtttatacgccattcttcctttactaccaggttaaatccaataaagcaaccggcataatcaatggtacaggcaacactcaaataactgttaattatgatattcctcagtaactgaatttttagtttgccggcaaatcaggcctgatttgccggcatccagccagaatttgaatgaccctctcacctgatattaccttattgtgccagctcagtatccggatctaaaccatgcaaaaaaaacctttttcatcagccccagtgctggatgagatccctgccatggcacttgaaaaaattggttttttttataaaaaaacagccattcctaacgaaatattttcggatgtgtcattcagtgttctgaccggtcagacctgcgccataaccgggccgtctggtgcggggaaaagtacactcatgagtcttatgggcttacttgaaaggcctgcatcggggaaaatttttatcgacggcgaggatgtctcttccgcaggtaatgatgaacgctcccgcctgagaaatatgcatctcggattcgtatttcaggggtttaatctctttccgaggctgaccgcccttgagaacgttgccgtttccgctcatgtatcgaggcctgaaccgcagggaagcctgccgtatggctgcagtacagcttaaaaatgttggcctgggggaatatcataatcaccgtccgaatgaaatgtcgggaggacagtgtcagcgagttgcgattgcgcgggctctgagcgggtctcctgctatagtcctggcagatgagcctaccggaaaccttgatgacgttaacggtaatatagtcattgaacttctgctcgaaatgaatgagcgctcagatacaacgcttattgtcgtcactcatgatgagtcgatagcaggacgtatgaaacgacgtttcgtagtggatggcagaaaggtggctgaaagataaatgactgaccgaatgccagatacagataaaagaaattatcgacgtcgcaagatttacggaccttctttttggcagatcttcacagctgcggtggacagtatacggtatcttggccggcgagctgttctggctcttataggcatagcaacaggcagcgctatcgtcgtcgcgctcattaacattggcaatatggcacagctggaatctgcaaatgtctttcaggggatgggcggtgatatactgatcgctaactttcagcctgcgcctggccgtcctgtcacaggctttatgcccggggatattgacatgaccctcctagtcagttctctcgatgcttccgtaaaagcggccggaatagtgatgaccgcatctgagcttccttccgggcagtcccggatgccagttatccttatcgggcagagcggaaatcttgaagacatcatggggctaaaactgcaacatggccgctttctaacgcgaacagatgccagcagtacgtacgtcgttattggcagtgagctggctcgtggacgtcatatcggcgaccagttaaaactgggggagtatatctataccattattggcattctggcccatcgcgggaataatcctctttttccattcgatcctgataatgctgtgtttcttaccgatgtgggaatgaaacggataatgccctcgccctatctgacattgctgatagtaaaataccggcaggcttcttcgcagaaaatggctgaccagctgcagcacatactgcactcattccggcctgaaattgatattaacgtacaacttccggagacactcatcgacggcatggatcagcagtccagattatttggctggttactcatctgtatgggatgcattggtcttcttacaggaggagtcggcattatgaatgtgatgcttatgaacatcattgaacgaagaaaagagataggcataagactggctataggtgcacgtacaaaagacattgccttacagtttcttctggaatctgtcctcctcagtgccgtaggcgctatagctggctgtgtcaccggagtggccggagctctgatattttttgaatttgcaggctggtccactctggaaattactgcgtcttcattgttgctgggagctggaagctccgtgctctccgggcttctatttggtttttatcctgctataagggcagcacaaaccgagcctgtccgggcaatgaatgatgcgtaaagcgctactggcttatctggccttcagctttatcacgtatcctttgatcgtttcagctggcgaaactactgcatacagatgcgatgcatggagacctaattcacgcagacgataaacaggtcatgctgtcactaagtgaagcaatatcgctggggctgagaaataaccctgctatcagaagtgcctatctgcaccgtatctcacaaaggtttgacttacgcgttgctgaggacagctttacccctaggctcgttatatcgggaaactatttgcgtgggaaaaatcaggaaaatctttactcacaaaataccctgtcacctgtaactacgctactgacgccgtatggcacgcgtctgagtctggggtgggcacataactcagtgcataatgacagcagcgaaacctacagcaatgatggggcggatttcactattatacagccactgctccgtaatgccggaaaggaggttacaacggcaaacagagagctggccagactgagtgaagcccagcacctgcttgaactgaaaaataccgtttcccatacagtaactgaaatagcagaagcctatcgtgcgctgcaaaaagccgctcaggaagctgtaatattacagtcttcgctgcaacgggctcaggatcttgttatggtaaacagcgccctcattaaggctggccgtatggcgcgccttgatattgtacagactgaagcagaagtcgccgggcagcagctttcgcttgagcaggcacagaatgccgttgaaagtgcgagactgcagcttctgcagcttctggcaattgacctcagtaccccgctggttaccgagcccgtaagtactcctgtatacactgacatcaattctgataaggctatccggatagccaggaatgttcagccagcgttcctgagtcggcttcttgaaaataaaaaagatgacatcaacgtattactggcccgtaacggccagctgtgggatgtttcgcttattgctggctcgagtgacaggcaatcgagaggtgcaggctcaggttctgaccgtagccggaataattatgttggtatacaggtcgatattcctgtgggggatttatcctcacggcaggctgcgctcagcgcagaggtctccaggaaggctggccgtcttgaagctggtgacatggagcaaaagctccgcagagatatacttatcaccacgaatgatattaccacccgttggaagcagtttgttatatcacagagggcagctgaacttactcaacagaaagtggatatcgaacggcagaagctggcagccggacgctcgactaactttcaggttgtctcatttgatgctgatttgagaaacgctgaaagtgcacggctggctgcggccatcagctatcagaatgcactgactgaacttgatgaaattatgggaacaacgcttcagagctggggcattatgctaaatgataaggcaaacgatgccgcgcaggaataagacggtactggggggcctgcttctggctgtttttcttctggccggagcattccttatcatcggttttcatgacagggatacgcctggagaaacagcttccctggaaacgtggctaccggttgattatgccccggtcagtaaatttatggggctggcaggtcacattgaggccgaagaagacgtaaccctgagtgcaccatttgatggggtcatcagtaaggtcggaccggcaccaggcagccgcgttaaatccggcactcttatattttcaataaatcctgcacagttagaggttcgtatcaggacggcactttcagatcagttaaaagcgcaaagcgaagttaacaggcttgagcactggatgagttctcctgaaatcacccgtctgcgccggcagattaatatcgccgcagctgagcttggggatacgcaagcaaatctgcatgaaacaaaagcgctctacgaaagaggtattgtcgcgcgcagcgaactggatgctcttcgtatgcaggccagaacacagtctgatgaactacagaactcaagagatgcgcttgcgcagtccctgtctgatgctgagggaaacaatatgcgcattgcacaaatggtgttactcaatgcaaaaacgcagtacaactcactggttagtcaggtcgccaggaaggaggttcgcgcaccttttgatggacttctgctgccagccactctgcctggcggtgcgaaaagtactaatgcgatacccggacagcaggtcatacagggtgcgcctgttttcaatctgacacgacttgaccgttttcttgtcagagcgcgcgttcaggaaagcgacgtccgctttctcaaagaaggtatgaatgtaaaggtgacgagtgatggactgccaggcgaaaaactgtcaggaaaagtcatacggatagcatcacaaccttctgcaaaagatgaagcatcaggcacagtaacatacgacgtaaccgcatccctgaaattcccgacagaaaccctgagcaacgtacggcttggcatgagcgcagatgtgcagatcctcacatattcagatgcccatggtatggttctgcccgcgcagagtattaaggaagatggcagcggaaacagctatgtgatttatcgtgaaaatacggatacaaagcctcgccgggtttttgtgacgcttaaagaaaccgttccgacaggaattgtcgttgagggacttcttccgggagagattcttatcccgcagttgcagtaaacagattaactggcccggccggtcttatttttcgcaaacctgcaggagcgttccatggtcaataccaggagcagtgtcattattttttttgctgttctgattacgtcagcacagactctggccgctgaaggaggagcttataccagcaagccttctgaaaccatgagactgggaacagcaaaccagtggtacgaatatcagtttccggtaacagcgattccggaagcgggtgcgagagtgtccgtcgtttattatgaatatgctctgggcccgcgagacctgcgcggccgaggctcgctgtcagtaaaactgtgccacggggctaccgataactgtacggatgtttcaggtcaccagacaggttcaacccttttcttcagaggccaggatgcaggtcagccctttcagctttattatggcctgaccagcgataagcctgttatcagcatgacgggaaccggaacgacgcagataacggtaaactgggaaacagcagaatcacactgaacgcggcattgcgttcctgttttcagttggcgaagctcccctgctgagcgagtgacagatatttctcaaacatgagctcatagtaattcatttcttccagcgggagctgagtattcagaactggcagccggaatggctgcagggtaaagggctcagcagtcagcggggccagatgcgggcatcgcattaaggactgcaccagttcatcaataaaaccggtatcgctgtcatgcacactggtctgaacaataattccgctcgtaacacgggtttcgccgtgacctgactgcagcaggcatgcgccataaacatactctgctttgtccggagtatagctgtggacgtgaccggacatgttcctgtcagtaaaagtgcagtgaaacagtatgactgtcataagtttccttccagaatctggcagaactatcttcccccgttcctaatcctgagggaagacatatgtataagattaacgcaggttgaccagggtgttgaggatctgatcctgcgtcttaatggtctgagcgttagcctgatagttacgctgagcaacgatcatattgaccagctctttactttgatccacgttcgacgcctcaagtgcacctgaagtcagcgtgcccagatttcctgtgccggcaagaccgaccagagcctgacctgatgctgctgttgcagaccagacgttatttccttctgacttaagcccctcagcgtttgagaagttagccagagctatctgacccagaagctgggttttctggtttgaatagctgcctgatattgtcccatcattgttaattacatatgaggtaagctcacccggcgcataaccgtcttgtgaaggattaccaaatgtacttttggcacctgtattctgctgctttgatcccagcagactcaactgcatcgtctggttagctgctgaaccgttcagtgcaccgatgtccacggttacattgcccgtaccattgagtataccacttgatgtgaaagtcagatttgtcgccggactggcagtgccggttgtgctgtctaccggatgcagtgtccatgcattatcaccagttttaacaaaatataaatcaagctgatgtgtattcccgagtgaatcgtaaacgctcatggatgtcttatcgctgtagctgtctacatttgctgtatcaaagggagttactgtaggaacgttataggatgaattaaggttagcttgaagtgcgccagtggacgttgggttcgctgacattgccgtcgagggaacggtgagtttctacggggttggcacctgtctgaacgactggcggtgtaccagcgaccgggtatcctgtcagagccattccgctggtattgacgattttccggtccgacgtcagcgtaaactgaccattgcggctgtaataagtattacccgcattgtcctgcaggcggaaaaagccatcattgcttatcgccacatccagcccgcgactggttgtggtggtattaccgtctgtaaagttctgaatgacggcagccactttagtgccgaggcccacgccagacccggcaaaaacatccgcaaaggcagccgtgctggctttaaagcccgcggtggcggagtttgcaatgttgttacctataacatccaggttacttgacgcagcattaaggccgctgaccgcttgtgaaaaagacatatctagactccggctgtgtatacgataatgttatttaatgaaagtccactaactccatacgtatcaccggctgactggtgcctgtacggatgaatgcacaatgtatgaaagctgactaaagtgatttgtccagactgcacttctgacaggtaaatatctggataatcattactgaatattatcctgacaagagaaactgtcatgtcatgaatagaggggcaattcatgggcttttcactccataatcacctgactggtcagccgcaaccccagtgaatccaccggctccgtatgtctgtgcctggctgacctggccatatcatttgctggcttgggtaattcatagtcgcaatcactttttggttcaggcacaagagcatgctatctcccgtttttcacagctgatgcatgcataaagcgtgtatacacatcagcttcatgtccctgcctgcagtcaatgaatcacgattacccttttccattccacataaatggcgacatggctgccagaatgatggctatcctggttgaaatggcaccaggcctggaaatttactcgatagatgaaagctttctggatgtcagcggcatttcgtcgtatatgcctctggaagactttggcttgcagatgcggaatcgagtgaagaaagaaataggactgacgatcggcgttggttttggaccctcaaagacactggcgaagcttgctaattttgctgctaaaaaatggacgcaaacaggcggtatcgtcaacttaaccagcccggagcgccagagaaaattactcgcactggtaagcgtcgatgacatctggggaattggtggcagactgagtaagcgactgcatacgatgggtattagtacagcgctccagctggccgatagtaacatcagcatgatccggaaaatctttgatgtgatagttgagcgtacggttcgcgaacttaacggtgaatcctgtttagctctggaaagtgccccgccgccaaagcagcagattgttgtgagccgcagtttcggacaacgtgtcaccagtatcgaagacctgcagcaggctgtagtaacgtatccacgcgtgccagtgaaaagctcagagaacagggctcaatgtgtcagtcaatacaggacgatacggaaacgaaccacagtatgccaactctgccgctatgacatgcgaatatccaaccagcgacacacgggacattatcagtccggcattgcgagctctcgacgcaatatggcgcgacggttaccggtatgcgaaagcgggtgttacgttgggggatttttatcagtcaggtgttgcgcagctggacatgttcagtcagcagctgccgcgcgcaaacgcggatgctctgatgtcggctgtggatcagataaaccgttcgggcctgggtaaggtgtggttcgctggacagggaacagacagcgtatggaaaatgaaacgcgagatgccttcgctacgttacaccacctgcctgagcgaaactctaagagtaaaataaaatgtgtgctgaaagatcaacacgaaaacagtggcttacagatgacagaacgcagtgagcacaacatagcaaaacgttcagccgatgagcgtgaacgagttaacattgatctggcagcttccggcgttgcatataaagagcggatgaacaaaccagtattggctgcagaggttgaacttcagcagccagagaagtggcgagaaaactttcgcgaacgtctggcattttataggaatgctgctctccagtttcctcgcgggaatgatcctgtgtacgcaaagccagaagcggataagtagttttattaacctttaaccggaaaagctggaatgttagccagggcgtctgctttatacgcgtcccagctccaccagttaccctccccgaactcttcacgataatgtgcaagttttacggctttacgctcaagatagtctggcgtgttcatgccaaacacctcaagcggcacgatctccctaccgggcacgtcttttagcagaaaatcaggaaacacatccgcctcgccgtcatagcgcagaggtttaatgaactgacgcttttcctgccagagtttctcctcaatgaccccttccagtgatgaatcgagaggaataaatctgggactgactgtcatcagtgccgcatcaatgacggtacaggtgttatacggaacaggtttgccgtcacgctgcctgaatttttttaccggtggttcggtttcagctattagcataactttttgcccccggcgccagtcacctagctcgcgggcaaagcttcggttgagtcggttaataagatctgcaggtacatcaagagacggaaagcctgcggccagagtgagcggcagtgtgccgttcaggctgcctccttccccatttgtgcagggtttgagataagtgatcatgattaaccgcttgttcgatgtagcggccgcatcaatcattgcccagttatttttaatctcctgagtgccgggtcgcgccattatgagcaggaccgatttcagagacgttttacccacgctgattttttctgccatttgcttcaggcgccatgcggcccaggcatcgtcgcgggtacgtttgtcaaaattagggtgccagtgattgatttctgcctgttcccacatgaaatgaaggaggccgaggaggcgcatggctggctgacgcctgcgttttcctccgcttttaggggctgatggctcaaaggcatcgcgctccgtatgcacttttttctgtaacccggtaggtagcttgatacggaaatagcccggagagagtgccttaactacgtcagaagtgtaaatctccccctgcttttcgtctgcccataccgaataaaaacgacagtcaggtgcgtgctctgaaccactgtaagaccagcgggccagccagtagttgtcgtgcgatgatgaatagcaggctttcagacggcggcggttttcaccttcatctttcttcatgcactgacaagtaataagggtggttgccttattttgtcgggcaaaacggatgtagtgtttgaacgtgtccgcatgatccttctgaaatgcagcatcacactccacggtttttacctgaccagtaaagcagacaggatatgttttaatttctgccatcgtcgcgtcctctctgaataatggcgcggctaaatgtgttaccagagtctggttgcctgccatttctgttttgaatcctgttttacgacccttcttcgtctgggcgcgctgctttaaccctgagtatggtctgacgggtcgtctcaaactcacgagcaattgcactgatgcttgctccttcatcaattcgtaagagcacagcctgcttttgttcctcattaagcgcaggaggacggccaaaacgtttgccggaggcttttgccttggcaataccggcatgagtgcgctcaatcagcaaatcacgttcaaactctgcgacagctgagatcacctgcatcgtcattttgcctgccgggctggtcaggtccacaccgccaagtacgaggcaatgaacgcatatttccgatgctgcaagtagctcaactgtttgcctgatatccattgcattacggcctagacgatcgagctttgtgacaatcaggacgtcaccattttccatcccgtccaggagtcgcataaacccgggacgttctgcagctgcaaccgaaccgctgacgtattcctcaatcagccgccgtggttggatagcaaaaccggcagcctcgatttcgcgacgctggttttctgtattctgttccagtgttgaaaccctgcagtaggcaaaaactcgtgacatggtgttacaacatgtacttaaagggtgtactaattgtaacgcatgtactaaacaaaaaaacacttactttcgtacagtctctgcaatatgcgtccgaaaccaaccatattaggacaccgacagatttgaattatggcgacattgattttctttggttattatttttattgatatatataacatgagcataattacattcttaaatagtactgacatttaatattaggtggttaagattgagcagtaatgatttaaagccgctaaaaaattcttcaatttaaatttatcaatgtctttaaattgagagtaagatgggtgaaaaacttgacttaagacgaaaatgaaaaatttatttggtggcttctatagtgttgacgatgatagcgctaaagttttatggaatgatattaacgctgtttttattttcgataccaatgctcttctgcttctttataggtgtgaaaaagaaactcgagatgcttttttcagccagtgggaaaaaattaaagaaagagtctggcttccttatcatgtgtgccttgaatatcaaagaaatcgtcttacagcaattaaagaacatgtgctggagctagaaaatgccggagaacatctcactgtcaaagctcaagaggctttaacattacaatccattgataaaaagcacgcatcaacaattcgtcgctatgaaagtttgaaagaaaaactggaggatcttactgaggaatttagaacaacagttgataatttcgttaaagagcaaattgctacgcgtattggagaagctgattttttaaaaaatcatgacatagttcgtgacagaattagtgaattatctgataacaggataggttcacagccagaccaaactgttatagaccaacttgaaaaagaaggcgaagtcagatataagaaaaaaataccacctggatttgaagacgagaaaacaaaaaaagatgaaaccttcaccttcaacggaattacctacaaaagaaaatttggtgattggtttatttggaaagaaatacttaattacgttgaaagtaaggtaacatcttctgttatctacgtcactaacgatgagaaacctgactggtggtatgaggttggaggaagaacgagaggtccactagagtcgctaaagactgagctggcagagaaaggtagtggtagtatactttttttatataactcatcgtcttttttacatgctgcaaatagatttctaaaaggcgcatccacatccaaagaagcaatccttgaaatagagagagtttcagccgatacaaataaaaatcatgagagcttaattggtcactctggattgttatatactaacttggataacgaaacgagaaggcgaaatttaaatataaaattggttggtgagttaaataaaaatagacacggatcttctggttggctgactcccgatgagtaccttgatgttataaaaagaagtcctagttacattgataccaagaatgaattacaaactcaattgatgtatcatgaaaaaactgacaaacagttacaatttgttcattttaatttaattaggacgattagcgatattgaagttgaaatgcagcgagatgacctcactgattacgagagggctaagcttgttcgagataaagattatgccgaaatgtgttatggtgagttaatgagggagtataatcgtagagagatcgacgggaaatgattatttcaaacttgtattatggtttttgattaataaatcattcagaaaatcagttatagaaatgtcagattccattgatatttagccaaggataatcgttgctgtaaagattattgaatatcaatataagtgtctatctgtgaattttaaaatgccacaaccagtaattgtggcatattcattatttgaataaatcagcgtattacttatctctatttgttattaagcattattcgcacttaacttgacactgatggctgtgatatctgcctcagtatagttggctaacaattcaacaaatgctatacctgcgctgctacatgcttcacgctttacagagtcgcgtaagatagcatcttcctgaaaatggccactgccatgatactcaacgacggctttcggctgccctgaccagtctatgatcacgaagtctgcccgcttgctattaattgccaggtaagcctgctggtcatttgagccaagaatctctccaagtgatacctgggaaaatacacgatagccacggtgtgaagttgaaagcagcttttcaagtctgcagaaaacggcgtactcacttttattcatcagcgggcgtttataaaattcgttgcccctgaccgtaaccagctggcgtttctgctacagactgctccctgacaacctccggtgcacgttcatgactttcacgcttcggtggctgataatctgttttgggtctgtatacaccccccttccttttacgttttgcacccgaaatcaggtaagcgaccaccgcgatggcgatcaaaacccagaaaaacatatccatatatctactccaaaaactgaagggagcgcaggtatcttgctgatatagccctcgcctgtaaaactcgattgtacccctcccctgccccgtttcgtagagtaatgctaatgaatatgcgtgttatatttttgtatatctagcatacgttttaaatactaaaaatgtacacttttggtattttggaggtattctttcttgcgcttcagttagtgtactgataaggtgctaaacagatactgaaaatgtacactttagggatggggaaggtatgaataacgcatcaaatccatacgcgggaaaagttatagcggtggcaatcaaaaagggcggcacgggcaaatcgcttatcagtctgaacatagcgcccgagcttaagcctgatactttttatgacactgaccctactccggccgtgacgacgtttaatggcttccgcgatgagaatattcggtggaatgtagtccgcctcaccgacgacatggaaaatgtcgtggaccgctttatcgccgatgttctggaagctaaagagaaggggcagaccgtactggttgactgtggtggttttgactcctcgatcacgcgtgctgctgtagcgcttgctgatctcattatttctccgctgaaggatgacccgtccgatattctgggccttcacgaattcagtaaggtactggatgaaatctcagctgagctgggcgagaaaaaaatcgctcatgtggtgatgaataaggtcccgccaaatcgacgcaattacagcgacatcgataactacattgcccagtttcgacaatctggttcggatggagacggctattccaatggataaagctgcaccgcagcagtttggtcagggtatgggtgttgttgagcacatgacaacacgctacagcaatgttggtaacgctatgcgctcgctctttttagatatgcgcaatgctatagaaaaggtatgattaagatattcaatgagtattaaaaatgtactttttaaatatgaatggtgtatgtgatggctaatcctaaatcagcaatgttcgaacgtatttcacagctctcaaaaaacgcacctttgcatgaagcagggagttctgcaccagctgaacaacagcctgtcgcggccgaggccgtcaggcctgcagaaccagagaagccggttgaaaacgaatcctctggtccacgccggaaagcaaaagctgtgcgcagggctaaaaacgttcagatcccggaagacctgtgggacgcgtacgactcactcaaagagcgtaacgttacatccctgctgatgacgccttatatacttgaggcgtttcgcgagaagcttgcacgcgatggcgctttcgatagtaaataaggcttaataaggaagccacttactgaggggattccttattaattgagtgtgtttaaagtacttaaaacgtacattttgaatactttttgtgtgctttaaatgtattgtgttagtgcttgcacttaagctcgtggctggcatcaatctgaactcttacagagacgctcagggccctgcgaaacgccggataaagaggatgtattaatcagctgttaatcgagatgtacaggttatcctagagcggcgcctcgggaattttgattacccagcgcgcagatatatacatatgtcatgtccgcagaaaacggcacgcgttcgataaatgccagcagcgtcttaactatggtgacaaattgccgtgtagccgctatttcgtcgggaaaaaaccagggccttttattcgcctacttgatgaattttaccaggcaaactcacacctgtgaaacggatgcgtggtaaaactcccggcctgcagttgagttcggccaggaggacgggcacaggcgctgagtgtgccaaactaagcactgttagttttattagtcagacataatcaatgtctattaggtatttaatatgtacattttaaatacctaatttgtgcctttaacatacctttgcaactggtagctctttccagttcgtcgtccatgctttactcagcatttcccgtttcatcttccagtcagggtcgaaacctttacccgcaaaacctatgctaaaacgcccggagcggttcatcgaatccatcaggctcattagtacttcactgccggcacgcggcgtctcctcatcaaacaggttgagctgcgccacgccgttcggtcgcagctcgctcagcatgatgccggcttttgcatagcgatagcccgggcgccagatggtatccagcgatttcactgctgcctcgatgatgttccgcgtgtcctgtgtgcccacgcgaagcttaacgaatgccgtgttgccgtagccaggctgcccggtgtcgaaaggggaggtgcggataaacacagagatgtggtggcagaactgcctgtcttcgcgaagcttttccgccacgcgttctgcatacgcgcagatggattgtcgcattgcgtcatattccgtgatgcgttcgccgaagctgcggcttacgactatctgctgtttaggcgggggcgcatcttccatcgggatgcaggattcgccgttaagctcgcgtaccgtgcgctacagtaccacaccgaaattattgcggatgaaggaaggggaggcgcgtgccagatcgagcgccgttgtcacgccgagcagctgcaggcgtttttcaagcctggaacccacgccccagagttcacccacgggctgacgagacagcagcttttcggtccgccccggattgcctggcgtgagcgccagcaccccgccaaactgtggccattccttaccagcccactgtgctgacttcgccagggtcttcgttggcccaagcccgacgccgaccgtcaggcctgtacaggtcctgacgtgcgcccggatcatgcggccaaagtcctcatatggcatagccatttccatacccgtgcagtcacagaacccttcgtcaaccgaatacacctccagccggggcaccatctcctcgatgcaggacattacccgcgtgctcatcgagtggtataaagcgtaattgcttgaaaatatatggattttctcagggaaatgctgattctttattttgaaccacggatcgcccatcttcacatattttttggcttccttgctgcgcgcgataacgcagccgtcattgttcgacaggatggccaccggcgcatttttcaggtcgggccggaataccttctccgcgctggcgtaaaagctgtttacgtcaatcaggccaaacatgtcagttccttttgcgaggggtatgcacgaagtgcaccacaacgccgaagatctcaagcgtgtccgggtccggaataataacgggataggcgggattcatgggctgcagaacgggtcctttcggtgtaagcaaaaagcgctttaccgtgaattcgccgtaaagctcggcgataaccacatcgttgtgctccggcgtcagggagcgatcgacaataagcaggtcgccgtcatacagaccaatgtcctgcatgctattaccctgcgcacgcaggaaaaaggtgcttgccctgtgggctataagatattcgttgagatcgagctcctgctccgcatagtcctgacagggtgagggaaacccgcagggcacacgttccaggaaaagaggcctgaagctgggcggcggattgtccgccgggtgcatcaactcaaaggcgttaaacatagcaaaaatccctgtcaaaatgctgtatgtatttacagtagtattaactggcttaccgcaaggtgcaagatggcagatgcagcactatcgtactggttattcgggaccattgatttatatagagttacagcgaagcggtagtgcaatatttagcctgttcctttcaggcttctgctgacgcggcctgccgaagtttatcaacagctttatgcgccggatgtgcagaaaagatgtggataagggccaccttcggcttccccttgcgggggcgtcagccctactcagctacccggcaaagccggaaagcttcgccggaccgcaggcgttccgggcctgacggctagggtctgatgtctgcaaaaacagcgcattacgtgctggcgctcatctgaaaacctgtcagcagcctttttatcatggacctgatgtgtatgattagcgctcacttaagggactacataaacagggagcttgttatgaaaaccattatttcctcacaccagtccggtactgactgccgcttacggcgcacgggcctgcactgacgcattcagataacggcattctgccgcagacaaacaccctaaaacagaatcagacagcgggaccttaaaggacctgcagccagcccgtggctggcgcgaaccgcgacggccagaaatcgccgccgctctgaggcgcaacgccgtttcgctgccgctcagccgccgttgctgctgcaccgtgctgtgcttttccgccgggcttcaccggtttaagtcctttcgccggggctgagacaagcacaggcgccgtggtcgtccagggtgaagtgaacgccgggaaaatttatttccggccactgcgttagaccggaaataaatatccccgtcgccccggacgcctgccgtcacccgcgctggtttacgccctcgcggcgaaggatctcaaacgggtgaagtgaataccggaggaaaaaaccagccgatttccacaaaacgtcaacaccgcggctcccgaaactcaacgggtgacgtggttaaaacccaactgcatgaggagaacgaacatggcttcacgaggcgtcaacaaggtcatcctggtcggcaatctgggacaggacccggaggtgcgctacatgccgaacggcggcgcggtcgcaaacatcacgctggccacgtcggaaagctggcgcgacaagcagaccggtgagaacaaagaaatcacggagtggcatcgcgtggtgctgttcggaaagcttgccgaagtagcgggggagtatctgcggaaaggttcgcaggtctacatcgagggccagctgcgcacgcgcaagtggcaggaccagggcggtcaggatcgctataccacagaagtggtggtgaacgtcggcggcaccatgcagatgctgggcggacgtggaggcaacacagacgcacagaccggacagcagttcagcgggcagcagagcggtcagcctcagcaggcgccagcagcgtcaggttacggtggtaaaggaggcaagggcggtcgcagcgaggctcagccgcagccggaaccacacgcacagcagcagggtaattatccgccggcagattttgacgacgacatcccattctgaatgacgcggctttgctcatgcaaggctgtcacagaggtgaaaacagaaggtaacaaagcaggaaggcggcaggaacggccggaatggttgccctggcggagctgtaactccgcgcagggcatgacaatcaaattatgaggaatccgatatgtcagcgaatcagtctaaagaaaaaatctgtaacagcaagtcttccacatattacggtcgccggcgggggggttaccgcagctgctgcggcagcgaactgacacgcgatgagagcgtgacactgcaacgtcttaaggccttcacgccgggcgattttgaggcctacagcacgcgcggcgaggagtttcgccggcgactgtgcgggacagtgctgaatgccctgcagctcagcaaagcctggcttaccgactgcgaatgccggggagagtggggcggggtgttcccggttcacctgcgcctgacgcaccggaaaaatccgctcgtcacgctcgacattctgagcccgggcagcgaatctccgttctggcacggcctaatctggataaatcccgatcacaccgggctgtacgttctgaacaccgaacagtttgagccggaaaccataggccggctgctgacacgtattgaagagatggtgtcagcaggcgtcacaccagcggaaatcgtggcggtactgggcagaaagggagggctcgcatgaatacagtcatgatgatgccggcaatggcgccacgcttttatgcgcagctgcatgggggctgcaggcagcacgatatagcttcatgccctgcagagatttcagcaccggtaaggaggacactgacaaagagcagggcaggtgcgccggtgctcacgttgcatagcctgactgtaatcatcgcacggcccgctcgtgtggcgtcagaacgaacgccgcaggcgatgatgtatctggctgagacgcaggaaaaactcatctgtgaggccgaaacggcgctggccagccagactgctcgcacataccggcaatggtattcgcactggcgtcggcgtggcgtgcgtgtgaacgatctgctggatatgacatgggtctggcgccagcgtggcagaacacactgattacagacagaaaatctcaaccggacagacctgataatgtttaaggtcgtcgtgccgatagtgtccaggtgcttcaccagagatatacattgatggcaaatccgtttagacgatgcttcgcggcatcgtcttttttgtatttaacaaagaaccagccggcgccgaacagattaaaaaccaatttcgtcattatctgaattgtacaggtcgaatctgcgcggatactctgtctccatatctgcgccccagaagcgtacaattttagtttcaccgggttgatagtaatctgtaactatgaactcgaactcttcaaatatcatatccagctgtaaccaggcgtcccgcgcatctccatgaaaccattcagactcagcttcatcataaaaacatatccttcctaaacctgctgaaagttcctgatggatagcactttctaatattcctagtttaatatttaatgatgctggcacaaaataagccacttgcagcgctagcgttggaactccggttcggaggtctttcaaacgcttaacgggatgttgtattgttttaccgactttgaatctgttgatattagttccactcatcaggatatatatccaggaaccatcttctttatttaaaaactgatgtgacattttgtgtgtctcttattcatgggagagatgtgttttgaaaaggtaaggcataaagctgtaaactgaacttgacagggttgcaataatcctgccattggttaagccttctgatctcggttaataacttttctcttggtcatacctactaacagagaatcccagtcgcccttaaaatgttttttcccgttaaccacccagacctgttcaagcatccagattgcttggctaaactcatttattttttccagcgtggatgacgccataaaatctttttcgtcatcatatatgcgcacatatctgtcgtgaaacaattcaaggccagtcagttcgcgatccagcttaacatcgatattttttgaatgagtgacagcgttcctgaatgcggccatttctgatattgttattttgcattttcgaatcgattcaatatccggaacttctaatctgtttgttaaccaatcaaatttaccggataacgtggcattggtgtagcgcttgtattcacttccttttgtaaaaacggccttaccatacgtcagtagttttgattcaagcgtaaagcaataaaaagccagcgcagggatgatttttttaaagcgatcacctgcttttgcatgtttagcttcttcatgcagattgatcgctatggattccagaaagcggtcgttaacaataacgccttcaatactattcattttgggtgtttccatttatagaggaatagaggtaactatcggcacgtaaaggaaaaagattatgtgcgatatgtagcgactgacgttgtcatgaaggctggctttaaagtagtgcataaattccatatgaaaacgcctctaaatcaatctcagtctaaccagcgaattacaaccacttttatgttcttaacagcactggtgctgtcttcgctggtttcaactgcgtaaccctccattctcagataatcgcaggcaaaccccagcatttctgtatcggtgtcactcgccatttcaagtatgtaatcacagcggccggaaccatgtgcagcggcctgctcaatctcttcaatcattcgcttcacgtgtggtacagctgcctttgccaggctcttttcatggatggctttttttcgctctctggtaagccttacagcatttgtggcatgaaaatgtcgcggtaaaaggtcgtgtaaggttgaaaaactcattattccctccggtaacgttgagcgcagaatcgggaagtttgtcaaacccgacctgattatcttaaagaccacaatatcttatcagtactcatgatcactacccatcacatgcagccgataacagaattaacaccctgatggccccctccggcttcccggcgttgccgggtcgtcagtcccactccgctaaccggcagagccggtaagctccgccggaccgcgaagcgttccggacctgccggctagggtctgatggcaacgtccaggtcaacccctgcagccggctggcgccggcgcgttgactggccacaaaaagacgtggccgctgaggaccggaccggcagaaagccgccgtccggggctgtgccctgttcatccttccgcattctgttttgttcccctgagccccttcgccgtgcagaaacctggcacccgggcgtcttcacgcaagggtcgcgcgctaaacggctgcacccggtccctgcgggctgcggctttgccgtttccccctgcgttcagcctgatgcccgcgcgcctgttctgccctcacggcgaggaactcagagaaacatcacttaaaccacacgggagaaacaacatgtcacagcagaacgtcaacaccacggcttcagaatctaaagaatcatctttttttaatggccaggattaccgtgcaacgtattcgccggatgacaacaagctgcgcctgtacccgctgcaccgtcttgatgaggaaacgtataagcgtgttaaggatgcgggttttaagcatgcgccacgtcaggggctctttgttgcgccgatgtggacgcccgatcgtgaagacctgctgatcgagctggcaggcgaaattgaggatgaagatcagtcactgtttgaccgccaggaggagcgcgcggagcgctttgaagagtacagcgaaaaacgggccgtcgagtccggacaggtgctggcagccgtggacagcctggcttcggccattcccttcgggcagccgattctggtcggacaccacagcgaacgccgcgcccgtaagcacgcgaaaaaaattgaaaacggcatgcgccgcgcaatcaacctgtttgaaacctctgaatactgggaacgccgcgcagaggcctcgctgcgtcatgctgcctacaaagagcgcccggacgtgcgctggcgccggattaagaagattgaggccgatttgcgcaaggcagagcgccggcttcaggatgtgcagaagtttattaaactctggtcatctgaaaaccttaaccgggcaatggcccttgttattgcaggtatcgatcaccttcattgttgctttaccctagagaagtacccgcgcgcgccggagaaaagccagtatgaaggtagccgcagcatctggtcagcccttgaagatgacattattaccgccgaacaggcccgggacatctgcataccctgccatgagcgcaccatcgcacgcctaagccgctggacagcgcactaccgcaaccgcattgcctatgagcgcgccatgctggacgagcatggcggcgtgctggcctcagatgtggaaatggtgccgggcggacaggtcaaaagccgcggggagtggctgaccatcatacgcgtaaaccgcagcggcgggaaaatcagctcgctggttacgcctgagtattcattcatgtcacggggaaacggtgccgtcatcaccatcacgcccgatcgcattacggaatacaaagcgcccagcgcagaggaagcaaaaacggcgaaggcggccgcgaagcgcccgccgattgtgaattatccgggggaaggctttgagtacatgacaaaagagcagtggagtaataagcacgccgattttaaacaggtgaagggcatagcggccggtgatgatcacaaggcttatcggttacgccgcgtgatgtccacgggctacaccctgtcaccggtttacatcaccgacatgaaaacggttgaagtgccgcggtaaaaattttgactccctggcgctgccggggaggatatgtatgtacaaaatgccggcattgccggcgcgggagaacgtaaaatgcgtaccgaactcagcgcgcgaattgcgcagatgcaacagaagcttagcggcctgcagcctgttgtacaggttcatgcagatacacagctgtttgtttcgtccgatccggtgtgccggaagcttgtcaccctggccgatgtccggccgggtagccggatgctggagccgagtgccgggaccggcgctattgtccgcgcggtgcttgcggccgtaccgggggtaatatgccagtgcgtagagatgaacgcggaactggctgagcatctcagcacgacgtttcctgaagtggccgtgacctgcgcggactttctgagctgcgccccgcaggcggtttatgaccggattatcatgaatccgccttttcgccacggcgacgatttgaagcacatccggcacgcgctgaaaatgctag

SEQ ID NO: 18 - DNA, 82303 bp, Pantoea agglomerans NY60
ccatcgacatgttgttaaacgaccagttgccgtccgccgtcgtcgaggcctgcccgccggtcgcaaacgccgccgagctcatcactccgccaacggcctgtgaggccaccgacgccgcgcctttggtaaggaaaaaggcgagcaccggtatcgacatgctcaggtagcccgcgatgttggccgcgtctgagtgctgcagggcgacctgatcctgattggccagtaccagtgacgtggctccggtcttcgtctgcagataaaagttggccagcgagttaaggatggcgaacatcaccggccacatagtgaagtaaacgaaaccgccggcgtacagcttcagcgttttaagcccgaagatgtcgtgatttaccagcgcaagcgcgatgaccagcgggaacagcgcaatcagtaccagcatcatcagcgactggaacatcggcaacgtacgtgacgctatcacgccacccgcgccccagctaattcgctgcttggtcatgctggactcggtggccagattcagcaggttggccgtgtcggaagagcgcgccgcaaaacctttccagccgtcacggatggccgcattagtgatgttgttacgcataatctgcgctgcgctcaggccgcctgcatagaagaagttgtagctctcatccatcgcgttgccgagcagcgtgtcaccgctgacgcggctgccgaacacgcgcgtggccagcgcatgccaggtcgtgccgccgatgcgcacgtccgctccaatcaggtttttgacgaccgcagccgcctgctggcaggtgataaactgccggccgctgcccgtatcctgatacagaccgcgcagcgggctcgggttattcgtaatcagcgtcagcggatcggtgctgttcagcagctgtgacacggtgtacttgttattcagcaggatatcgcccaccacgcagttttccacgtagtcggtaagcatgccggccagctgcggattctgtgaccggaagtccgtggtctgcgccacaatctgcgaaccgaacagcatgccggacttcgtataggtcagcgagtccggacgcgagaagctgtactcataaagccgcgccacgccgaactgcaccgacgtggtcagcccggcgatgaaggccaggccggccggcacgttatcgacctgataaactgccgccggatcggtgacatcaagtatctgcacgctgcgtttcggaacgagcagcaccgacgtaataataaagaaaacggccagccagctggcaaacaccatcggattgcgcgatttgatgaagctgaagatcacgcccagcacgccaaaaagcccggcgatacgttttaacgtgtcataggtgtcgctgccgatgacggtgacgacgccgttaaacacctgacgccacatgtcaccgccgtaaatggtccagacctcagtcattgcccgttccccactgatagttgccctgataggacgtcgagataatggtggatacctgctgctgcaggtactgcatgttgcgatcgatgccgtccagcgcgttctggtcggcggtactctgcagcttcatctgtgccagcagcgaggttgcagccagcacgttgttacgcagctcgccggccgcctgctcggggaagtttttaccggccagtgactggctcgcctgctttacgagttcctgcaggtactggatcatcatgtcctgcgcgataaagtcggcgacctgtatcaggtaggtcgggctcatgcccatgctgcgggagttggtcaggtatttcagtaccggcaccgaggtggtgttgatgaaacccttttctctgtccgacaggccggtatcggccgtgagcttgctgtcgatggaaatcatcaggttgcgcacctgggtcaccagcgccacgtcgctgctgacagtgacgctggccaccgtcggcccgaggcacagatcctgctcatcacagccgtacatcttcgcggtgccgccgcgcatcagcacggtaatgatgtcgcggttatcaaccagcggcgtcaggacggtgacctgcccggctttattgaagatgatggagcccaccacgctcatcaccagttccttcagctggcggttaccgtcgaacaggtggttgcggcccagcgcgtcccagatgaggtttttgtttttcagcacctggtccttcattttatcggacgcccggccggtgacgctgtcaccctgaccacccacggtgcagccctgccgcgacgccgcccagtcggagaaaatgttgctctcgccggcaatgtcctgacagattttctggttcgatacctgagacaccggccacaggccgccgatgatgccctgcgcggcctgacaggagctcatgttggcggagttcacgtccgaggcgagcttctgcagaaagtctttggcctgcttgagctccggcaccatcgtctgcagtgccaggtcaaaggcgtagcccgccgcattactcatgatctgcttaacaaagcgctgaagttcggccccgttgatataggaaaaggcgcccagataggagtcaatgccgccgcagccggcgttgagtgacggtacctgcatcgagatgagctgcacctgtttgaccgggttacgcagatagatggagccgccggtaacgtagcctgcggcctgaccctgccatgcctgcgcctttgagacgttgccgtcaaagccgaggctgccaaagtagccgttcaggtcgccctgtacgtcggcaaaggccggcgcactcagtgtaagtgcgaccagagcgcctgttaggaactgacgcagattcatgatgttttccccgcctgcaagtgtgtacgttctgtcattgaaaactccgttcattcataaatccgtgccggcgcagggtgatgctgaccagcacgccgcagccgaagccaccggcaagggagagcaggaacaggagcgggtacagctgcagaccgctgagcaccagcgcgtcagaaccgtaagtcatgccgtccatacggccggcaatttcgcaggcgagccaggcatacagggcggcggcggccagcagcgaggcgcagacaagcagcagcgccgtctccagccgggagagcgttaacgttttttcagtcatgggttttccgtcggcggcacagccgcccgtattactgcggggtcagtgaggcactgctcgggaccggacccagcgtgtccggcgggaggttatcgatatcggcttcgatcatctgcgccagtcgctggctcatggttcccatgtccgtcaccccctgaaacagcgggtaggccacgttggtgttcacgttgaccataaaggtggtcggcgtggcgatgggcagcccgttgccgaagaaggtcaggatctcaccggcaatcggttcattcggtcccgtcttgcgcgggataagcgcaatgggaaaagccgcatccccgtagccatcaagcgtataggggtacacctttatcccttcctcatcagcccaggacttcagcagcgggtcaaacttcgcgctgtactgacagcctcgctgcataaaaaccaccaccgcatagtcgttcaggttgacctgacgtccgtcggtcagggttatcattctgggcggctttgctgacaccgcacgcacagggcgcgtcccgggcaggccgaaatccggcaactgcgcaccgcgctgccccttcgcctgctcaagcgcagcaatgtccgaggccaccgacgcctgtgcgaataccggcagcgtcagcagtatcatcagcagcacgttaagcctcatgatggcctccccggccgcctcgcgaccttcgccaggcaatcagctccgcgatgaggcccagcgcaaccagaaccagacaggctaccgagacgccggcaagcacgtcgtacgtgaagctgactgaccacgccagcagctggcgcaggcagttaaaaatgatgcctgacatgaacagtaagatgataagaggtaagcggttcatttacggactccctgagcgtggcggcgcagggtccgcaccgccacgccggcaataatggaaaacagtacgccggtgaggtagaggctacgcagtgtactgtcagtctctgttgcccatgcatcacggctctctgccgccttcacacacgtggcaggcggggggacaggcctgatatctctgctgaccggtacggccttatcccatgatgtatcaggaacggacggccaggactccacgcgcgtggcctgcgaggcgcaactccacacctgccctgccggagcatcgcgtatcagcctttcggcctcgctcaccagcagatgcccggcgccaccggcgctgtgcgcgctgagcaggaacagcagaaaaaacagcagcgccggatgaatcaccagcgtctgcagcagaaagttgcctgcccggtttgcggtaagcaaccgcccgtgccagacaggtgagagtgtcagcataatcaggtcctcagaagttaggcttaaagccggtggccacattgagaaagcgcttcgccaggtcgtcctgcgtcataaaaccgtaggcgagcggacggaagctttttgacttggggtcaaccagaaacagcgccggatagtgcgtaattcccatgcgcgcgctctggccggcgtccggccggctgtcgggcacctgcggcgacaccgtgccgtccacgctgaccggtatcagggagatgtgccgcaggcgggcaaagtccgccaccacgccggccatctgtgcatcaatcgggtcaccgccgcggtagaagtagaacagcccgtactggccggaaagctgactgatggcctgcgtctgctcctgctggtcccgtgcctgctgcagcggcgcggtgctgttgtagtgcggatggtcaaggttatagtcgagatccggatggtcaagctgcgccacggcaaaggactgactgaacatcgaggcccggtcggtccagaacttctgccagcgcaggaacgtggcggtatgctctgcagacggatggaggatggcgttgttcagcgcctcctttgtgtacgctttaagtacgtccgcctgctctgacggtgacagcctgctgaagtccggcacctgcggcgcgggctgcgcttttggtgccggcgggtcaggctttttcttcggctcgttgtaccagtgccagccggtaaacgggtcagccggcgtcaccaccgcgtcagcagccggcgcatcgtccgccaccgcctgtccggcgcacattgctatcatcaggctaatcagcagccgcttcattatttacctcctgtctgcgcattgacctgcgcagctatacggtcttttgcctgcttgatcatcgtcgctgagtcagggattttctgattggccatgaggtcgctgtagaagtcctggaagttaatcagatcaaagttaatggcctgcagttcaggaaccgtaatgccgcgacagttcggtgagtcaccgctgccaaagctgacgtgcagctgatcgcggcgcccctgctcctggataatgcgggcgagcttgccgccgaacacgcaataggcctgcttcttctgcacgcacacccctagcactgccttgttgcaggcttcgccgaccagaacggtaacctttttagccttcgctttaccgatggccatttcgtcactgttacagttggccagccccgaactgttcccccagccggtatcaacgcagcagtttgagaagccggccatcgccttgcggcaatagagcgcctgtccggtaaaggccttaatatctatctgatcgccgttcttgacgtcatcgccggcagaggcaagtccggcaagtttggccacggcggtatcaaagccgctgtcgccggcaccgtcggtaccgttgcagtcgccgctctgacagaggtattctccgccgcacagcaggccctgcgagctgtaggtggtctggcactggtaagtatcctgctcatgcatgcacgttccgccttccgcctcggtacagccgcggccggcaatggtgcagttgcggtcagacatcagctgagcgcagttaccggtggagttcaccggcacgatgtagctgtcctggtactgccagcagtcctgcgtctgggtataggtctggccgtcggaggtaacagatcgtgagcctcccgggtcggtgcagacgctgccggtactggcggtggcctgggatttgtcaaagctgcagctttcggaccaggtcgtgtcggcctttttgtcggacacggtcacgttaaacgtcacgtcgaggtggaacagcgtggtgccgttattaatgtatttaatgagcgtgttaatgacggaatcaagtcgggcccctttaggggtaatcacggcagagtaaacctgacccgcattaacctgctgtcctgcgacacccaggctgtcagcccccttgccgtaccggagcgtgacattgttgttcagtatcgaggtgacataatctgccccggagttataagacggggccggggtataaaccagctgcgtggtgccgctgacgagcgtggccgtttcaggaaacgtgaaatcgaccagtatctgattgcccgagcgccgtgcgttcttgagcagcatattcatcgtccgggtttccgtgtggcttgagcccgtgacgataacgctgccggtgcgggcacaggtctggacctgcgccacgtccctgtcgcaggtgaagttttcaaatactgacttcgacacgactttcgcggtgcactggctgttggttccgtccacgatggaaccgctgttcgcctccgcattcttgccgttctggataaagtcggcgttagggtcaatcgtcacggccggattcttaacggaagaatcggtgacggcctgccccgcctcattacttccaatctgagtctgtcccttatcctttatcccgccgtccccgccctgcacgccgccgtaataccccccctgcggaggactggcggtgtagcccgggatcactgacgccgggtcggtccccttcgccgcagcggtgccctgccccttatttgagccggcatatcccgcacccgcgttgtaagcatcactcgtcgcatcagcgaatgcgccggacgccatcagacataaagaaagcagcagggcacgcttcatttcgtaccctccgcatcctgcagcaactgcgcggccgtactgccacagtcaccgcgctgcttaacctcttcgagcgcctgcttaaccggcaggctgccatagatgacgtccgactgactgccacaggtaacgacgagcgccggcacggccctgatgttgtatttctcatacagggtcgggtcgatttgcaccccggcctgcttatcttttttagacagttcaaacatcgtctcagcggtctgacggaagtcgttgttcagcaggccgcgcagcgtggccggtatgccgaagcggcgggcgtccgcaagcatcggcaacagcccctcctccgggatacccaggctcacgaaatacacagcccgcggttcgggacgggcggcgctgttctgatccgcctgcgaggcggcaatttcgttctgcagctgcgacacccgttcctgctgcgcatccggcagcgtaatgttcatgcccttcagctggcttttgaacagctccaggtcgcgctgctgctgcttcatatacgccatgtcattacctgacacgaccggctgctctgcggcattcgccatttctgcgcaaagaagcgcggcgccagcaagcagcgccgtaatcagaggttgtttcatggtgagtccttacagataaacgcagttacgctttcgccacatgaggtagccgaagttctttttcgtcgccggtgagttgtgtaccgagccccagagctgggtcgtggtgccgaacgggtggcagtcattaggttcggggtacatattcaccatctgataacgccagcgtgatttcggaatgattggggacggatactggtagcacacagccacgtccgccccgaccgtctccatcaccagtccctcccggtgcagcttgaaggccatgcgctcactgaccagcagcgaggcttccagcggtgaaaactcattactggtgaagcccgtaaacggatacatcgaaccctgtgcgccggcgcaccagaacagtgggtccagcggcacgcccgccgtggaggcaatcgagtccgccgcacaggcgccctgcgccagcaggttattgaacaatgccacttccgggttcaggatcatggccagcgtgctgtcgttccacagcgggtcaacctcggacagataggcgatgtccatgtcgccggtctgcatgcagcccgtactggtgatgatgttgagccagtaaatcagcggatatttgtaccagtgaacgtgatagaagctgccgggagtgggtgagtcgctctgcccgccgcgtccggcaccggtgcggccgaggttaattttaaagccgcccatgttcaccatgacgccgggttcgcgcgtcacgtccgtcagcgccagcggctcccaaaagccaatggccagacccagccggtagaaaataccgtagggacacatctgaatcggcgaggcggggttcggggtgtccggatgcgcacctgatgcgagctggatactgcccagtgacatcgggaacagacacttccagcagacgtcgctgatggggtttacccagcgcccgtcgccagcgttgctggtcgctgccatgacaggcttcgccataacacctgccgtgagcaggcacattatgaggagtaaacgtttcatgagcctctgacctctgttttacttcgaagccagacacatacagggccgtcatccgtgtcgtgaatgctgccggtaaaccagctttcgcccgcaggtgcggacggctcccagcggctgcagtcaccggttttccggaaggcctgcatcatccagtccggcgcgtcgttttccatccaggtgaaggcggccgccaggttatgtgcggtaagccagacttcaaactcgccgggctgcggatattcattgccgtcagcgggcacaaaaaattcaggatgtgtccagccgccccagcgatcgcgcacgaccggctgagccgatatttcagcagggtgtgtcatagggtgagattccgtaaagatggcagcggaactgccggggtcagacgttaaacgggcctgcctgcggggtgcaggctgaggcgtaccgcagcagcgcgaggaacgaacagcctgcgcactgcgggcagaaaaggcattcaggtggccgcagccacccggggaggatttacttcaccgcgcggcatagcctgccggtgatatcgtcgagctcgcggtcatagctggcacgctcggccgcactcagaaagccctgctgctttacgtagccgtcagcatcttttctgacccggtcagcctgctgccacagctgttcagactgcgcttccgtcaaatgacgcgccttgcgggcgttaccgatatcggcctgcagcacattaatgcgcactgatatgtgcgcctgaagcgggtctttaatacttccgccggtttcccccttcacgtcatgctgagcctttacgtcacatgacggccagtcctgcgtaaatgacgaagccgcggtggcatggccggccgccagcagtaaaaggccgaatgtcatttttttcattgcctgtatcccgttgtgtgagtattcacgcgcagaattatagaccagccgctgtgagccacggcaccgaggcactgcatcccgcgtgtcgttattctgtcgactcaggaccgtggtcgcgcctgacaatgtaccagccggccgcctccgctccccgcagacagtaatcggtccagctgccggtgtagtcatcctgttcggcctcgcgcagcatcgcctctgcagcgtcgtcactctggcgcgggttcagatagcgggaacgcgcctttacgatggccacacctacccgggcccggacaggataaggcagcgggacctttgcccgcggctcgttgcgaagcgcaaagccctccgcctccagcgcgtcgccaaatgctgtcagcatgcactgccagtagtggctgttcgcctcatcagctgccagtttcgccatctcgcgactgccaaacggtgccggagatgatgagacaaaagccacgcgcattgtgtccggccgctcaggattcgttctccttcctaaacggacaaggacgatggccatcgccatgaagacaatgaaaccacccacagccggcaggcctgatgtaaacgcgctgatgctctcgggtgccagtgtgatttcggcacgacaggcaggcagaacaggatcagtccataccggttgcatcaccggctcagcgtgcagctgaacgggtgaggcctcggatgacgacgcagaatactgccagtcatttaccagtctctgcacaagatcatatggcgtgctatcactcatttcagtgccacctcctctacccggagcatccggtccgcgcgcgtgatgcgcactggcgtatgctcaaagccgaatttcgttgttaacgtgccgtactggtcgaagtacaccggctcgtccagcgcgatactgctgtcgtgcacgttgcccttcaccaggatgaccttaaaattctgttgtcccgcaagctgcggcttcagccacgccatctgctgcggattgtcaccgtccacgaagtacagcgtctcgctgaaggcaattttatccagcggattaaccctgtcgcctgcccgggcgatgacgttgccgcgcatatcgcggatggtttcccgcaccgtaaaggtcgggtcatacaggaacgcgcggcccgttttcgccggcgtcagcccggccaccggtgccggacggacggcatgggctttcacccgtgcctccgcctcacgctgcaggcggtccatctcgccgctgtcctccatgcccttaaggcgctgaccgataaaggtcagcaggtccggctcggcgatcgggaacaggtggccgatagtgccgagctctttcgcctgcacgggctgagcaaccactgcagcgagcagaacaaccgctgtggcgagttgcctcatggcgccccctgcatctgccgggcaatatcggcctgaatgaccggggtgatatcggtgacgccggcaaccaccgcgcccttcaccagaacgacgccgccgtgtgcggcctgccagtcagacaggctggcgtccagcgcggcgccaaaacgcttcgtcagcgtttccagcgctcccttttccaccggctgctgcgccgtctgctgccggaacgtgtcgatggtgcctttcatgtcaaacaccacataatcgggctgtacggccctggcaaccagcgcactgacgccggcgcttgtcgcgatgagcaacagagtgaacgccgccagccgcacgctgtggctccgcatcagtcgcgcagccgctgtcatatgagcgccgtcacttatgttatccgcggtttctgtggccacctgctgaggcggctgtctttcttcctgcatcgttaattcctcttttaagcagtggtcagtccggcccagcgctccagctcctgcatctcggcctggtacatgtacggctcgcaggccagcaggtaggcagcttcttcactggtcgccccggccttctgcgcctccgtcatgtactgatagtcttccccgcgggtgctgaacatggctcgcgtgaccgggtcaacaaagacgcggtggaacgagctgttttcgcccgttgagatcatcaccgagctgaagccggtatcgcgcgcaggctggaacccgcggataacctgcgtttcaacctcactgaactgatccggattggagttaaggtaggttttgaaggccttagcatcctgcagcagggtcactttggtgcccgaacagtcccatgccgccgccgctgccggcggtgccgcctggtctttggtgccggtaaagtccttgatgccctgcgtgatggtgatgaatgccccgcggtggcggcgaaccgtacggtagccggtttcgataaagcgtgctgcgtgcgggttagagccgctgaacaggcgccaggcctcatcgataatggcgaccttcttcaggctgcgcggcgagtggtacatcttttcctgaatcgccagaatcagcgagtacaggatggcggagagcaggtgcggctggttctccaggctcagcagctccagtacggcaaagcgcgtgtcgccgtcgagcgtcggcttgtccgagttgaagtagtcgccgttggctccccacgtacaccagcggtccagcagcagcaccagctcgtttatgcggttcatgatggtcggctgctggccatattcctctttcaccgccgccgacttcatgtaaagcaccacgtcatcgatacgcgcggtgttctgcttcgattcgtatgccgccaccacccctttgagcaggatggtttcgctgaccttatcaagcggttcgttagggctggccagaacggtcagcaggccctgaatgccctcggcggattctttaatgtcccgcacgttggcgaacgggttaaagcgcagcgtcgcgccatccagataggccccgcccgcctgccggcagaagttcttatagctgccccccatgtcgataacccagccgaagccgcctgcgttcagcacctgccgcaggatttcctgtatgaagaagctcttccccgccccggtggtgccggtcaccgcgatgttaaagttggtggccccgttgctttcgctgaacatgtcaaaaaaggccagcgcgttgcgataggtcggcagcgggctgcccgatgccgccatctgccgctcggccacgaccggcataaggttgacggcgttgaagctcttgcagcgcagggtggcattcatgtgcttcatgtcgtcccacagcccttcctgcatcacgaacggcagcgaggtcatccagttgcgcagctgctggtaacggggggcggacatttccaggtcatttttgcggaacacgttgatggcggagagttcacagcgctgctgttcgctgtcgctgtcgggcgtgaacagcgtcaggttgaggttaaagctgcacatggcgatttcgttgctggcaagccccatacgcaggtcgcgccactcctcataggtgcgctgcgtattgggaaacagcttaccgtaggaggagttggccttcttgcccatgtcctgctctttgcggaacgcctcgttctgactgctcacctgatcctccacgcagatggtccagctcaacaggaacggacagggaatacctaaatccgggaagcgcatgttctgcaggttgtccgccgcctgccagagtgcaaactgcctcggcaccttcgtcagctgcatgttcacgatgcgcgtgctgaccaccgctttatcgccgctgtcgctgaccgcccggtcaccctgctgccgcgcggtgatcagcttcaggtgatccggatgaacctccatttcggtactgttatccacgcactggcggtgcagctcctgctccgggttccagtgctcgctgccggcactgacctgccccggccggtaattcagctgctcgcggatgacggataaaaactcattcggtcccacgcgacgcgtgtccatgtgtgcggccagcatcgatacgcggagcgtttcgcgaacatgcgccaccgcgtccatcgatctgataccgccggtgccggagtgtgcgtacaccaggaagacgcggtagttacgcaggtacagcgggtattcgcgttcgttggccagcccctttagcgccgaccgttcccagaaggctttggtgatggcgttgaggcgcggcgccatgtcacccttccacatgtcccggctcagcccgttttccagcatgtcgcccacgcacttgctggccaccatcagcaccgtgaccggcgttttacggggcagctttttgcgcagcaggtcatcgagcgcttgtaccacctgctgatttgcgccggcaagcggcgccacctccataatgaagccgaccgagcggctgttgatgaacagctcagacttctcatcaaattcgcgccacggcagcaggctggtcagcgacggatagctgaagctctcctgcagcctcttgcgcgcctgctttgcgccgccctcatcccggctgctgctgaaaataccggtgaggtgatcgataacgttactgagcatgctggcctccgacgcgctctgttttcagcacggcctttatcagggcagggaagagtgcggactttccggtaccaggcgtactgtgcgcaaagacgtgtccgtaaccgggcgcatccgcgaacatcagcccgggccggacccggtgatgcagcgctgcagcggacgatgcagattccggccgttcatgcgcgctgctgaatgaaaaacgctttttcattactccccctcgctgattacgcgaaagtcttcgtcccagcgggacttctctttcacgaactcaaccacggcaggctgatgaaagctgtcctgctcatccacccagggcgcaatccacagacgctgcgtcgcatccgggatgcggcgggcgtccacctggcccggtccgctgtagtcacccgggaccacaggaccggtggcaccggtacggaccggcaccgtggatgcccgcaggctgtctgcggtcgcgccctgccctttcaccgtaagcggggcaagtgttgccacgcttaccgagcggtaagggctgacggcgggcttcacgttgccgggcgtcgccagcgcctcagcggcaggctttgggccggcctccttagctgccgtcaggtcgtccaggctctgatgctttgatgccagcctgctggcatcggacatcgacaggcactggtcggtcgcggtcttattacagtcaaaatcagagttcatgccggcgcagccggtcaacgcagcgcacagcagtgcgcacgcaaaaagtttctgcatggtggagtcctcagtggcggccgggccgcaatgggtcagggagataaacgtgcgggtcaatcgggtggtgcaggttgccctggtgaaggcactaaaaaacgggttcagccggtatatttacctttcataaaggcgttgaccgtctgcaggtccttaagcgcatcctcgctcataacacgggggctgctggcagcgtgtatgttttttaccggcgcttttgtttgcgtccagatatcagcatgtagcatgccgggtgaaacctgacgaatgacgtcagcgatgtatgtcgcaagctgctcaatcgtgatatctgtgaatgcgggtatgtatccgaaattctcagccagcgggcgtattgccgcatccggaaccggtcgggtgttaaacctttcaagccggaacagcatattgccgctggattgccgcccgtctttaatccggatcaacagcgagtccggagcaggagtggtttcatcgtggaccattcttagcctcgttaaaaatcaggttttgttgagaaaggcgcgcatggagccgcagggtgccctggtgaaggcggaagtattgtttgtagtgttgtgcgatagcagtcccggccggcagcataggctcagaactgtcttcttattatagggggactgtcagcgggatacgtggaagctgatttaccgggtttccacatgcggctggctgacggccagcagacgctgatccacccatccatctgccctgcaggtcgctactgccgaaaccgtgttttccggagtccagtttagtacagcagcattattttcatgtacgctttttacgtcgcccagttcgcagtcgggttgcagaaccttgccgtgacgtacggctgcaatcacaatcttcgcaggctggccatttataaaggatgccggaactgaccactgaaaactgacgtcagactgctcagtaacaggtggtgtgttttcactgttttcctcgcggagcctattgttaatccattcacgatcactggatgacagatcatgctggctcagtaaccagatcaggcctgccgtgcccagccagcctggtccgctggcttccttttccctgatgatggtctgaagctgaggagaaggttgtggcccgctgcggttttgcaaagactgaggtactgaaggtgaaagttttgctccggctgacctgctgtcagtttctgcccgttgccgtactgcttccggctgcgggcctgaagctcttataaacaggtgtactgcctgtgacggagctccggtaagccgggctgcgagcggcataacctgctgacgacttaaacgatgaccgggaagaggaactgcccgccataaccggcaatgactgcaaaaagcaaagcgcaataagcgcgcctttcagaagatatttcatttctcctcccagctggcctgcccgttcacggtgatgatgcttcggtcctgcgcgagagactgaatgcgtaatatctgtctcgggcttagcgaagcagaatcatcatatgctgccaggctgctgtcacaatctccggtacagcgaagccgccatagcagtgcgctggcctcatcatgctgctcactgtaaagccggctcagactggctggcgcctgtgtgtcatatgcaagccacgcccgggcaaaaaaagcagccgcacggacactgtctttctgcacccatttaccgagttccagaacatgagccgctgttgcaagtatttttactgaggctcggtcacccgatgaatgatcggccactgtaatgagctctgcagcaaatgctggcatttgtgatttcagttcggccggtggctcatcccgcataaacagatcggttaaagccgcataagagtgctggtctaacgctttgcgatagagcgaaaccgagaggttgcggtagtcagttttacgtttttcagaacaggatggtaaaagctgtttttccggacaggctttttcggcttcagcattcagttgctgccaggcctgccatgcatcagggttctgctgggctttggtccggatggcgtcgaactctgctttttgattgtcacaggccgacagtagcatgactgacagcaacataagcatttttaaaactctatctgttaccacaactcttctcctgatgatgtgtggcctgactggaataccggatagcaggctgagtatggtcaggcgcagtcctctcatccgttcaaagcttcaggcccgggactgtctgaagccagacgctgacggaccgactcgatttcggtcagcatagcggccagcctgcagctgctcgcctgcgccagccaggctcgctgataacgaagccgcagtgcgcagagccggatacgcagttcacgctggttatgttcactcatgattgcctccgcagccggactttcgttatctgaggttaagcagcacgtagaacagcgtaaaaaaatacgcgataccggtggtaaagcccgccatgaataaaatatctgtggggttgggtaccggtaccatccagaaccacacgctcttgacaaaataatatgccgccagtatcagccagaacagcgccatccccccgaaggtcatgaccgccatgtccctgaacatgtacgccagcagaataataatgggagacgtgaacagggccagccgccagacctgccagccagggaagcccgggaaagcgggcagcccatcacgcatcgtcagaccagctaggatgaagttcaccgccagcataactgcaaccagaaccacataaacgtgaaccctgttatccggatgacgccagcgtttaatcagccccttcatgctgcctcctgcccgtgtgttgacgtcctgcggaactggatgttctgagaccggacctttttgagatcaagttcaaccagtcttcccataaggtttaggagaagcattgcacgctttgcgccctgcggctcatgccagatagcttgcatgttttcaaacgtgccgtttgttatcagaactgtatcgccatgctcaggcgcctgcatgtctgcctgcgcagccgactcagctccccgcttcatgcgctccatttccgcatcacccattattgcgatgcgattgccaaagctgactatggttgagactccgcgcgttgctttaatagtcgttgtgtgaatctcttcaggatcgaatcgcgcaaacagatagccaggaaaaagtggttggggtttaaccggtttaatgcttcccccggcaacaagctgacaggtgaaaagcggaaggtaacattccactccctgattgagcagatgggcttcggcgcgtttttcctgactaaataacgacttgagtacataccactgtttcatctgtcatctccttaattaatagtatcgccgaggcgcagctggctggcctgacgcagaacttcgtcaggattcagaacaggcgcactgccattactgctgctgactgccggtgcagttgctgaggcctgctgcacggcggcctgcggagcctcctgcttcgccttttcagcttcggcatcctcaatcgtttccagacggaagccctgctggaacaccaccgtcaccgcattaccggcgccgatatcaatcaccgggtgatactgctcggcacgtttaatccagtactgactcagcgtgtccgccgccttgctggcaccgccaccgagcccctgcttgaagatgtcaccggcgccaactgaggcactgccacctagcccgaccgttggcgtggcggcagactggataccttcaccgaagccggacagcaggccggcggcacctgcattggcgacaatggcgccattacgcatcaccggcttgccgcggatgcccaccttgccctggaaggacacgtgcccgtcgaacggcatatcgatatgcttgccgttatccaggatgcagctgatgtttttggtgcgaacctcgccacgctcgctggagatgtcaccgtacatttctccggtcacgcggcactggtccatgttccaggtcttcccgttaggcatggagacctcgccgagcagggtgatgaccaccggcgaggtattctgctgaccggtcacgctggcgttggcgtcagcgccctcaatcatcgtggcctcggaaaaggagccggaaggtatccagggaagctttgtctttttctcggtaagcgcagcgtaggtgaaggtttcacggctcagaccgctaggacgcaccgtaccggtgccgggataaaaggcctgcccctgcggcgggtaaaactgtccgccctgccctctggccggtccgctgcccggactgttgatgctccactgcgccggaccggactgcccggctgagaccggtgcattaactggagtggtaccggccgccggtgtggtagcggcaggaccgtttgccggccggcccgcctgctgcgtctgcagctgactgattgcgtctgccatcgtgttgagcttcttctgcagctcctcattctggcttttcagtgtgccggtaagcgtgccgaggtcgcgctcaaggcctgcagtcttgttctgctgctgctgcagcgcggcggtggccaccccttcggtaaaggacgtattcaccaggctgccggtcaggttcggtgccgcctttggcgcgggacggttcagctccgcctggtggtgtgagtacgcccagatgccgccacccacggccagcatgaccgcggcggccacgccggcaatcacccactggcgccggcgcgtggcggtgttgatgttgctcatgacccgccctccgcgtcagtggagaaaatcacccacacaaagccttcgccgtttgcatacagggtacgggttgagagcattaccgcccgcacgcccttctgccagaactgtttttcactcagcgtccgcgtcacgtagccggtgtttttcatgcggtatcgcatcacccgcagatgggagccggcaagctggcgctcaggtgtcagcagcaagcccgcaggcgggttatacgcaggaccgcgcgaggccttcacctcggtgtaattctctggcactccaccactgacaatgctgcgcgcaacgcttaccagcgttttctggaagggctgactctcctcccataccttcgcgtccgggttgggcttaagtggcacatccgccggtattaggtgcagcgtgcggccattcccgggtttgggtgacacgtcgatcgaaacgcctacgccgccggccgtttccaggaagatggtgaagtcctgaccggtctgtggcgtaatcagcagcgcgccgtcggcggtgttgcttttgaggtaggcattgtccggaccggtgatgccggtaatcagctcgccgtcgataatgattttgttaggactggtattactcatctgcgccttaagatgcgcattattctcaaacggggtcccggccgggccgggtacggcggcctgcccggcggcaggcagcagcgccagcgcgccggcaacggccagggcggaaaggttttttttcatcggttcagtcctgttgcgggcggcgttcaggttgagtccagggcacctcggggaaggccgtcaggcggataaggccgtccacgtagtgcacgctgagccggtaggctttactggcatccggaagcgaaatgttcaggttaccgttcgtggtgctcgcgctcagcgtgccctgcacggtgatgtcaccggtggtggagtcggtgatttcgtcatcgatgcggaacacggaagagacgccgttgtttttgatgtactcagcttcggcggcgagctgctttttcatgtcgtcacggtattcagcgggaacgaagcgcagcagggcggcgtgctggctgtccacggtttcaggcgtgacggaaaggcggaggttgacgaaagagcgcaccagcatgccgtttaaggccgcgtctccggaagcggaatcggagataaacgggcggtcaaacatcatcggggtggtcagggtcctctgcgtttttgcaaaatgccacgccagcgcgccggtaacgacgttgctgacggcgagaataaacacgagcagcgaaagtgcgcacagggccagaatgattacccggttgcgcccctcccggacctgatacttcatagcgttatccttttaataagcgccatccggagatggcgcgtgggttactgcatccagtgccggttgcccgagtcgggcacgcggcggaactgcagccggagcagcgcggtcggcaggtaccagtaaagaagattcatgagccaccaggtgccctgccccttcttcagatggcggactaacagccagagcgcgcccgccacaatcagcatcacaatgaacagatcgcagagcaggccgatgcccgcgcacgcaaggatgagcacggcctcctctgtagggagtccgccgaggcgtttctgctgattgagggtttccgggaactggtactgaagcgattccccgttcatgcgggattaaccggccagggagaagaaggtgcgggtgataacgatgaggaaagccagaccaccgacgaacagcatcgggttgcgcgttttaatatatgcgccaatcgagatgatgatttcgccgatgtaaaacccccactcaacggtactgccatgaccgaacgtgtctttggcatcctgcttctgcgtggccagcaggtcagtagctcctgcaaaatgtggcaacgcaaagaacagcattgcgagagctacaagggttacgtttgcgcgatgctgataaccttttttacaggcagtacggacaagacctttcagcatttgtttagtagataaatatttaccagagatgggtttctggcagacatcagacaatgctaccgccacgctatccgttttatcggaagcgaaagtcgaagtttgcattatttaatcctcgaacagaattaggttataaaaaacgactcaccatttttaaaatggcgagcagtgtcctgcaccggtaatatctgatgcagtctgaaaaaacatttttaagcgaatatgatttttggtctcaaaataggctatatctatccacctccttatatgcagtaagttacagcagcgttacatatatagatttaaatgagaggaatgggcggcgaaaagactcaaaaactactcacaatcagtggcggattcgaatctccgaccggtggcggctaagtcggaaaatgatctgagtgagtcttcaagtctgatttttgcctctcgtgttttacttcttcctgaacgcttcgatgattccactaggagctggttggtctcctctgacaggtggactaaaactgaacctcccctgatggattttgcattggccataaggcgtctcttatgtggctaaaaattagtaaaatcagaaacttagctactcaagcttacttcaagtcgcttcgtttactgattaagaacctttactaaacaactcaaaagcaactcagcattgatgtgtttctgtaaagaattatgcatgtattgaaaagtatttcgagtagtttttgagtattttcctatatagttattgagtttattgaaaaactctttattaaacagagcattacgggatcaaaaaacccttcaaaagatactcattcgtgtatcatcttttgtttaacccaaattctttagtcacggcgttaactgggtaaaacgtaaccgatggacgggagtagactttggacacacctaataaaaacctcaaaaaggtattagaacttttagagcggaaaggaatcgacaagaggaagcaggcgtcaacaatggctgatatcctcagcattaaatatcaaagcgccaaacaaaagctcgatggtaaaagaggtgttttctacagcgagcttaaatctatttatgattattttcacgaatcgcttgaagaagctaagccgtataacggcatattcattgttaacgacatgcatgtaagatgtaatattattgtcagtgatgaaaaggttgatattaaagagccaggcattaattatgcatactttcataagaattattatgtagtaaacccaacaggcgtaaaattcagtaaagacatgaagcgggtattaagaatggattttttacctgcgcctaaactggcaatactagataacgataaagagttactcgaattattaaaatcagtatcgaacagatacggtattgatgcatcggttttcgagaccgcacaagaaattgtgcaggcggtcgacagagaagattatgatggatatgttattgactggttactggactacgacgaaaactctgaagcagtcatcaagaagatccgctctaaaagcgagaccgtgccaataatcctgcttaccggacaattgaatcagcatgagcgagagataggagaaaccatcatggaatacggagttgaactggttgaaaagccaactcgtgtttttatactttcctcaatattgctggcgaacctcttcttttaaatggtactgaaatggaattaattaaattaacggctgaacatataaaagaaatgtacgacataaggttttctgtcgctgaaaaccttgtccatgcacatcagatcgagtatctgcagcgaaacgtaattctggctgacgtcgcacagggtggcgggtggatctgcaaaactgacgatggctatgtaggttatggcctcggcattcacataccccatgcattgataggtggtctgtttgtacgaccagagtaccaggggcgcggagttgggggagcaatactggaaaaaatcactgagtggttttttgaactgggagacactgagattgaactaaccactgatgagcactcatctgctgctcggtttctatcaagcgagaggctggcacagttgcggtcacgatgaatatggacagttgatcatgaagaaaaggaaaatgaccaaatgaaattacttacagcgcttctgttttctctgatctcggttaaagcagcatatgctgactcctttgttctggcagacggcagtaaagagattcacgtctctactgaggatttggtcaagctaccagtaacttcaataaccacagccaccaatttcacaccaaaagctacttttgagggcgtgaccttcacagaactgctctctaagtactcgattaaagcatcatctctgagggtctacgcccttgatgactacagctacaccctgccagtgggagagcttttaaaatatcacgttatcctggcataccggaaaaatggtcaagtgatcccggtttctgaccttggaccctttgcagtaatctaccccagagatgagcatccagaactgaacaaattggaagtgaatgccaaaactgtctggcagataaaccggattgaggttattaaatgaaacgcagggtcgttcccgtcgtacttggcttagtactgactctttttttttcaggttcagttttttttactgttcagaaattcaacgagattaagaatcagtataagagtattgagccaaaccttgataactattcgacggctgaaatcctcttcctggcatttgaaagaacccggacatctgtttaccagacagaaacccctgacaacttcgaaacaaagaaatctgtctttgactctaaagttagaattcttaaaaacaaatcaatacgcataaactcattttattatgagccagatttccttagtgcacttaacctccttgaagagcaaagcaatgaactaagtaggcttaatgagtctacgccgcccacaaaacggaaagatgtactcttagagcaaatgaataagatgcagcctacgcttattaatttgcaggaaattatttataaaatccagataagaaactttaacacaataaaatcattgatactggataactcatcctacacagaacttgctgcactcttttgtattttccttctctttactttaatcattttactttgggttcatatcgttaaactaaactcagcgattagaggaaaaaacattttcatttcggccatttatcatgaattatctggctcaattcaaaaaatccaattatcttctgatatgatcaacgttaggggggatgtcttaaattcagaaaaatatcttgctaaaatcacttatcattcaaataagctttatcaacagaccaaagaaatacttgagttttctaaaatcgaaatcggtaatgttggtgtcaacaaccttaccttttatactgaagatgctttaaacgctggcttgtctctctacaatgaaagcaattctaataaaatagattgcagtgtatatccgcagaacactctcattaatgctgataaacaaaaaatcatatcaataattcataacataatagataacgcaaataaaaacacctatcacggcatcattaaagtacggcttagagtggcaaagtcgcacttctttttaagagtcagtgacactggctgtggttttgatactaaaaagctcaatcttctttttcagccattcaaccaaggtgtcgagggtgaaacacgacaggggctgggtctgggactgtcaattgttaaaagttatctcaaaacaatgaagggaagtatcactgcgcgttcgaaaataaatgaaggctcaacatttatgatcagaattcctgtaacagtgattgataaagagccttaagcgtcctgaaagaagtccgccacgcccggacttcttttccattactcactctcgtccggtttaacgaaatgcctgttatctgcatcgctttcggagttatctatttcagtcagatactggctcagcagggaatcaatacgctcagtgctccctcctcccgttgagttcacataaagctctgtcaccattgtcagtaatatcataatgccttctttactgccgctgactttacgaagcaattctcgattaaactctcgttgattaaacgtatcttctgtgtttttagctttgtgcataatcaggcctaacctgagtagttcgttacacgtggaagacaaactgacctcagcaggacttgctccgtttctgtatgtccagaagataaatatccctaatttccttctcaattttatctttaacgtagatacccattcttcccatctattcttctccagagtgtcttattttccatttaaaaaaaaactacggcttgaggcatctcatccagtacggcactgcagcgctagtctgcataccatttggtgcttatacaggtagtcgtaagcgacaccaatatgtcgtagggtgtgacactgtacgatatataacactatgattgaaatcattatcaacactcctacgatatgacatcgtagtaaactacgacaacaggtagtagaaacctacgataccatgtcgtaggaagcgacactactatgtcgtagaaacctacgataaaacgaactcacacaggttaatggctataaattttaataagtaatcatatgattttaaacaaaaaaactgcaagatgaaatcttgcgtggggtgtgatggaaattatcctatagagagcggcttgttaaataaacttatcttcctgaattctttatatccctgcccaagttcgtcatccacccctcagcgcaatgtgcgcgcctgtaacgaattaacttgcaagggaggatctgagcgcgtatttttcacacgaacccgcctggcgcattacgcgcacgcacgtgagattattaggatgaaattttttgctgctctcgcggctgtcgctgtattcagcgtgcaagctgcgccggaaatgtgtttcacaaaggccggtcaggatttcggtattgatccgcgtctgctgatggcgcattccattcaggaatcacatatgcgtaacaacgcactgaatactaaaagcagcggcggcacgcatgacgtctgcaatatgcagataaacagctctcactttaaccagctgaagaagttcgatattacgcgggaaagactgctgaaagatccgtgcatctgcatttataccggtgcatggatcgaggcgagaaacttcaggcagtacggcaggaactgggacagcgtcgggatgtacaacaccggcccgaacccgaagctaatcagacagcgtcgtgaatatgcggccattatcaaaagtatttaccgtgtgctgattgcacgggatgaggtttataccgcaatggcgcagcggaataaaaaagcgcccgcgccggaaacgtttctggctgcggacgtgatgcctgacaaaaaataaccccggcgcgccggggttattttcatgatttgagttttgcgaactcctccgccattttccacagcgcctgattcagctttatatcgccgtcgatgccggttaccggacgggtggtggttctttttcccttcgccgttctgccgggcacgccccccttaatcagattctcctgcacgatattaaacgcggtccacaggtcggtgcctttgtcataccaggcacgcggctgaataatacgctcagcggataccggcggctcttttccgtcatatttatattccagcgccagctgccccagcaggcggcgttcttcgctgttaacctgaatacctttcatcatgccgatattattttccaccttatcaaacacgcccagcacctcataagcgccttcaataacctgcgacacaatatcacctttgtgcggcacgctgatttcaccaaatgatttccagcacaccaggccattcgtgcagacctgccggaaaataccgggaatcattttataactgctggagccgtcatggctgttaagcaatacaatttccggcacctcttcgccgccgttgttatttccacggcgcaggcggatcatgtgtttggtaaattcacggcgctccggatcgcgcacgcgcgactggctggcaaaaaagggctcaaatccttcttcacgcaatttatccagcagggtaatggtcggaatataggtataacgctcagaacgcgaatcatgtttttcagcagaaaacgcgctcggaacaatgcgcatcagctcgtcgttattcagcgggctgtttttacggatagcggtcggggcggcatagcgggaagcaaaacggaccataattaattacctcttaaatttgagtgtcagcagtgaaataaaaaacggtttataaagcggccagcgcttcgcggaatatcaggtaaccggtgtcgtactcatacaacgccagcggccagccgttgtgcaggtaaacgatggccgcttcaggctcctccgtgggctcctccagcgcatcgagctcagccagttgcgcaccattaaccccgctgatgccggtgaacacgccgtgcctgtgcaggtgatcgtacagatcgcgaaactgcgccggactgagtgccccgccctgcttttcagcgcatgttttgggagattctggcgtggcggtgttgacgttgacgttctgtgtgttcatggcatttctcctgctcaggtgggttgtcatgtttcggtcgatccagtcgcggcagagggcaaaggagcaacggcaggcggcaggtgcaagggcgccgcaggcgtgcatttcacccttgcagctgacgaatgacggtgctacgaccagccctccgcgcctggactgaccggacaagcccgccgcgcgcgaaaacggcacgaacacaccccggacggctatgccggtccggtcctcagcggccccgtttcggggccagtgaacgcaccggcgaagccggttgcaggggttgcgtcaggatggaaacccgctggcccggaacgggtccgggcagagacggcgtgccggctctgtgcgcagcatgacagccgcccggacgcccggggagacagcatttcagtgcgtgggacagggcattgcggaacgccggaaagaaacataacgacgtggacgattcagacattactcctgctcatcgcctgacggcatccggacagcgctgaaagcgggggtgataacaggatgaaccctcagaatcatgcctagagatggcacctgcgaatgtgttcgcgttggaggcaggccggtgcgtcagcaccgtcttttatccggggccggacggccccgcggggttatgctgtgttgcccctgctcacgtgtccgcttcgcagccgtaatgctgtgcagccgaaaccagcagctcacagaacggcatgcccgttccgccacacaggtgcatcaggtcagccagcaagtccaccacggcggtggcggccggttcctcatcggcatcgaggccggtgcagcgggcaaaggtgacgagcgcggcggcggcggcgcctgcccggccagcgttgtctgcttcaggcggcatcccgtctgcgttctggtgcgccaggcaggcgaggtcagcaaacgtcatcgtgtcgtcagccatcagggaagtcgtggtgttctgcataatgtactcctctcagtcagggtgatcagggccggtctgaccggccctgcggcatcagatagtggcccggcgattccaggtggctttccagtcgatatagtttccctcgcgcagcggcgtcagcttcaccaggttttccgccagcccgttcatgatgaggatgcgctcaatcgcctcaaaccagccctccccgctgccgaccggaaaccacaggttagaattgtcaccgctgagcagcggatgatcgcagaagtggacgccccggccctgcggcgtttcacttcccgtcacgatgccggaggcgcgcaccttttcggtcagggcactgcgggccagccgttcagcgatatcagaccagcaccactctccgtccggcaccggcagctcagcatgccgcagcgactgaccgcccgcccgcgcggcaagccgggcgatatcggccaccccggcctctgcggtcgcgccgtccgcctcgcagatgtagtgcccgttgtgccagaaggattcggctccgttgtcgaggcggatcaggcagtaccgccccagcgcgcgggcgatatcctcatgcgtcaccggtgacgccgtaccggccggatgctgctgcacgatcatgctgctcatggctgcacctccagctggctctttacggtggtcatgaactgctgccacagcgaaaacggcatggcgggtacgtgtgccagccgtccgctgcgcagggcgtttacaaatgcggtggcatgtgcgacgatttgtgcgtcgaaaatcataattgcgtcctcgtaatactggttttgatgaggccgccagctcgaactggcgaccgtgaaaagagcaggctccggcctgctttttttacgcctgcggattgtcctgcgcacctcctgcctgttgtgtgacgtcagcggcaaggcggtctgccagcaggctgctggccctgccccatgccacctctcccgccgtgccgaagcggtcgtgtacgatgtggctcgccgctatccacgcgcggaatgagggcagcggcagcgcgccgtcccgtaccgtgtctgccacctgctgcgccatgtcgtgcagggtgaaccacaggaactcatgctgctcacgttcgctgaaccggctctgtgccagctccgtcagtgccttcaggctttccgccagctgcggcgctaatctgctgatcccggcgtctgctgcgttctgtgttttcattccgctccctcccccgctcacgcaatatccgccaggtgcattccccggcccgctttcagcagcattcccagctcgcggcaggccagccgccacgcctcttcaccggcgccgtcgcactggtcacgtaccagcggaccggcggcaagccacgcctgccaggccgtcaggggcatccgcgggcggtagcatgaccagtcggttacggcgttgcagacctgctcagccaggcttagcaggccgccgtaaagcagttctgcgcggtcatccagcgtcatgcgctccgtgcgcagcccggccagaaaagccaggtctgccgccagcgccggactcacgcccgcgagggtgtggccgttaacccatgttttgggagattctggcgtggcggtgttgacgttgacgttctgtgtgttcatggcatttctcctgctcaggtgggttgtcatgtttcggtcgatccagtcgcggcagagggcaaaggagcaacggcaggcggcaggtgcaagggcgccgcaggcgtgcatttcacccttgcagctgacgaatgacggtgctacgaccagccctccgcgcctggactgaccggaacaggcccgccgcgcgcgaaaacggcacgaacacaccccggacggctatgccggtccggtcctcagcggccccgtttcggggccagtgaacgcaccggcgaagccggttgcaggggttgcgtcaggatggaaacccgctggcccggaacgggtccgggcagagacggcgtgccggctctgtgcgaagcatgacagccgcccggacgcccggtgtaacggcttttgaccgtgcgggacacagcattccgggtcgattaaggggtctgtcgtggtgttgatgacgttgattttcagtaagaatccaggttttcatgcgcatacacgctgtcttttttccctgcagcgcactgcagggaagccatgatttatcctctcagacgtgaaaactgccagtgacagaacgggctgtattcgtcagccaccggcaggttctgctgcgcatatttactcagtcccccatgctcagaccagaacagttcaagcgctgcggcattcaggtcgccttcaaccttataaacgttaatcgtctggtattcagtgttctccgcatactcttcttcgccgatcggattagctgaatgcacgatccgcgtttcataagtctccggtgttgcgcctgccgccagggcatagacagaaaccgtgacctgcagtttttcgtgcgcgttaatcagcagcatctcaattcctgaacggaattttcccgtatgaaattccgcctcttcgcgcgtgaaggttgccgccatcaggaactccagattcatagaaaaatcgctacgcagcgccgccgtgttgacattgaactgcggacagtccgtgtaaaacagactgcggcgtaaagcgcgccgtatagcttcatagctgatctcttctgatggttttgccgtgaaagacgatgattctttagattctgcagccgtggtgttgacgtttctgctgtgacatgttgtgtctcccgtgtggtttatctgatgtttctctgagttccttgccgtgaaggcagaacgggctcgcgggcatcaggctgaacgcagggggaaacggcaaagccgcagcccgcagggaccgggtgacgccgtttagcgtgcgtcccttgcgtgaagacggccgcgtgccaggtttctgcacggcgaagggattcaggaaactaaactgaacgcggaagatgaacagagcacagccccggacggcggctttttgccagtccggtcttcagcggccccgttttcggggccagtgaacgcaccggcgacagccggttgcaggggttgcgtcaggatggaaacccgctggcccggaacgggcccgggcagagacggcctgccggctctgtgcgaagcatgacagccgcccggacgcccggcacagcagcattctgtctgtgcggcacgggcagaaatggccgttatgatcacgtattacgccaggaaataagcctgaaaaggtggctgctggcaccgttctgatagttactgttataaggagcgatgcggccgccgcgccgtcaggcgcgagtcctgccgcctgcgcgccgaaggcgcagggggttttgcgcaccaggagggtggcggcgggcctccctgcccggccccctttgttactggtttatggcaaggtatgcgcgcctgagtgccgcctgaatcgcgtccgtttgtctgcctgcgcctgcatccggcagcctgcccgccgcctgcatcagtatttccaggtcaccggctgaaagggtcaccagccggctgcgctgtccggcggcgtagcggatattatcagccagctcgcggagggtttcggctcccacgcccgcctcgtgctgcgcatccctgtcccatgtggcgaggtcacagacgatttcggcggcggtttccgccgttacgtgctcctcccccataacccgtataacgtcttctttacgccagataatcagcgtgatcttcttatcgccctcaaactgaattttcaggtcgttacacagctggcttacggttccgtacaaggttctctccttaccggggcggccttgccgccccgtgctgtcagatatatgtttatttgccgctctgctctctcagcagcgcgctgatccgaaagagcgccgccgtttccgccgggaagcggcgggcagatgccccttctccgtttctgcgcatcctcaagccgcatgaagtcccacgccactctgatcgccgtctcaagcgcggcggcgggcacggtcgccacgcgggcctgcttttcctcctcgcggatgttttccagcacggcctggagcgtttccagactcacgccataatcgtgctgtgcgtccagcccgctgatttgctgcacgatatcagcggcggtttcttccgttacgctttcgtcgtcaagaacggccagcacgtcctcttttgtccagacaatcagcgtcataagctcgtcagatttgtaacgctgtaataatcgggcgcagagttcgttaacggttccgtacatggttttttcctcttaagaggggcggccatgccgccccgtgatttatcagttcagggcgcagaaaatggcggcggcttcggaatgggttttcacatactccatcagctggcggtggcgctggcagaaatgcgcactcagttcttcgtcgtcgtggcggtcgtacagccagctgcgatggttaagaaccagcgccgtgatgatgatccccgccgcaccggcgctgatttccagctccgtccagtggtacggatttgaatacatgtagcgttcctcaccttccggcttcatgtatccgccgccgcccggcagctgtacgaagtcccagaccgtgccgtcatagttcgccaggtagcggctggcgtagaggtacacgttgttttcggcctgcgcgtaatcgtggccaaacagggaaggcagaaaacgcaggctgacaaaatcggccagaacagacgccggctgtaaaacgtggggttgtgtgttcatcagacatctccgcagtcagagggggttaaggttccggcctgtgccgtgactgaatgacagcccggcggaaagcgaagtgttcaggagcgacaccgcaggccgcagcgcaagcgagcgggagacgggattacgcacggcgctggcgcgaatttctgagcggcggcgcgacggaagtaagcgcggcggagcgagtgcgaacgggcgaggatggcgagcgaagcgatctcttgaacacgcagcggccgggctaaagtgaagtcacggcaccggccgcaccacgcacggaccgggttttctgccctgtcccgccgcatggcggaaaaaagcggcgcgcagcaacttccttatttcattctgtccacagtccgggtgcatagcctggcgataaccctgtggacaaaagcgcagcggcggcggtctccgcgcacagacagcaggcggtcataaaatgaccgccccgtccgttatttcaggtgcccgcgcatttcggcagcgcgccggtacagcgccaccagttctgtatcaatctgttcgatcagcatcccggccattttctgagccggcgccgcgccgcggaaaagatggcgttttgtcatgtcccgcagcctcaggtgaaactcgtaaagcgattcctcgaggtcgttaatgtcgtcggtaagctggtcgttgccggtcgtcagtgtctggtctgtcatggtggtgtcctcctggtctggttacggaaaaatacgttatgcggcatgagcggcacgggcggcgcgcagctcacccaggcgacgcaggccggccgtgtggtactgctccagcagttcgatcccgatccagcggcggccgcactggtcagccgcgacgcaggtcgagccggaaccagcgaaagggtccagaattaaatccccgggcttcgtgaaggtttcgataagcggctgcaacacgctcaccggcttttcggtggggtggtgccggttgcccgtgtactgccagggcatcacgtcgggtaaaggcttcgccggcagcggcgggcgccctttagccagcaggtaggcgctttcatgctgatacccgacaaatgccgatttcgatgcgtatgttttggtaaacacaaggtgcccgacgacgcgaaagcccgccgctttccatgcctgcataaagatgtccacgcggttccagccgtagaagctcaccgccaggctgttgtttttaagtacgcggaacatttcacggctggccggcagcacccactcgtcactcacgtcgttggcgatggaacggccggagcggtccttaaagccgacgaggtacgggggatcggtcagaatgaagtcgatgctgttatccggaaagccggccatgatctctacgctgtcgccacgcatgaatcgggacatagttatgctcctgagtgtcggggggcaccccagtggtgccgtgaccaccacaaagacgggcgtaaagcggagcaggcaggggcggacgcgcaagccgcacgcgccgccggagcggactgaatgtcccgcgcacggcggggaacgggtgagcaggacggcgaagcttcccttgcaggcgaagcggcccggctaccgtgagggcacggcactttatccctgccggtttccggccgcaggacgggaagcggcaaaagaggcggagcggagcgacttccttatcccttacagatgagatgccgccggccggggcggcatcggatgaaatatcagggccggtaatcttcccaccggcagtcgctgcggtcgcagatgacgggcgcatccggcgaaccgttcaccgtccactcatcgaggaaccgcaggccggccagcgtctgtgcctcacattcgtcaagcagaacgatgctcttcagccagacgctgccccgatcaaactgccagtagcagccctgagagcagacgggacgttccggcggccaccaggtttcccccatccgttcgcatgcggcttcggccagcgtaaagtcctgcccgctcagcagcaggtggtattcatgtgagtcgctgcccgcctcttcctgataactgaccagccagatgttcattcagtctccctccgggccttcacgctttctgcacagtcgcgcataaattcccagctgaggctgacgtcagcatccagcatcctgtccgccagttcgatcgctgcagtcacttcacagggcgtaagttccggatcaatgtcatcaaagtcgtccgccatccagacgtgggccacacacggcgtatccggggcaaatcccgacaggctggccatcaggcccgcaagggtgagttctcttttcatcattctcttcggcggggcttcccccgccgcctcccgtcagccgccataatggccgatgttgtttactatccagtccggcccggtcacgcacgtaatgccgtccccgtcctcatctccccactccagctcactgcagaggctgtcggtcagttcgccgtcgctgtaaacggcaaacccgcagaagctgcagccgctttcggcgtaccagtgctcagcctgcacaccgaaacgcgtactgagagcggcaaatacccggcaatccggcggagaccagggggtgtcaaaatccacctccagaaagcccggcccgcaatcacccacctccagtgcgtaccccaccggccacttcacgccgtactgcgcgatataaaactcatagccgcccggcacaccgtccagcaggccaccgttgaagccgttgatttccacatcgagacgggtgggaagcagcaggcgcatgtcaaactcagccgaatcctctgcagtaacatcgctatcgcacgtgcggctccagaattcgctcagattgctcccgctcacgcctgaccagtcgaaagacttacgctgccaccgggcatccattactgccctgacctcatcatccagcgcatcccacgtgcggctgcggagtccggtggccagccacaggtcatgcagccggtcacaggtttcgtccgtcagttctgcgccgtcgcgcagctgcgcgagccactgcgtaaaggcgcggttttccggcgaatcttcgccctgccccgctgccgtcagcgccgggaaaggtgcatacgtttcgttcgtcaccgggcgcagcagaccggcacagcccgccaggaacagctggataccctctctttccgcccgcgcatatgcaggacgcacctctccccgcatcagcgcccgcagctgactcacattctccgccaggccggtcacacgcagcctgtttgcacaccagttcggcatggttctctcctcagtcaatggttgcacggcctcacctgcgccgtgccgccacagcagacgggcgcaaagcggagcaggcaacgggcgaaggaggaagccgcacgcgccgccggagcggactgaatgtcccgcgcacggcggggaacgggtgacgagagaggtgcaacggacccttgcctgcgcagcggcccggctaacgtgaaggcacggtgcagcccggaaaggagtaaagagagcgtctgaggatgagggaggatttccggcgtcaggcaacgccggcgcgccggttaaaagcggagcgtagcgacggccttaagagaagtgacgcggaccggacgagagcacggtgaacagccattcctgtcatatgtctgtcacagcacgctgatgaactggccctgctgaagatggtattcgtaagatgaataacgcaacactgcatttgcctgtccggtatacgccgggcgggcttttttatgcccggcatggccactcaggcgtgacgcgattcagcgcagtgcaggatcgtcgttatcagcctgtgggtgtgaatccaggcgggcccacagcgattgccggctcagccagaacccgggcgaatgaaatacgcggcccggccccggatcaaatgaggaacagagaaaaagccggcccttaaaacgtgagcacgcaacgctcgccgcagtgacggctgaggcgtaccgcagcagcgcgaggaacgaacagccgtggcgaggaagcgtcatttcacctttgccggcagaaactgcttacgcgctttctcaaaaaaatgcctggttcaggaagtccgcagacagatccccgggtgactgaatcaccttccgggagcccggtggcacctttattctgcccgttgtctgacgtgatgctgctgaaagtgcatgatggtaaaaattttccattgataatcagccagataaaaccgtatctgagtgatcctctgctgctttttcttgccagataaatttcgcccaataatactgtatataaaaccagttaattacagaggaggaatttatgcaccacttacatacagcacatatcccgtcaccggtattttcatcccggagcgtcctgtgaaacccgccgtgtacggctcaggcctgatgctgctctggcccccggtcttcaccccccgtgtacgcgtgcccctctatgcagatccctgtgcggcaggctttccttcgcccgccgcagattatgttgaggctgaacttgaccttaacgagctctgcatccgccggcgcgcctccacgttttttgtgcgtgccagcggcagcagtatgcaggaactggggctgtgtgatggcgacgtcatggtcgtcgatcgcgcagaagaggcctcgcacggagacatcgtcatcgctgaggttaacggtgaatttacggtcaagcgcctgcagcttcatccccgtctggctctcctgccgatgaacccggcctactccgtcatttatccggaggagctgcagctgctcggcgtcgtcacctggttcttcaacagtacaaaagcgcgcaggaggtagctatggcgctgcctatgttcggactggcggacgttaactcgttttatgcgagctgcgagtccctgttccgccctgacctgcgcggtaaaccggtggtggtgctcagcaataacgacggctgcgtcatcgcccgttcagcgggcgccaaagcgctgggcatcaaaatgggcgctccgtggtttcagattaaaaatgaagtttatcctgagaagattcatgtgtttagctcaaactacgggctttatcacattatgtggaatgcaatttaaacaaaaaaataagttaccattcctctgaagtttattttctgaacaggaattattcagccttgaaccacttcggtatgcttactggcagggaggaaagttgacgggtggtaagacatagccggaaaatcgatttccccgccgggatttaatctgccatgcttattctgaagccctcaatcgggcaatgcgcttttatctttcactttatgcaggaagaaataatgataaaaaattacagaatcccgggactgaccgcggtggcatttctcctcataagtaccatcgcaggtgctgcagaagcgcgctggacgtttgacggcgatatccacaacaattcccttgctgtcagtcccgatgaaaaaacggcggtggcgtcctacagtgagcgctcagacgtggtggtctatgatctggctgccgggaaagtcagaaaggtgatgaagggctacgtcaccccccgtaatgcacttttctctccggacggtaaggccatatttctttctgacagcagtctcggcgtagtcaaaaaaatcagcaccgggacgcttgacgtggcggccacgctgccgctggggcccggggcattcggcacggccataagtcgtgacggtcagcgactgtatgtgaataacgaggccgccagcacgctctcggtgtatgaccttacacatgaccggcccattgcagttgtgacgggttttgcccagccccgtcagggcattaaaatcagcccggacggcaaaaccgtctacgtcaccaactttaagggcgataaaattaccctggttgatgccgtgacgggcgacattcgcggcgagataaccggcttcagcaagctgtgcgccatttctgtcagcgcagacggccgcacactgtacgcggctaacagcggcagcaacacaatcgccgtggttgacacgcaaaagcacgtcattacggcaaccattcccgtgggtcaggacccttacggtgccgcgctgacgccggataaccgctatgtttacagcggcaaccttggcgacaacagcctctccgttattgataccgccgccggtaaggtggtgtccaccgtcaccggactggatgcgccccgtcaggcgattgtcttcaacaaggacggtacccgcgcgtgggtgctgaataaagacctcagcattgcggtggttgacctgaaaaagaaccgtgtcatggccacgattaaaagcccgccgcagacctgacgcgaaacctcccttactccagcgcagtgacgatccttcgcaaagtggggtggttaatcacttttatagatttattttagctaaataacctgttttaaagatttactctgacatgcctataatctttctgtctactcaggagattccggcatgaacgataaaatattcaccctgcataacggtgcgcgtccgctgagcgcgctgagcagcccgaaagaggccatacgacagttcacgcctaactggttcgccgcgaccatggggaccggcatcctgtcgctgtctctggcgcagttcccctggcaggttccgggattgcgccttgtcgccgaggggctctggatgtttaacatcctcctgttcagcgtctttgccgtgatgtatctggcccgctgggtgatgtacttcggagaggcaaagcgcattttcggccattcaaccgtgtccatgttcttcggcaccatcccgatgggcatggcgaccatcatcaatggcctgctggcgttcggtcttccgcgctggggcgcagacgttattcaggtggcacacgccctgtggtggctggacgtggcgatgtcgctgctgtgcggcgtgtgcattccctacatgatgtttacccggcagcagcacagtattgaccagatgactgccgtctggttactgccggtcgtggcagccgaggtcgcggcggtcagcggcggcctgctggcgccgcacattgctgccccacacgcgcagctcggcatcattattaccagctacgtgctgtgggcgtactccgtgccggtggcgctgagcatcctcgccattctgctgctgcgtatggcgctgcacaagctaccgcacgaaagcatggcggcctcaagctggctggcgctgggtccgattggcaccggctcgctcggcatgctggtcatcggcggagatgcgcccggggtgtttgccgcggcgggcatgccggaaatcggtcacatcgcgcagggcgtggggttcgttgccggcattctcttctggggctgcggcctgtggtggatgctgctggccacgctgataaccgtgcgatacttccgtgaaggcatcccgttcaaccttggatggtggggctttaccttcccgctgggcgtgtacaccgtggccacgctcaagctgtctaccctgattgacctcgcattctttaaaggcttcggtgcgcttcttgtcgtcatactggcggccatgtggctgcttgtcgcggtgaaaacagtgcgtggggcatggagcggtaaactgtttgtttctccctgtctggcaggcctggatcggaagccgtgagtgaaaccagcacatcgatgcaggactcgtttttacgcgaggaatgcctcgcggcagtcaccgcgccgcatgtggccgcgctgaatcgctgggtcagcggccagcgtcaggccggtgcagaactgccgtggtttgatccggctgacggcggggttagggccggactgctcgtcctgctgcagtcgccggcgcgcagcagcccgtcaccgcggtttgtgtcgcgtgataacccggggccggcccagcagaaccttgggcggtttctggcggaagccggtatttcgcgtcaggacagcgtgctgtggaatacggtgccctgggtcagtcacgggctgcagaaacggccgtcagcggcggacatccgcagaggctgcgccttgcttgaggacgtgctggcgtatctgcccgcgctgcgcgtggtggtgctggccggtgccgtagcggctcaggcccgcgggacggtcaatcatctgtaccccggcgtccccgtgttgacgatgccgcaccccagtccgctttcgctctgcacgagtccggcggtgacggaaaacattcgccgggtactctgcgaggcacgggctgcgctggcaggctgagggcgccagcagaataatactgacaggttttgcaaccggctctatactcatatgacaaggtgatggcgttccacctttcccaacccctccgttccggagctgatgacgcctgatgcgactcttgattttcaggaggtgcgtcaggccgtccttactttcttcccggcctgcgtacttccctcttcggggagagacctgtgatacacgtttttggccacatcaatcctgacagcgacgccatctgcacggccttcgtcaccgcgcactggctgaccgggcgcggcatggacgcccgcgcatggcgtcttggcgaagctaaccgcgaaacccattttatctttgacaccgccggactcacgctgccgccacggcttgatattccgctacaggatgaacgggtctggctggtcgatttcaccgagccggcgcagggacctgacgacctgctccggagcaacatcgtggggatcactgaccaccaccggctgggcggactgataacgcaactgccgccggaggtacacatacgcccgcttggcagcagcgccacgctgctgtggctgcttatgaacgctgaagcgcgacgcacgctgcccccgacgcttgccattcttctgctgggtgcactcctgagcgacaccgtgaatcttcgctcgcccaccacgaccgaagacgatatccgttcggctaccgagctgggcgtactgtccggcgtaaaccgcagagccttcgcccgtgacctccttacggcaaaaactgacgtcagcggcctcagcgcacagctgctgctggacagggacctcaaggccttcgtcattgccggcactgacgtgcgcatcgcccagattgaggtcagctccccgtcacaggttgccaccgtgatggacgacctgctcgctgccctggcgtatctggcagaccagtcgggtgctggtttggcggtgctgatgctgaccgacatccgggccgggttttcaacgctttatttcgccgggcgggagagcgttaacgcggcctcctgctccgtaccgggtatgctcagccgcaaaaaacagcttctgccgtggcttgagtcccgcctcaaccagaacgggagttcattatgacctgctacacccatgcattgatacttgtgaacgataaagacgacggcaccctcctgctgaagcgggcggtcgcgctggcgcagccgctcggcatgaaaatcaccctggcccacatcagcgacgactaccgggaaatgaactacgtgtccgacagcctgatggacgacgtcgtgtcggaagaggtgctgaaatccaaagcgtttatgagcgagctggcggcctccgtgcctgagacggtagacatgcgggagctggtgaccatgcgccgctttgaggacgtggagaagtgcatcgctgagctgggcgtggacctcgtgcttgccgggcaccgaaaccgctttatgggaatgctgacgtcccgctcggcggaatacattaaccacctcacggtggatgtgcttatcactcacctgaatgactgaaccgggagaaactctatgcgctttacactggataacgtgaccgcccgtgaaattcttgactctcgcggcaaccccaccgttgaagtcgaagcccggaccgtggacggaatgatggcgcgggcctcggtgccttccggggccagcaccggctcgcgcgaggccgctgagcgccgcgacggcgacgtacaccgttttggcggtaaaggcgtactggatgctgtcaggacggttaatacggaaatctgcgaagccttgcgcggcagggacgtgcgcgagcagcgtcagctggataacatcatgctggcgctggacggtacgcagagcaagagtcggctgggtgccaatgccattctgggcgtgtcgctggcggttgcccggctggcggcacaggcctcgcacgagccgctctggcgctacctggggggcctgcaggcgaacctgctgcccgtaccgtgcatgaacattatcaacggcggcgtgcacgcccgcggtcagggcgcggactttcaggagttcatgatagcgccacacggggcacccacgctgcgcgaggccgtgcgtcagggcagcgaggtctaccaggcgctgcgccagatcctgctggacaagaacctgtccgcggcagtcggcgacgaaggcggttttgcgcccgccgtatcgtcgaaccgcgacccgctggcgtttatcgtgcaggccattgagaaggcggggtacaggcccggagaagacatcagcatctgcatggaccctgcctcaagtgagtttttcgcagacggaaaatatcatctgcgcacggagggcagtgcgctgagcgcggcggaaatgacggcgtactacggcgagctgatggaccagtttcccgtcattctgctggaagacggcctggcagaagatgactggtcgggctggaagcatctgcaccagcagcttgcgggcagggccgagctggttggtgacgacctgtttgtcaccaacgtgaagtacatccagcgcggcattgacgaaaacctcgccagcgccgcattgattaaactcaatcagataggctcgcttagcgaaacgctggacgccgtggcgctctgccagcggcacgggtggggcgcgttcatgtcccaccgcagtggggaaacgacggacacatttcttgccgacctcacggtagccctgcgcgcgggacacctgaaaaccggtgcgccgtgccgcggcgaacgcgtggaaaagtacaaccagctgatgcgcattgagcaggcgctgggtgaggacgctcactatgcggggcttcatgcgtttgtgcgccgcacgtaacagatccaccggacggccagcggccggcacaggagcacagtctttggcaccttcaacgctgattctcctgcgccatggcgaaagccagtggaaccgggaaaaccgttttaccggatggacagacgtgccgctgacggaccgggggcggcaggaggctgaccgggccggtgacgtgctgcgggacgcgggcctgctgcccgatcgggtcttcacctcggtgatgacgcgctgtgttcacacggtctggcgggtgctggaccgtcttggccgcagctggacgcccgtggacaaacactggcggctgaacgagcggcactacggtgcgctgcaggggctgaacaaggaagcggctgcccggatgatgggtgcagagaccgtccggctctggcgcaaaagcttcagcggcattccccccgcggacgcaggggctccggcgcagctgcgtcgggacccgcgctacagccgcgttgcgctggccgacctgcctgcgacggaaagcctggaaatgacgctgcgtcgcgtcatgccctactggcagcacgccgtgatgccgcagatactctgcggaagtaccgttctggtcgtggcgcacggcaacacgctgcgcgccctggccgccttcctggacggcatgccacacgacagcttggcacagttgcatatcccgaccggcgtgccggccgtataccagatggatgcggccgcacaggtcgtttcccgttatgttctgaatataaaaaaataaaaggagtgaacgtgaatcagctttttgctgtcatcaccggcggtgctttagggtgtgttatccgctggcagctgggcgcgcgcctgaacgcgctttttccggacctgccgccggggacgctgctggtcaacctgctgggagggtttatcatcggagcggcgctggcgtattttctgcgccatcccggcctcgatccggcctggcggctgctcattaccaccgggctgtgtggcggaatgacgaccttctccacgttctcggctgaggtttttgccctgctgcagtccggcagctatgcctgggcagccgcctcggtgctgatacacgtgctgggttcgctggccatgacggcggccggattttatatcatgacgctgtgtggttaacccgagggagaccttagtgcagtgaccgctgcactgaggtatattgttcagaagcgctctctgcaggccagacctgacagggtttacgcttgtaatgcttcccgtacacctgaggcgctgctgtgaaagaatttcaggcctgcctgttctggtaaaggtcccagcgattgccgtagatgtcctcaaatacgacaaccattccgtattcttcctcccgtggctcctgaaagaagtggacgccttttgccttcatagcattgtagtcgcgccagaagtcgtcggtctgcaggaacagaaaaacccgtccgccgcactgattgccgataaagccttcctgccggtcgttcgacgcgcgggcaagaagaatagcacagtcgctgtcaggggccggcgtcaccacgacccagcgcttacccggctgcggcgtgtcttcaatgagggtaaagcccagcttatcggtgtagtactcaattgcacgatcgtagtcatcgaccacgaccgccacgtatcccatacatcgcttctgttttctcatctgctgctccatcagttacggcattacgcccgttataatcagctttatatcaaatacggcgttcagttatctgtactgattctgcactgataccctcagacctgacattgtaagcatctgagcagtcaggattgtgggcccaatcttgtaagagcctgctcaaccttttcagcatcctgctccagtatggctctctcatcgggagtgagcgggacctcttcgaggtaacgccggatggatgctttactctccagtatcagcccgcgcgcgctatccttcagcaggttaaaatcgcagccgatgcaggccatccggtgcgggcaactgctccagaaggggttcgtacagtatgagtcgcccagatcgtagtaggtcgcgggcccggacaggctggcggcttcaggatcgtggtcaaccagcacgcttatcatatgagcgaccctgtcggctttgacgaacgaggcagccagctgagtcgggcggatgcgaagatagtgcattgtagactggggcgttgaatggcccgtccactgcatcagttcgtacagcgacatgccctgcggtacgctcgccagcgcggtcacggctgaggcccgcccccggtggctggttatcattccgccactgtcttcacaaggcacgcccgctcttgcgcatagcatcggtatcacggtgcggttgaggatagcgctgccggcaggcttaccccggtactgaaacagaagccggactttctcaccggttcgctcgtcagcgagcaaagcctgttctgccggacgctcatccagccatatgtcgacgtattttttcaccacggccgccaccggtttaacaaaggcttttgaggtttttccggcagggatatgcaggtaacacagggttcctgccgggatgatacttccgtcgtccttcacgatatcgtccgcctgcggcgcgatgcacccggttgtcaggcggagcagttcgttctttcttacccccgcatgggtccagatgacggccattgcctgcagcatggccagtggataatgtatttcagtgagcagatcttcctgacgcagattgaggctggcccagatgagcttcagccagaccggatcgtcaataacacggggattgacgccgcgacggaacagcggcgtatccggtgtggaaagatggcgggcagggctgaagtgcaggcgcccccagccccagttttcgtaatcaatcataaaacggcgcagagaatagataaaatgcgccctggaatgcggcatcatgggctcgccggagcgcaccgatttgcgggtgcccctttccgtgcccagctgaagctcatccacgttcatccggcctaccgccgcaatgaagctggcgcaggtttccattgtccagtctgccggttcccgaacctccggatgctcctttttcagccagaggccgcagcgcagaataaagctgtactggctttcacgggtgcgcggcctgagcaccgacgtttcccgccagcgccggcaccagtgcacccaggccggatcgacgccttcgaccggcttttcgtaccattttttatagtttcgcatcctcaccggggcgctgataatccccagtgcggcaagtgcatgtgaaacgcggccgacgtaacgggatattcccttgtctgtcccgctctgggcgcgccagaggagttcaggcgtaaacgtttcaagccggggatccctgttcatgatcatcagtgttgccagtatacccgagacatgatttttctggctggtcggggcataacccagcgacgtcagcgtatcagtcagccggtccagctcctggtgataaaaagcctggccgaagatggcagaagcatagagcgcgggtttacgtatatcaggcaggctgagcgggtcatgcaaatcagccagatgccaggcaaaagcggccattaacggacggccctccctgacttcccggcacagcgtcagccagcgtttcctgcggccagcaccagcagggcatgccgtctgcatgcatttcgcgcagcaatccggctatcaccagccccgtgattttgctgccgcatccgcttccggcggcaatgtccatcagcggcctgatgaggtccggcaccggcttcgttcgcagcatacgggaccggctgtgagcgctgctcagtgccgtccgttcagcgagggtcagtgacgcctcaagccggtattcagtcatgtcgaacggatgccggctgttttcaatcggtgtgtgtgggctcatgttatttctctgttctgaaaatgaggttcgccatcctgatatctgccgtttcaatcgcgccagccatccgggcagccaggtccctgccagaaagatgaatataaatctgtgttgtggtcaggtcgcggtgtcctgcataggtggcaagttcgtgcaacttccagcccgcgcgggcaaggtgtgtgagtcgcaggtgccggaaggtatgggttgagatgtccggcatcccagactcaagcgcccatttccgtaccgttttgctccaggtccagaatgaaagcggcccgccctgattacgatcggactcagaacggaacagggcacctcttacgattccggtccgcttcatctgcataaggtgcgcggccagcactggcactactgccgggctgtaacagacaattcgttcacgccggctcttggtggtttctgcccggatgcggatgagccggtgagcaaagtcgaagtcgtcaatacttagcgaggtaatttcagaccgacgcagcgcgccgtaataggttaatgccagcatcaggcggtcacgcagtggggaagcggcggcatgataaagaaaacactgccactgcgcatcgtcaggaatgcgcggcagctttacaacgcggggaaccagtccccggccggaactcagcatgccgggcgtgccggatcggggcagcggattgaccgtgcaaagatccaggtacatgagaaagtcataccagaggcggatcgccgacaggcgaagctggagcgtggcgctggccgcggaaaaaggcatcccgggtaactgaggactaatataggcagccaggtcttcaaaccgcgccttttcaggtttaattccgttctggctgcagaacgcaaagtaatgacggagggcattgcggtaggctgttagcgtggcctgcgcccgccccagatcggataacagttgcagccagcgctctgccagcaacagaacgtgttcactcggtggaatcagcattgcattctcctctgacaacagctttgctgttcaaagtttactcaatcaatgttgcattccacgtaacttactgtctcagccagcgggtgatgacggctcttgaggaggtaacgccccgggtcgagcagtactcgattgacgagatgttcctggatctgaccggcattgacgggtgtgaggattttgagcacttcggccggcgcctgcgggcgcacgtgctggccataaccggcctgactgtcggcgtcggcatggggccgaccaagacgctggcaaagagtgcccagtgggcgagcaaagagtggaagcagttccgtggggtactggccctgacgcccggtaacccgaagcgtacggccaccctgcttcagaatcagccggtggaggaagtctggggcgtgggcaggcgcatcgcaaaaagactgaacctgatgggtattgaaaatgccctgcagctgtcgcgcgcgcatcccgcgctcatccgcaaaaacttcagcgtggtgctggagcggaccgtgcgtgagctcaacggggagtcctgtattccgctggaggaactcccgccggctaaacagcagatttgctgttcgcggtcctttggcgagcgcatcacctcaaaagtggccatgcagcaggccctgtgccagtacgcaacccgcaccgcagaaaagctcaggggagagcggcagttctgccggcgcatcagcgtgtttatccggacgtcgccgcatgcagaaaacgaggtgttttacggcaacagcgccggcgagaagctcagcctgccgacccaggacacccgtgatatcatcggggcggccatgcgatcgctcgatcgtatttggctggacggccgcaggtacatgaaggccggcgtgatgctcgacgactttacgccgcatggtgtcagtcagctgaacctctttgacgatgcgcagccgcgggccaacagcgcgcagctgatgaaggtgctggacggcattaatcagtccgggctgggcagcgtgtggtttgccggtcagggcgtgaatacggaatggaaaatgaggcgggacatgctgtcaccggcgtggaccacgcgctggagtgacatcccggtggcgcgcgtgatgtaacctgtagcggcagggcacagcagacataacgtaagtctgctgccctgcattgtcatgaaaagtgcggccagaactcatccatgatgatcaggggcttgcccgggcgctttccgcggaagtatcgtccgcgcggaaccctgtccttacgcgaaagctgatgaagccagtcatcaaaggccggacggcgcctgcggacggggcccttgaacataccggctgactgggtaaacgttttgaatacaatccccggtgctcgcatctgcgtcagcatttcctgaatttccatcaacacctctgtgttaatcgttcattaatcggggctttttttcttccagccgccgttagccagaacggctgcacgcgaaacacaggccccccacagcagctgcatgccgattttgaccagctcgctggcatcgtgcaggaaaaaaagcggcacgataaacagcgtactgagaagaaaaccccactctgcagctttcttcctggatttctctgctaactttgaaaaccctaagaatccagttatatatctaaaaaaagacatacaccctcgcatatcaatagtgcgcacaatgaatacatctaagagccattacgcatactcattagatatacataaacaccacataaggtacttgttgtgaggccgcttattgctgatctaaagcaccatcgctctctaactttgcacgtattgcttcaagtatgtacgagctaaaatcaagggaagttttgtttgctgcttttagtgaagcatgtgcctcaaaataggtttcaggcaccgctcgtaaattcttgcttcgggacttatttttgtgtgacgttttgatttctgatgaagcttcttggacagggacagcatcaggaaccgcagaagtcttcaactttgcagaattcattaaaccactgagtttttcctgctgggccgccagatcaaacttcttattcataaatacaccttagatacataacggatgcgtgatagatattcaaagaatacaccttaagcatctttaaggcatcctaaagatacctatatttctttgacaatttttagcatctcctcaaccattgatctcacttctttacctccggcggtagttcggccatgtaacgattcagtgataccaaatcctgattcaagagactcttcaaaatccgcagtacgataggataagcgactgctcattagctttatatgtctaaaagttgggagtagagcgtcaagttttgggtagtgttttttgttagggtttgtcttacagagaaataagtgtgcctcaatatgcctgccaacgatttcactaatctcacctaatacgctatcaaaactcatcagaccaatacgtttctggtagagagtctttagcaggtacaatcaccagatcagcaaatgctaccgcagtacgcgtcatatcggagtcaaaaccaccgcaatcgatataaagaagttcatcagtgcccttaaactcactaatttctttaattaattcatcctgtgtttcagggatcgatatagggatttgcttatcttccggcctaagaccatgaattattgataaccctctgtgcgtatcaagatctaaagcttttgctggttttagctctccaacaacgtgcactgaagaggtagttttaccggcgccacctttattgtgagccataacgataacagtcataaaatccgcctatagagatatcaaatgagtattcactaaacgcacattgtatatacaaaagatatgcgatagaaatccattagatacacaataagtatctggtgcgaattttatatcattgctgatctgcgagagcaagaactagtttacacactgcataccttaagagtactcaacgtatatacgtaagatacacaaaaggaactcgttaaacatccaaagggttctcgatgagtatgcaaaccacttaaatattagggtaatttcctttgagtaatgataccgcctcatttccaggcatatgaaactgcacccggtgtcgcgccgccacgtcaagcgcaaaaaccttcgtgtagacctcggttgatttcatgctcttgtgccccatcaggctctgcagcgccttcagcggaatgcccgcatagagcatgtgcatggcgtagctgtgccggaatgtgtgtggcgttaccggcacggagaacgtgactccgtcaacggcggctgcagcgacggcttcgttcagccaggtccgcaccgttctgtcggtcaccgtccagagcctgactttctcggtcctccccgtatccggattgcgtcgctcctgcggaattttcagcgtggcgaccatcatctccagctgaaccacatactgaggatctgacagcggaaccagccggtgagggaccaaacctgacggcgccctgccgggaccgcgtgccgctttttcaccacgctgcttcagcgtggccagctgcacgtaagggtagggcggtgccaggctgaaatctccacgcgtcagcgccagtgcttcattaatgcgcgcccccgtattccagagggtagtaaacagcattttgcggtgcagatccggcacgtagtgaagcagcgcgctgacttccggggccagaaggtactgcggatagtcatcatgttgagcggccatctgccgcagtgccagcgctgcaggataatcaatcgcaaccggcagtggtggaacggaagcctggggataatgtgatggcagcgtcatggtcatttctgcttttccttattgcccattgcgatgacagaccagtgaaagctcgtcaaacatcacgaaatgccgtgtctgcttccccctgaaaatacgacgcatcatgggcgtgtaatcagccggttcccagccgtagggaccaatgtcatggattcgggtgtcagcagtatctaataccttttgcggtccggcgacaatacgaatgacttcagcgtacaggacctctccgcgcataccgtactggctcagatagcggcgcagacgcgatctgggcatcctgcaatcgcacttcatagagtagcggacatcttcgactgactgcgcggcagctaaaatccttggacttaacttacgccatgaaaaattagaatctgttctactctccattcatctttccttcattaaatggttcatgcgttttctccggcatcggaagcgtcgtctgccgcttttcttctcatatcgttctttacttcaaatgcagccagcgcacgggcatgaagcagggactgcaccgagcgtcgattcctctcccggcgccattcttcccatagcacgcgctgcgccgaccagggcgtggcgttgaggcgtgaatccgggaagcctgtcagcttacgcaggcgccgggacaaaatcaccgccttcaggccaagccgggtgtactcgtactgccgggcttcaaagaactcgtcatattccggaccgataaaacccgccgaagcaattgtccggtccgattcgcttttgagaaccggcagctccctcagctggtacatcagccggacgggcagggtgcgccagtcaccggtgacagcagcatagtcaagtttcgggcaggggatgagaaggtgcaaaagcatgctcatgttcggatccgttatcccgggcgacactcgcacagttctcagcgaattgctccagcagaaaaaccaactcggtggcgatgaaataccgctcccgctgcagcctgtcttctgacgctatcctctctcttttcagggtgaacttgtgagtcagcatcacggccgcaatcgctgccccggcggtgatcagcccggtagccacacttccccatatgcccggcccctggttgatcacctgcaccgtaaccggatgggaaactactgatgaaaggctgtcagcaatatagtcagcatgcatcattcattcattcctaaacatcccttcatcaagttcaatagactttaggccccgcctctctgtactgcgtggcctaaaactgaataccacggtcttataatcttttattctctatttcgttcgtcggggcatcatcaatgctgttgttcttctccgatttgtctaaccaggcgtggagaaccttcttctgacgtaaagattgattgctagtaatgtgcttaaaaatgatgtcgaagttttcgacttcttgattctctcccttaacgggagagccggtgtctgtctgaagcttttcgagtacggcatctttttcaggaacgacctcacggttaacaaccttaccaagcacccggatgctgccagcgatgatttctagatcgtactggttttcgaaggagttacttttgaatgtgcgctgcgtcctcctgagccagatgtccgaatgctcgaaaccttgaccaagaaagtccgaaattttcttagcaaccacagcttcctcagcaagttcattatcaattttaaaaacctttacatctgatactttatccattgaattaatacctgagatggtaattagttaagtaatagtaataagcatataaataagcacacttacaatttcaaaatgcaattaccgtaaccccaccccggcatgatccgagtttttcccgatacggcagtaaccggaagcgtaacacggcggcggggcggggcaaagtcccctcacacgggacgctaaatccgcagggacactatatctggtagctggaccagctgacttaaccactacatgtagtaccctgcgcagaaaaccgccaccctcactcgaagatccggttccacccttttccggatctgcggaatttcacaacaacgaaatactgcaagcgactcaaaatgctctaggagtattcttatcattaatattatgattaaaacatcagcaagtctgatgaatgctcatttttcctgaccccaggtcagccccctcagcgataaaaagaagcactaggagagcacgtggcacttaaacttcagcaggaaatgcccgcagacagcgacctgttcaaaggtggcagccaccagaatgtggcagacaggatggcagaggtaattaaagaacaggaaattaatatcctgggtctggaaggtgagcttgggtccggaaaatcgaccattattcattttttaaaaaaatctctttcccctgaatacacttttatagacttcgacgcagaggtttatcactacggcaatacgaaaaaggcactcattgaggtcatacacgacgggttgagcgaaagtaaagatgctaataaaggcaacctcgaaaaactgaaaaacacagcgctgggaaacattgtaaaatacgataaaaaggtcagtagcagactgagttggtggacggtcagtttcattcttttgtgcctgctttccgtgcagatggtcagatatcttattctggatatcaatgctaatgctaaaagtccgggcacaatatcaggctgggtaattgcctcagaaatagttgctgcgatttctccgggcatgcttttattatggcttttagtgagccctaagcttaatgtcaaaacttggtggatcataagctttattttttcgtgcctgctttctttgaagatggtcggatatattatctcggacatcaatgctaatgaaaaagtaccagacgcaatctcaggttggataattgccttagagctagctgcaattctgttaccggccctgcttttattatggggtaaagtgagccccaagcttattataaaacccctgagcaattcagaagacgtcaccaccgtgggcgatctcttcaaacaaaacagcaccgacagtattactgaaaagtggctgataagccgggaaatagggactattgaattaacgaacgcgctcgcaggttttaccagtagctcatctgtttctgcagacgcaaagtttattctcattattgacaacctcgaccgcattaatgccgacaaggttaaagaactctggagtgatatggagctcattgcgggaacaacgcaccgccagttccgcattattgtgccttactctgctcgccatgttgcaaaatctcttatgctggacggccataccggccgtgagtttatctccaagcgcatccccgttaccttttccgtaccacctctgataactgccggatggcaggacacgtttccgcgaaatgtggaaggaaaccgtgaacgagcggactgatttctcctgcgcggagaccatgcagatactggaacgctggcgcactgctgagtatccccggatgacgccgagactgttaaaaaaactggtaaatgacgtccacatactcctgatgacagtgcctgcaaaagctccggaagaatacgttttaattgcactttatgtggttttcgtacgctacaacgaatcagacgtaatggcgctactgagattcactgaaaataatgatatcgacgtacagcccgctgagtatgacgataagttgcaggcaacaaaagatcagttaaaccgactttttatgaatgatacgaaccgatggagtgaatatctgatgagtattcatttccaggcatcggtagagcttgcgcgtacagaactgtttgatctgccgcttaccgaagcggttaacaaacaggatgctgtagcactcgagaaactgacaggtatgtacggattctctcatgcgtggcagcgctgtgccgggcgctttactatgtacgactggatggaaactgtcacgaaactttccgacaatacattaatcagaatcaaagaagagctaaccgatgccgttgccaggctcaatgcgatatatgcattttctgagcgggaaaattttcgtgagtctttcacccaaagccttaaattgcttgaagaaaaaggttacctcggtactgaagatttcatggtccggcagaaaaatcatgtcgttacagaactgaataaaattcagaaaatgcctgaaaatgatgaggtttatatcagggggcttcttaaagaggcagacctttattctgcaatttttaaagaaaacctgctggacctgatagatattgatctaagcggtaaaatttattccatgtacctgctgaatgaaaaagagaatctgcctaacctccatgtcagtactctttctcttacagaagcagaacaggaaaaaatgcttcgccacatactggagactgaatcgcaggatatattcaattatgatgtcatccgcttcttcaagctgtacagtaagccagtgggaaatattattaagaatgacaagcaaaatttgccagaaaatatcgtaagcaaactggggttactccgcaactccagcagtaatgaggatgtagatgttcttcgttatgttattttcaaccctgagtggtatgacagtcagattacacccagtttaaaaaaacagagtggctacagagaatattttcctgaggagtatactgctcacctggtcgcacatctcgtagtcacaaagaactattcagaaatagaaatttacggtgaagattacgagcataatgaaagttacattaaatacctttcttattattttcgttatgttaataattttggtattgtaatggatgctttgaaagatgctcagtcgtcagcatatgtaagagaagctgttaagattttatttactaaaaatcacttgggttatatcaacacggttgattacgttaacacctattacccgatgctcaaatctgagttaattgatgttgattacatgagcccaattgtcgatcgtgaagctggcttgcttaaaaatattgattcagcaaaccttgataaaataagccatgaatttcttgaagacattttctccggaaatcaatttaaaaaatttaaagagctacttcacgtaatcagtcaggacattatttcaagtagggagcagctttacagtgcctttaaagcgatagaaagcaacagaagccttgttctgagaaggatggcttcagcaggaaaatacttaaacatgaccgcaggtatcagcctcttcgcggactggtatcgtaatctcgatggtgtacagcttaaaacttctaacaacgtaagattaatatggtcatgtctgaatgaagtgcagcagtctgaagttcttaaagaattccacgatgttcttatggaagtgggcacgcttaaagaaaacaggatcaaagtcattcatgattttcatgatattatcaactttgccgaaccggaagggaaagcgtcacgacgggcaatagcagcgctgttcggtcttgcttccggcgatgaggtattgcgttcgtggcttaatgcgcagcagtttactttcagcgcctggcctaaggctgaagctgatacagtaagtcaggtaattaacgtaaatcaggaggattttcctgatattatcagccgttcttcattcatcagaaaccgtcttcccgtaccggcaccggagccggatgataaaaatgcagaaggaaataaggatgaggcctgaaattacctttcgcatccgggcattccgtcaggtctttgaagaatacgctgcggatatcaagaggtgggcattatcatgaaaaagacgacaacaacgcctcatgacgccacatttaaggccttcctgacgcatcccactacagctcgtgactttatcgagctgcacctgccggcggagctgcgcgccgtctgcgacctcagtacgttgaagctggagtccggcagcttcgtggaggaaaatctgcgcgcctactacagcgacgtgctatatagcctgaaaaccgccgccggcgacggctatattcacgtgctcatcgagcaccagtcaacgcccgacaggcacatggcgttccgcctgatgcgctatgccgtggccgccatgcagcgacaccttgatgccgggcataaaaagctgccgctggtcatcccagtgctgttctacaccggccggcgcagcccgtacccgtactccacggactggctgcaggagtttgacgacccggcgctggccggtcgcctttacggtgccccgttcccgctggtcgacgtcacggtcattccggatgaggaaatcatgcaccaccgcagcatggccgcgctgaccctgctgcagaaacacattcaccggcgcgatctggccgacctgctggaccggctggccgccaccctgatggccggtcacctcacaggacagcagctggtttcgctgataaactacctcgtacaggcgggcgaaaccgatgacgccgaggcctttgtacgcaacctggcgcagaaagtgccgcagcatgaggatgaactgatgacgattgcacagcagctggagcagaagggtctggataaagggcgtattgaaggaaaaatggaggtcgcacgtaaacttctggaaaacggtattccgctggagtcggtcagagagcttaccggactatccgacgacgatcttgcaaaaatccgccactgatattatccagtaagatatcagtatattgatcctgcttgcgatgcccacacagtgggcatcagcattcacttaatcagcggtatgtcttttaacctcgtggtatagcgtggtgacagcatttcgcgtttcatctgccaggcactgtcacgttctccctgacccgcaaaccatacctttcccttgcctgagcggttaatggtgtccagcgcggccatgagcgcatcagcgtttgcacgcggctgctgctcgctgaacatgtcaaactgcgcgaccccggactggtaaaaatcacccagcatgacgccggctttggcgtaccggtaaccctcctgccagatggtgctgaggccgcgaatggctgagtcaataatgtcccgcgtatcactggtcggataatcacagatgcgggaagccgtattcgaatactggggctcatcgccgtgtcgggcggtggcgatggacacgctgatatgacggcagcgggaattctgctcccggagtttttccgccgcacgcgtggcgtacagcaccacggcctgctgcatctcctccagctgtgtaacgcgctggccaaaagagcgtgagtttacaatctgctgtttcggcggcggcgcatcctcgagcgccaggcaggactcgccgttgagctcacgcacggtgcgctcagtgataacgtcaaaattttttctgatcatgctgatgttactgtctgccagctgcagggccgtagtgatgcccagctggttcaggcgcaggctgatgcgccggccaataccccagatatcactgacgtcggtcaggtgcagaagttttcgctgccggctccggtcggacagatcaacgacgccccgggtctgagtccatttcttggccgcgtggttggccagtttggccagcgttttggtcggcccgaatcccacaccaataaccagtccggtctcccgtcttatgcgctggcgcatctgctgtccgaacgtctcaagcgggatgaggctgccaatcccggtgacgtcgagaaagctctcgtcaatcgagtaaacttcctgcccggcggccatttcgcccaggatggccatcatgcggctactcaaatcgccatagagctcataattagagctgaacacctgaacgccgttctgcctgaaaaagcgctcgttctgaaacagcggggcggccatttttatacccatgcgctttgcttctgccgaacgtgcgatgacgcatccgtcgttatttgacacgacgacgacaggcttaccgcgcagatccggcctgaatacggtttcgcaggaagcgtaaaaattattggcatcggccagcgcaaacatgactactctcccgccggtccggtgaatcccagcccggccacatcggtgagtgcgtaagcaaccacgccccatacgggaagtgcctgactcacatccagcagggtaatggtttcatccgcatcaggtgcctgcagggcggggaccggatcgagcagcaggcgccgcagcgtcagctccccgtcgtactcggccacgataagctggccgtgcaccggtaccagcgcacgatcgatggccagcaccgaccctttcacgatcccggcatcaggaaagctgctgtcgctgcgcatcaggtaggttgaataaggtgaaagatgaacgagatcccccagactcaggcgagtttcggtgtagttctgggccgggctctgaaaggccatgaaaatactccattctgacagcttttcagctttaggacgtgaacctgtaacgccgctgtctgccacacagtgcgtatacgttactcagaatgtcagtatacgacgccagccggggagttgcctgcattaaaccgtcctcagcggggcggaaaggccggtatatcatggccttcagggtctgctgaggcatcccattgccaccatcgtccgggcccgtgctctgtgtcatacgccaccgttttaacctgtttacgctgcagataatccggggtattcatgccgaatacctccatcggcagggcttcggcgccggcaacgtcagtcagtacgaagtccgggaaaacattttcctcaccgtcatagcgcagcggcttgatgaacgcgcgtttttcctgccacagacgcgtctcgaccattccctcatagcgcgagtccagggggatgtagcgcggactgacggtcatcagcgccgcatcgattatcctgcagctgctgcgcggcaggttctgcccgtctcttcggataaaaactgtttccggcggctcggtttcacagataaccatgacccgggcaccgcggcgccagtctcccagttcgcgcgagaagctccgcgcgaggcgcgctctgacgtcatcaggcagctgcagcgcgggaaaaccggcaaacagtcccagcggaagcgtggactccagtcgcgcatcggccgcatcgctccaggcagccagctgcgagatcaggatgagacggcgtgacgcgctgccggcgtctctggcagcctgacggttctgcacggcctgcgctgagtccttcatggccatcagcagcagcgactgctgcagcgggacccgtccgatacgtatgcgtgcggccgtttcattcagccgccagctgacccagcccggataacgctttttccggtcaaaggcggggtgccagacgttgatgccggactgttcccagagcaggtgcagcaaccccagcaggcgcattgagggctgccggcgccgcttaacgggtccggcgctggccgggggagcctccggttttttttcctggatatctttcttctgcaggccggtgggaaggcgtatgacaatattcccgtccggtgccgcctttacgacgtcgggtgcataaatagcggcctgcctttcatcagaccagacggaataaaagcggcagtccggcgcgtgctcatggccggaaaagggccatgacgcgagccagcactgatctgttttctgcgagaggtgcaccttcaggcgccggcagtgagcgtcctcatcgggtggccggcacaggcaggtcaccaccgtggtggctttattatcccgcgcgtatttcagccagcgctgccactgttccggcttatccgcacggaagtctgcggcgcattcccgcgttccgcgctggcctgcaaaccgcaccggaaatgttttctttgccgccataataagccacctcccgatcataatactgaatatgagacctgcctgattcttaattcagcctgtccgctgagcaggctacaggcgaagattcattccacagacggttaaattccgtctggtactgtcgcgcggtttccggctcgcccgtaataaccagcgcgttttcagcatttcttttttcggctgatgacgtgtagttaaatgatccggtttccaccgagcttccgtcagcaacaataaatttattgtgcatgatgctgtacatgccgttgacgcgcacctgtacacccgcgcaggccagcgcgctgacgagtgaccagcggtcccggcttttcttttcatcggcaaccaggcgcactgacacgccccgcgctacggaagcagccagcgcctgcgccacgggctgactggtaaagtcataggccgccacgtccacgctctggcgcgcgctgccagcgaactgcagtatcaggttcagcgccgtgccgccgggggagaaccctgccgtcaccgcagcgaacgaacagggcacaaatgcaatcgcgcatagcgctattactccgggtttatatttaatcatcgatagtcgccctgcaggataaataagtcaccattctatcacgcagcgtgtttatttaattaaataacgcgctattactgccgcaacaaaatataacaaatgcggattaagtcattattaatccctgccgataatataattcacacagggagcgggggaaccatgaacgaatttcacgaaataaacatgctcacatcacgcggtgatattaacggggcactttcactcatctgtaaatggagtgagagcattgcccgtaaaatcatgaaaaaggccggctacagtgtgaccccgcaggccggacgcgcgttctggtcatgggtgcaggccacgctgacggattcagcccggcagcgccgctgtggctaccgggtgcgggctgagcgcagggcacccgtccgctactgtcgccagcaggcgcgggagaactatgatgcgtacgcgcagatgatggcctcagacgtcgcgccgcaggctgaggctgccccgcacagagagatagcgtccatcgatgctggtcctgaaaaaagtgtcgctgtctgcggccgcacagaaggcctgatacacctttgccggcacggcaagccagcgccggcacgcgccgttccggtactccagctcaagcacgccggtggtcgcatcgtatcccgcgctgctgaaaagcgcagacgtcacttcatgtctgttcatggcgttattccgggcaggtccctgatgaatgaaatcgttgatcgtaaaagtgcggatcgcacgtacacaatgcccgtgcagggtaaaatacaatggcatgtatccggctgttcactggcggctcgtccgctgcatgtccgttattctgagctaccccgggcattcactgtagcctgtaaaaagggaacccggaggaacagggacccggcaacgctgactgcttcacggggagcaacggccagacgtcagtgttcacggtctttaagggcagcagacacccgctcatgtaccagcgccagaaacgcctgcgccgtcgtgtcccagttcgccggcacaaactcccctttgtaatgcgcccggaaatcccgctccgtatcgtcacattcacccagaaacagttcaatgtctgccagcagggtgtgaagattcgcgtcgggcatgtcgtgaatgtaggcctgaattttgggctctatctcatgtccgggttccgccataacgtaatcctgaccgaaatagacgccgataaaattatccagttcgctgatgctgatacgatccactatacctccggaaacgcagtcagaataaaatagggttttccgttaaatgacctgaaatcaatcaccacgcggacggcataacaggtaacggtctcctgatttcctctgcgcaccataatccccgtgggatgcgcaaaccgccggctgagccgcatgcgggcacgcatgccgggcggaacgttcttcacccacatcgctatatgatttttattatccgccagcacccggctgatgattgcctctgcctcacggagtgatttaaagctgctggattcttcaagcctgggctctctgataagcctttcgcgtagctcatccggcgatttaccgatgtgtcgctcgatggtatggccaccgggcgcacgtcctgaaagtgactcgtgctcagcaattctgaaccgcccacggcgtacggcaatgacccgctctgccccggccgccagtgcaaacgccatcggtatggcgatatcgaccgtcaggccgaccttcatggcggtctggcggtcagcaccgagggattccgcgagcgccacggcggaattaaaggtatcggtattgacctgcctgccggtccagacctgccggagactggcctgaatggtatcaagtccgtgcgttccgacaaagacgcatccggctttggtcagcatggtgggctccggcaccacgcacagggcgcctgcaccgaacatttccaccacgccacccgccagccccagcccgccggatatacggttactgactgattcaccttcactgacgctgcgatcagagagtacggctgccagctgcaccggcgaaagcgctatcctcagtccctgttcttcttccacagaatcctccttttcgtaaccggtacgtcatttactcaatttataaccggcacggcatcaggttgcaaaccggtggcgtttctccgcttatcttcaaagggcacagtgaacaacagaggaacggccatcggtttcaataccagtgataaccggagtgatatcggcccgggctttcagagcggctccgcattgttcacatccggaagaatttccagcttatcgataacgatctgcaggacgtccgccatgcccggtgaccatttgccgggtatatcgagctccgaacggaatacccctgccagccttatgcgtgtggtttcaagccccgcatcggccagcatgaggacggcttcacccagcagacggtatgcctcttctgaatcccgtcgttctgcttcagtaacctgcatagcatgtacctctcagacgtagccggacaggtgagcagtgcgcagcctgtcccgtgaatgccgcgtcagcggcatggaggcgccagaaactgttaaggacggctccagatgccatcgggcgccgtaagcccggcagagccggttacagggctgatggtggcaaaccccaaccctgtcctgccagacgccgtttacgcagcggcctgtcagcagcttatcagcctgacggtcggagacgaaagaaagaaaccgcggttcctgtcaccgcaactcagaaccaactagttacaacacccattaatcagccactgcagttccggcccttcgggccgggcggcggcggctggtcagtgggggcaaccgggcttcaggtccggcgcgggtccggccggagaggggcatcgtgggttcagacctgcgtggggcctgattacagtgaatccttgactgttgtaactaattgtactggccggggcccgcgtcagcgggagctatttcagattctgagcggcgcggacgcctgcggccgctgtgagcgaaggcattaacttaaacttatccccgcagaatgcctgcatgaaaaacaccttatctttatgaagatctcttactgacgtaagtcaggaatatcttgcaggtaatgtgattactgattacgggtaaagccattttcttaattgcgggtaaatgtgcattaaaaaaagaacacttccgaagtgcgctgtttttttattttttctggagaaaatcctgagtgggtattgctgaaactggcaattcttcgcattgcacaaacgactttaccgccagtcaaggcggtaaaagaaaaggggacagagtcagtgtactacgtcaggtatcgcaggtatttccggttcataatcgagacctaaatccatctgccggagacggttccagacctgacgatcgaactcttccggaggaagatgcatccattcatgggcaggtcctgcgcgcagcagcttggccacggcgttccgccggtcatcaatagacagcttactcagccgcgtacggcgctttttgctggcggctttttcacgccgcttcagcagcgtggccatgcgcatattttcataccagcgccggcgcgcggcgcgcacggagtcgtgcgtcccgggctcaataatgccgtcggcttctgccgccaggcggacgttacgttcagccaggaacttatccatgtcgatgccgcacagctgccagaagcggtccgtcagcacgatgtggcgtggcatgcagtagccggtggccgggtccatttccagatccggacgctcaatcaggccaaagcgctcccactcctcaaaaaggcgcgaaagccgggatggctcaacgcgcgtttccggtataacgttgccgttttcgtctttcgggctgagctcgtcggccagcttactgccgttgaaggtgacaactgaggtggccagatcggcacgctgaataaccagcggccaggtcgaatcatacagcgcctgcttttccggccggaaatcgcgtttacggccggcggcctcgcgcagctgcacaaaatacgggtgacgggacatgcgctggcgcagcatcattttgccggtgcgtttgtctttcataacgagccggctcatggcatgccccatctgtcccggcaggcgccggaagttaccgggtgcaaaccattcagggtttgagcacttgcaggcaacggagtgatcgccgcgacggcgtccgtcatttttgaggttcgggcggtttaacccgattaaaatctggtcattcaccctgtcccgaacttatggcggacaggggttgtcttatgaaaagcatgcgttataatccttcacaggccagcgcctgcttttggaccccctgatttctgccgccttccgccaagttgatgacagatttcgggggttttttgcattcagagcccggtaaaacgtgggctccataccctggacgtttttacggatacgtcctatccggttgattctttcctgctccgcgcatgtccggctacaggtttactgcacaccctcatcatcaaccaccacagtatctgacaaggatctaaaaaggatcgccgcccggcgaattctgaaaagaatacccatctcccccatttaaatccagcacagtttgctcatagcacgaatcgtaaggataaaaaaagctcaccgataaactttacagtgaccgggttcacatctgcaggcggacataatacaaatcacgcttctggcgggacggtgatacccggaagatgtctgatagaggtattcactgatattcaggcagccggctgtggtggggtcgcagacaatcgcttttaatttacgacgggcagggcggtcaggctgaggcgtaccgcagcaccgcgaggaacgaacagcctgagcggcgtggccgtcatggggtaaagattctggcggaatggccgataccccgcacaatgcccgctggctggcgctaaagggcaggttaacaggtttcaccttcccggccccgggccgggattctttatggtcacatgcggtaaaggtttgacagaatggcggatgctgtctcatgctaccggcgggatttcctttgtttggtggtgttattccgtttgggatagtatgcccggccctctgtcacgcaggccggacttttttaacccttttctgcccgggttatggcctgctgcatgacctgttcgctgaccacacccggaatgaccgtagtgttgtccggcgtggcgtttctcggccggcatcacgataatgcccggcgttcccctcagccccagcatctcagccagggctgcattgttctccgtaacgtggtcagacacggctttatcctcgtctgaagccgcacctgcaccggccgcggcggcgaccttctcaatgtcttctgccgtcagttttccttcattatgcccggtccggtaaataccgttgtgaaatgccatgtacgcatctgccccctgcttccggtaaacacccagtccgcggtgcgatgcctgcaatgactccggatagcgggcggcaaagatggtccagtcccggaaagcaaagcgcacgccggcgtttgcagccatcaccttttccatcaccggcgccatcatgctgcaggcactgcattcgtagtcaaaaaactcggtcacgatgacttttgagtccgccggccctttaacgggcacgccatccagttgcatcagtagccggtgagttttcagcgctgactgcacgtaagcctgctgctgcatggcctgctgccgcgcctgcagctttttgctcacctcaatgagcacgtccgggtgcgcgaccagatagtccgctgcaatctcaccaatgcggacctgctgctccggggtaaacgcgtcagcgccggcagcaccggcttggactgtaaataaagcagcgctcatgaccagagctatgctggccatcttaagggtctgtttcatgatttatctcatatggctgcgttaagcagactgaaggtgagacggccgcaatgagtacggccgcgctgatttttaacgctctttctgaatgttccttgagggttcatgtgacagttccggtggcatccgctccggagcatcatgctgaaccggcctgctgagacctgccgcaaagtctttttccgtccgggaggctgctgaaagctcagtggccagttctgtatcgcccttgcccgaatgcactggctgttcccggatctcctcctgcatcctgataacttccggggagtccggccgggtattctccagaacccggctggcaagtttcgcttcatccgttacagacctggcaacagggaactctggtttctcactgtctgtcatctcctgtggagcagccaggctgagatctgtggccagctttttctctgctaccaagtcggcacgactgtctctgctgctgatttccggttccggtacggcaggagtatcaggctgctgactttctttcctgacaaggtctctgatagctgcgtcgctaatgtcggcaggtaccaccgttgatagcgtatcttccggaacgggcggtgtattctgcacgctgttaacggcagctcttaccgccgtttcggtaacgggctccacgcctccggaaattttaagaagctgttttgacggcgagtcgtttccggtcttaagcaaaacgcctgaagtgggatattttctcgccatactgagcgcttcgtccagtgtggtcaccacatgcgtttcaccgttcctgcttttctgcacaagcgccgcttgtgcgccggcggtaaaaatccgcctttcagccccccgagccatgtcaccgctgccgggtcgtagcggcaccatcgtcaggcccgccgcttttccgttaccgtcgaacaccggcagggccagatgcggctcagggaacttccgtgtcggcgggatgatacgtgccgtaaccgggctgccgcgcaaaccatttgaccgcagaaacgcgcggcccatcgccgttttagacgcgggctgacccatcgcccagatccgcctggcccgatcgcgctccggctcgggcgtgagcgcatcatgcgccgtggccggcccttcttttccggtcctgagcgtctttgtccagccggctttatcatcggtaaaaatctggacatggtccttcgcacgcgagacgttgatataaaacgcccgcgcgccgctcatcagctcacgagcgccctcaacgccctccagcgccagtgagtaacgggcactggcgccctgagcgccgtagccggtgaccgcccagctgtagtcaacgtgccggtcagcgaacgttgctgccggatcgataatcttcagcccgccggcattgcgcagcacaatctcaccattgtcgcgcagctcttcaacgcgatactgttcgtgtgcagcatgaccggcctgcttctgggttttactcaggcggacgctgtcacccgtgcgaagctcaatagagcgggtctcaaaaacctcaatttcagtggcgttgagttcctgcggcgaccagtactgcgtgcgccccgcttcatccttcagggtgatgttgccgtttgcctggtcaacgccggtgacgtgcaggtaccgctgattggccatcaccacctgcccggtttcccagtcgtcaatacggttaaagtcgtgccggccaccgttgatgcgatccaggacagggacggtgcggtacgcctcgcccagctcttttgattcaaccatcgcgttatgaataccctcattgatggctctgcggtctgcgtgcagctgaaccatgatcatggtctgctcccgtgcctcatcggtgcggctcataaagtcagccacgattgtggatacaggatctgctgactcgacaattgatcctgtgggcagcaccgtgcctgctcgccggggaacaacgtccggcgacaccttttcaatgtttctcagcgccgccgcgaaatcattgctgatgatgctgtacaccgcagacttcaggtccgggtcgcgctggcgcacgatttccttcatgaccgccacatcaatggggctccgctcctgcatcagctggaatggcgcaccgctctcgggcgactgcagctgcgcaacgtcccctacaggaacggcgcggccgttaccggcggcgatagcacggtacgccgccgcggtatcctggttaccaatcatggaagactcatcgataaggaacagcatgttgtcatagcggacgtcctcgccggccgcgctgcgcatctgccagtccagcacaaacgacttcagcgtctgcgcatctatgccggtgcccgccatctccttaaccgcccggtgagtcggaccaaggcctacaatgaccggacgcgcgtcagccggcagggtgtcgatagccgccttgaccgcattgaactgggtggttttaccgacacctgcatacccctgcacggccgtaaaccggtccggactctgcagaataagcgaggtggcctctttctggccctgagtcaggccggacaggagagccggatcgacctgcgccatcagcggcacctgcgtgtttttaccccgctcaatttcactaacgatggctttttccatctcccacgtggcgcgcgcaacgaagtgaggcccggccctggtctccacctcaatgaggtcaccctccttaacctgccgggcaacttcactctcgataagcttcaggtcaccgcagaatgtcagcgcctcatccagcagtttcgcccatgggaaggcgacgtcccgcatctgcgccacgccgcgcgttacggctttctgtgcatcagagagtagctgtttactgagcgtgtccaccgcctcactggcatcctcttttccgctggcctgccggaccagcgacagcggcgagcgcgtggagcgcatgcgccccagcttctcttccgcccggctcagcgcttcgccggtaaaaatttccgcctcatggccggactgcgccagcgcgttaatcatattcaccgacagatcctgtgcgcccaggctggccagtaccgtgccgcgatcgttgtcgcggctgccgggcgcgctgacgtatccgtaagttacgtaaagcggccgggacgcgtccagacgcagcggcttttgctgcccttcgcgctgcacgatgagcgtgccgttttcaatagccgtgaccgtgaggcgatcgcgcgctttcaggccggcatgcttatcaccggcaagtgcaaacaggtgctccccggcggcaacttcagcgtcattctgcgtgaacagccgccagtcgccggagagtgcgctgagttttacccgtgatagcaccccgtccccgtcaatcagtgagagcatgcgggtctcatcatgcacgcggtcaatgacgtagtgccgcgtttcgtttttctctgaccggtcctccagcaccataccggcgcggtaggtctgagggagacggcgctccttagccgtcacaaacaccggtgtacgcgccgcaatactgaccgactcctgccccagcctgccggcatcctgcagcgcactcctgataaccccggtcagctgcgcctgctcgcgcgggcctgtcacaacggccgtaacgggcccctccgcagggtccattccggcatagcgctctgccagcgcctggtagcggtcgcgcttgtcctgaatactggtcacgcgcacctcaattccgtcagatggtgcggtcaggctctgacgctttacgcccgctgcagtcagcacagacagggcgttcgcatttgactgccgtccggcactatccagaaagagcagctgcgcattctgctgatgcgcctcatcggtgagcaccagcatttctttcaggctgagtttttccgcgctctcaacgatgaccgtactctgcggcatcaggctgaaggtgccatcaagcatccggctgcggtgaagcagccggtccctgagctcaggcgactttgcaaagctgagtgcgcgctcggctgaacttgtcagtacgcttacctcgcgcccctgctcacgtgacattgtcaccagtgtctctgtaacctcacgcagccggccgactgatgcaggtgcactgatgataacggcgggctcccgggcaatatgctcagggtgcccgggggaaagaccaccgtcggggctgaagttaattacccggttctctttcaagatatctgccgccagcgactgcaccgacagctcatccagcagatggatgtgcgaggtaaacacgcctttatcaccgtcgagaggcacgagcagattgtcatgaatagcctggtcaagcgcttggcgcaggtccggaatggtgttctgcagttcaccggtgttatgagcggtcagcagaagatccccgtaggtaaaccgcgttttactgtcgctcagtacagaaatggcagtgcggaccgactccatcgccggcacagggacgtcctgcacctctcccgcgtcaggacgggacatttcacgttcacgcgcttcattcatcacgccctggatgtcaaagccgatttcttccatctggcgctgccagcgcgcctgcagccgggcacggccgtcggccgtttctggtttagcgatcgggtcatctttagccgatggagacggcgctgatgtttctttatctgctgttgcagcctctttttctacggctgacaccgcacgctcaggaccagactctgtcggtaggtctttttcctgtgctgatggggttaaaggctctttatcccccgtttcagggaatttctctgcagctggcaccccatgtgccggttcagtctctgcaggaccatttttttcctgtgctggcaccgctaaagtttctttatccgccgtttcagggattttctctgcgtctgacaccctatgtgccggttcagtctctgccggaccatttttttcctgtgctggcgccgttaaaggctctttatctgccgttgcagagacttttccggtaacggtcatctcgtacgccggcgcaggctcagcctgcacaggtatagaggcagattcgggccggctgcgctccggtgccccctcgtcttctccatagcggctgatatcctgcttgcgctggcgcgtatcgagtgcggccacgtcgcggcttttgagcgaggcatcctcgccggcgcgtgcgtggatttcccggtgtcgcgaggagaactcatccagcaccgcttccgtaaagccctttatctcccacaaatcatgacggccgccggtcggcacggtttcgtaaccgatagcctcagccttgcttttgagcacgttgcggtagattttgccgtacgttatctggttgcggtacgccgtttcgataaagccggcaccgtgaatggtgtcggtggccagcgccttccacttgccgtccagctccgtgacgttggccattaccgcgtgtgtgtggatctgcggatcaaggttacgggaggtgtcatgcgtgaacagggcagcgaccattttaccgctggtcacgatgcgcgtgacgccttccttcgtatcccgggcgctgaccgtctgctccatgatggccagcgtctcttttaccgcgtcatggtgtgcctccagcaggcgtttatcgccgccggcaaggataagcattgagacacttttaggtgctgaaaaggtaaagtcgtgccccggacggtgtacgtgggcaccctgcacttccttccccagcatcacgccgttgggcagattgccgtgcagaatgccagtgaacgtatccaggtcaaccggtccctcaagtcccagttcgcgcgcaccctcccccatccactgcgtggggatgtcatccagaaagtaatagttatccttgctgctgtagtagccggcagcgtcggcggccgaagccaccggagcaacggtcatcatcgttcataccctcccgggtcaaggctgtcactcatctcctgatacgcgtcgtagtcgtcgcggtgtcgcaggatgttcttttcttcatcggccatgcgtgcgttggcatcgctgtactgccgggcatcagcctcttcacgcttttcctggtcagtttttcgcgggctgatgtgccggacgataaggcgtccgccgtcgtctttttccatctgcatgttcaactcgggagcctcaccccccggcgtgtcactgtcggtttctgctgagcctgccgtagtgccggtctgtaggcgccggattcggtccagcggagaaagcctcgggccgttatcagtctgtgcaaccccgggtgccggcagggtgggcgctatctctgctgttatgtccgctgtggattgcctggctggccgcggcctcacctgatgcgtactgatgggcaaaatagtggcgcggcgcgggaacggactgacgtttgaggtagtcagcacattgccgcccgatacgggagccggttcagtcgccttcagatgaggggagacatccagggaaagctcagtctctttctcttcaggcggctcctgtcgggttacaggaggagcagtttttaacgtgtcagcagacggagaggccggtgcaggctcagttgcggcggtagccgtggccgtggccgtggcggtggcggtggtacggtcaccgttttccagtatttcttcgccggtcggaaacgaaatgttcgccgcgcgggagctgcgttcgttgctctcgatgatttgttcgagctccggactcagccggtcatggaagtcacgctcaatcagcgcggggtgatattttttctgtttacggtacttcaggttcagctttaccaccgggtactcgcccggcaggcgcacatagaactgcaggttcggcatcttcataatctggtcgtagtccacgataggctcattgaccttgtccttactgatcgagataccatcacgcacctggtcaaggccgtagctgttctgctcgcgcgcctcacgccggcgctgatgacccagttcctcctccacgattttggccacctcagcgctcggcgaacggccataggcgcgggtgttcagcaggtcaaagatggctttagccatctcgcggccgtagatgtggattagctgcggcatgttctgaatgcccagcacgaaacagccgccgaacttgcgcgcctcggccagcgtttcgttgaactccggtatcttctgcaggctggcaatctcatcgccgataaaccacacgcgcctgtcgctgttctcgcccatgctctgcagcagcagcgtggccagcgacagccacatcgatatcagggggcgcacagccttgcggtggcgtgccgttgtggaaataaacagccagctgctgtcgtactgcgcatcggtcatccactcgcggatgctgaattccggcttaccctctttatccagcccctgcaggtagcgcagcgacttggcgtagttggtcagcaccgagcggatagagatggcggtcttctcgattttttcctcaaccaggttggccgacggggtgttcttcagaaactcgcgcaggcttttcaggtcgatggagagacaggtcttcaggaacgtttcgatgctgcggtcaggacgggacgcgaactgcatggccgtgtcgctgaagatggtgcgcgatgaggagacccagaacggatcggagtcgccctcaaccggcatcagcgcggccgtcatgttctcgtaatccaccacgtcctgcgcctcgcgccatagcacccagttctcacagcgcctgtcgtgcgcgttcaggattttgtccaggcgctcgtcgtagtgggtctcaataaacgtcccgccggagtcgtaaacaatcgcccggtcgccgcgccggcggatgtagtccagcagccagcggatgagggtggacttaccgacgccgatggtgccgtgaatgagatagttcataacctcggcgttcttcaccatgttcaggccgccaatctgcagatcggacttctcaccggcctttttcagcagccggttgacctctttaagctggtcagtaagggtcatgcccgagataaactcgtcttcactctcccgcttaccgatgcgacccacataccaggcaataaggcaccagagcaggctggcggcaataccgcaggcgctggcgataaagcgcaggttcgtcaggaactggcggcccatgtcctgcatccacggattggccagcagctgcgccggcgtcagctttatcgcgcacagctgcgcactttcatcgcagtgccagaagatgtcccatgtggcttcggccgcacgcggggacaggtccagcagagagtggctgggccacgctgcccagtaccagaagccgttacgtagcacgtcatcgggcgtcgtaagccagaacagcgcgccggtggccaccacgaacagcagcagcatccagtggaaaatccagttgctgacctgcacaaacatgcgcagccggtaggccgtcatctggccgccctgcgtcaggtatttgggtgtaaaactcatggggaactccgaatagcacgcaggcgcagcccgcccgagagaatcgggcaggctgacgacgaaagaaaagtggaagccgggccgctcgggccccggagattatttcagcttgacggacgcgggggtgcggataagccccgcccggcgcagcagccagacaccggccatgacggggatagcacaggtgaagacaaacagattccagcaggccagcgtgagcccggaaagcacgcagccggcagtcattaccagcagaaccagcagcagcgtgataacgcccgggggcatcatgtcgccctgcaccatgcgggtggcgaggtcccaggcataaagatggctgtgtgacatgatggtttttacgatatccggcccgaactgccacagcacgatggcgctccaggcgaaacacagggttaaccagataacaaatgtgcgtgccgcaccgttgaaagtgagcatagatatttccttcagaaagttagggtcggggatgaagtacagccgttacaacgcagactccggcgcgcgctgcggggaaagaaccccgctgagcatgatcgatacatgtcggttaaatctgagccacgcttccgctaccccgtatatcagggagaaacgtggaaatatgaggtcccgtaagggaggagggcagcacccgtggtgttgatgctgccccggtgtccgctgcccgaggggcgcagacgggggttggcaggcgccccgttgtcaggagagattttcttatttcccccttaaggcgcatgctgccggctttgcaaccggtcatgacttaataccaggaatttcagcaccctgcaagctgctatatcttaataactgtctccctgaaagttgcagaagcagctaagcagtatcttgcgttacatgatgccggcgactgatttagccaactgcgcttcaagaacaggctttgcctcttcaaacttcaggttcactttattagcgtttgaaacgacgcgggtctgatacttcatacggttgccttcttcactgctggtctgcagcttgaggccagagtttccctgcctcagcgctgccacattatctgtcgtcacggctgctttgctgcgttcggaaatctgtagatcggtcaccatcgtaaagttcgtgtcctcgaccagagcatctgctgccattcccgcaagccccgcggccaggcctatgcccagaatggctccacctgaattactgttataagcggtaatcccagcaccaagagcagcccccgcagcggcgccttcataccctgtcgacaggaagctttgtgcctgccgtaaatccatcttctctgctttcagaaacgttagcctgaatccagtaataagcagcatcagggctggaggttacggtatagccttttgcacgcaggtcctgcgccagtatcggctcaagatcgctcatgtctttatcagaggtatttcgcacctgcagataaaccgttttctgactggatggctccagccatacggtctggctcatctgcgttttgacatcgagattgcgctttttaatagctgtactcatggcactacagccggaaagcataagacaggcagcggtagtcgctgccacaaagacattgcggtttttcacaggtgcatccttatttaacagagaaaacggaaatggcgcgcccctgggcacgctgtattaactggaaggatttataaagaaaaccccttcagccagaatggcggaaggggtattagcaggaactgggtgtcttagatgtttttaataatcttagcgaatttgctcattgcgccagcaataccatagcgtgttaattctgaactgataatagcttgcatgatgagatgacttatcaaaagcatgaatggcgctgcataaaataactgcggattccaggctgctattaacgcgaaaatgccattgccaaagattgctgctatacaggtatttttgtatgtccggcttaacttctgtaccagaagcgatttacttctcaccgtctgaggtatagcggtcagcaacagaaacggtgtataagtcatagccataatcgctaaagataagattagtgtgaagccaccgaaggccagcgtcagcccctgataatgcagcgtcgggttaatccacacatcgtctggcggcacaaagctataaatgatgtatgcgaacgataatgcatacaacgacaaacaggttaccggaaaagcagcactcaatttcattgcatcgagtgcatttgggacctgctgttcgccagatgcaaaactattaagcagataatctgcgtccttcttgatatcgctatacatcatcccagcccccttacttatccggcacgccgtctaagctccgctatttttctatcaaagtcatcgcccagattgtctttgggtttctgaccctgctcatttaactctttattatgacccgctttgaaatttcctttagcagaatcatgttcgtgcttaagtatatcactggacgtctgaacagtagttttattttcggcgattttaccgtcattttccctgagagtttccataaggccagatctttgtgctgcgacctgattggcgacattattctgaattccggcgcctgcggcctgctcgctcactcgttttgaaccgctgcggaaatcctctctcatttcctgtgaaggtgcaccggccggaacgctgagattccgctctccctgccgcgtgctgacttcagctgtctgccctttcctgacgacagcattctgtgacgaaccttcagcaggtccatagctgtcagccggcgagctgcccgacagggcctgtccggaagtctgtacttcagcgggaagcgtggttccacggtccgcagatgtgcctgcagcatccagcgaacgtgacggctgcagcggctcactgttaacctggtcagtccgtgcaccatagttacgcatgatttcaggttcaagccgatcatgcataaattcagtagctgcgccctgcgcgcttctgacgtttgtcaggatgttctgggcgtcactgccatatttagcagtagtccagtccacaaactcctgattgtagttggcgtccaggctggcactctgcgtctgggaaagagtggccatgcggctgaattcctgactgcgcgtgctgctctcagtgtactgatggtactgactcttagcatcattaagcgttgctgcgaactgctgagcgttagagctggactgattatcagtatgactccctgaatcgctcagacgggtcgatgtcaccatatccatgccctcgcggaaatcacgtgcctcctgactgctctggtctcggcgactatcacgtccctctgaatggctgtcctgcgtaccatgcgagctgccggtagtgtgacgaaggtcagcactgatactggcttctcccccagcgctgacgccggtcgcccacttgccgagtttacccgccagctggtcaccggagtcaaatttaacctgacctctgacacccgtgccagcactgccctgattggtaatatccatcagctggttgtaggcctgctgttcagaaacattgtgcgacttcgcatagttctcaacggcagactgcattttgctcgcgcctttagagacattcgttgccacactgttgtcgctgccctgcgtcatgctgtcgctattaccgctctgctgcgtcagctggttcatctgctggaagccgctggtcacgctgtggttataaccatcaagcgaactctgcgcctgctgctgcgcctgccgtgcctgctcggagaaacccgctgctggcgagggagcttaatcgcatgctgactggcaggtttgatatcgcctggctggtatctaccaccgtatgcccgtctgccgtctgcgtcatcatcgcgttattgccggtctggaagccctgagcccccgagcgacgcagcatgttggtgtcaaacttgttggcactgacattat

SEQ ID NO: 19 - DNA, 4049253 bp, Pantoea agglomerans NY130 (residues 1-2,024,627 of 4,049,253)
gtcagggcggaatgtggatcggaaccttccacggtctggcgcaccgcttactgcgcgcccaccatcttgacgccggtctgccacaggattttcagatcctcgacagcgaagatcagctacgtctgctcaagcgcctgatcaaatcaatgaaccttgatgacaaacagtggcctgcgcgtcagggcatgtggtacatcaatggcaaaaaagatgaaggcctgcggccaaagcatatcgaaagctacggcaatccgattgagcagacctggctgcgcatctatcaggcctatcaggaagcctgtgatcgcgccggtttagtcgactttgccgagctgttgctgcgcgcccatgaattatggctcaacaagccacacattcttaatcactaccgtgaacgctttaccaacgtgctggtggatgagttccaggataccaacaacattcagtatgcctggattcggatgctggcgggcgacagcggccgggtgatcatcgtgggcgatgatgaccagtcgatctacggctggcgcggcgcacaggtcgagaatattcagcgctttctgcaggatttccccggcgcggaaacgatccgtctggagcagaactaccgctcaaccaataacatcctgaaagccgccaacgccctgatcgctaacaataatggtcgtctggggaaagagctctggaccgaaggcagcgatggcgaaccgatctcgatctactgtgcctttaatgagctggatgaagcacgcttcgtggtcaaccgcatcaaagtctggatggagaaacggcggcgcgctcaacgactgcgccattctctatcgcagcaacgcccagtcgcgtgtgctggaagaggcgctgctgcagagcagcatgccgtaccgtatttatggcggcatgcgcttcttcgaacgtcaggagatcaaagatgcgctctcctatctgcgtctgatggcgaaccgcaatgacgacgcggcatttgaacgcgtggtgaataccccgacgcgcggcgtgggcgatcgcacgctcgacgtggtgcgtcagacggcccgtgaacgtcagatgacgctgtggcaggcaacgcgtgaactgctgcaaagccgtgcgctggctggccgggccgcgtctgcgctgcaacgcttctgtgaactggttgattcactggcaaccgaaaccgccgagttaccgctgcatgttcagaccgaccgggtcatcaaagactctggcctgtggctgatgtatgagcaggaaaaaggtgagaagggtcaggcgcgtatcgaaaaccttgaggagctggtgaccgctacgcggcagttcagctatcaaaatgaagatgaagatctgatgccactgcaggcctttttatcccacgccgcgctggaagcgggcgaaggccaggcagacaaatggcaggatgcggttcagctgatgacgctccactcggcaaaagggctggagttcagccaggtgtttattgtcggcatggaagagggcatgttcccgagccagatgtcactggatgaaggtggccggctggaggaggaacgtcgtctggcttatgtcggcgtgacccgtgcgatgctcaagctgacgttgacctacgccgaaacccgccgactctatggtaaggaagtgtatcaccggccgtcccgttttatcggcgaactgcccgaagcgtgcatagaagaagtgcgtctgcgcgccagcgtcagccgtccggtaaaccatcagcggatgggtgccccggtgaccaaaaatgacagtggattcgcgctgggtcagcgtgttcatcacgcaaaatttggcgaaggcaccatcattaatctggaaggcagcggcgagcatagccgtcttcaggtggcgtttcaggggcagggaatcaagtggctggtggcggcttacgcgaagcttgaaacgctttagcgtgcggttgacggctttttcgtctcagcgtaacatgcgcccactattatcatgagaggacaatgccttggacacgcccagtcgatgctggctcaatgacctggattccaggaataacatctaaggctacctctttacgcgggtagccttagcggttatcagcgacctccctttttgattccgtcgcgagtcagcactgatttatctctgaaactctgtttccgtgttcaggctgcccgttccatgttgaggaacggcggactgccttgtcccatttagtctgcaatggggagtattgctatgctgagcgcatttaaactggatcacagccgcctgacgcgactggagctggaagacgaaaacgacaaactgacaacctctgtctgggtcgatctgatcgagccggaagagggcgaacgtgatcgcgtgcaatctgagctaggccagagtctggcaacacggcctgagctggaagatatcgaggcctcggcacgcttcttcgaagatgaagatggtctgcatatccactccttcttcttctatgaagacgctgacgatcacgccggtaactccaccgtggcgtttaccatccgtgaaggccgtctctacacgctgcgcgaacgtgagctgcctgcgttccgtctctatcgcatgcgcgcccgtaatcagaccctgatcgacggcaatgcctttgagctgctgctcgacctgtttgaaaccaaaatcgagcagctggcggacgaaatcgagaacatctacagcgcactggagaaactcagccgggtgatcatggaaggtcagcagggcgaagagtacgatcaggcgctgtcgcgactagcggaactggaagatatcggctggaaggtgcgtctctgtctgatggatacccagcgcgccctgaacttcctggtacgcaaagcacgtttgccgggcaatcagctggagcaggcgcgtgaaattctgcgcgatatcgaatcgctgctgccgcataacgaatcactgttccagaaggtcaacttcctgatgcaggcggcgatgggtttcatcaacatcgagcagaaccgcatcatcaagatcttctcggtggtctccgtggtgtttctgccgccgacgctggtggcctccagttacgggatgaactttgagtttatgccggaactgaagtggagcttcggttatccggcggcgatcggcctgatgattctggccggactggcgccttatctctatttcaagcgtaaaaactggctttaaaataagaacgggccatctgagatggcccgtttctgctggctcctgtccccatttctgcgtaatcttaccctcctgtgtttacaaattattaacttcttatggacgctttttcgttgcgcgcgcagtggacgctgctgctgctgatctcggtattgctgggcgcggtgctgcactattttcatgtgcccgctgcgctgttactgggaccgatgattgtgggtgtagtgatggggctgtcgggtgccacgctgcgaattgataaacggctgttcctgctcgctcaggccgtactgggctgcatgatttcgcagagtctgtcgccttcgattctggccccgctgattcaggactggccgatcgtgctggcggtgctgctgctgacgctggcggccagcggcctgtcaggttttctgctggtgcgcttcagtcatctgcctggcccgaccggcgcatggggatcgtcgccgggcggtgcaacggccatggtggcgatggcgggtgactttggcgctgacgtgcggctggtcgcattcatgcagtatctgcgggtgctgtttgtcgcctcggcggccgcgctggtggcacgcatcgggctgggtgatgaggcgcacagcgtctcgctgctctggtttccaccgctgaatcagggctttgttatcaccctggtggtgatgctgacgggcgcgtggctgggcacccgactgcgtattccttcaggcgcgctactgctgcctgcgctggcgggtgcggcactgcacagtagcgacatcgtggtgttacaggtgccggaatggctgctggctgtggcctatgcactgattggctggagcgtgggattacgtttcacccgcccgatttttctgctggcactgcgcacgctgccgcagatgctggcctcgatcttcgggctgatgctgttgtgtggcgggctggcgtggatgctgacgcgaatgctggatatcgatctgatgacggcctatcttgccaccagtccaggcgggctggacacggtggcgattattgcggcgggaacccaggtcaacatggcgtttgtgatggcgttgcagacgttgcgtctgtttaccatcctgctgaccggcccggctttagcgcgctttatttcacgttatgcgcgaacgggaacggaatgaaaatgccaccgcatcgcagacaaataccagcagcgccagccagatgaagccaaaggtcaccatcttgtctggtgtgatggtctcaccgtaaaacgcgaccgccagcacaaacatcagcgtcgggccgagatactgaaagaagcctacggtggaaagtcgcagacggctgcaggccgccgcaaacagcatcagcggaatggtggttacaatgcctgccgctatcagcttcaggttgagactcagtgggttggcggataagtggctggtggcgctgtcggcaaagccaaacaggtaaatcgccgccagcggaaacagccacagagtttcaatcagcatgccgctctgcgcatcgacctgaatctttttgcgcaccaggccatacagggcgaagctcagcgccaggcccagcgcgataatcggtaacgacccaaactgccacagctgcaccagtacgccgacggtggccagcagcacggcgagccactgcaagcggcgaaaccgttcgcgcaaaaacagcatgccgaacaccacgttgatcagcgggttaataaagtagcccaggctggcttccagcatatgctgattgttgactgcccagataaacagcagccagttgccgccgatagtcacggccgtcagcgccagcagcagcacttttttaggctggcgcaacacgctgcgaacgccgggccagctgcggctcagggtaatcagtaacagcataaacagtgcagaccagatcacccggtgcgtcatgatttccgtggcgggaacctgctttaccagtttgaaataagcgggcgcaatgccccagataaagtaagcgcccagtgcaaagccaacgccctggcgggtttgttgcgtatccatatgcgatccattcaatggtgtggttagccgataagataggtggcggtagccgtggcgatataatcgccctgttgattgtgcagttccacgcgcgccacggcgactttgttaccggcgcgcagcaggctgctggtggcggtgaagcgttcgccgcgtccgggacgcagatagtcgacgcgcatatcaatggtacccatgcgtgacagacgctggcgcagatccgcttcgctgatgctttcctgacgggttaacgcattactgacgcagaccatgcccgccgccacatccagtaccgacgcgataacgccgccgtgcagaatctgctgcgcctggttgcccaccagcatggttttgttattgaagctgatctctgcgtagtctgcgtcaaggcgcatcagttccaggcccagcgcctgattaaacggcatgtgataaacgaaaatttcgccgaccagctggcgagcgtcctgctgtgtcagcacgggtgatgacatgatgatgtgtcctgaaaaaatcgggccagaggggcgcggaacatgaatgagttgtgtattctatgccgcctgcgagggtgtttccagtttaagaaatcagcactcatgctcactgccatttgcgtgtagaatggcctgctttttacgacaccctttcagttactttgatacgcagctgctcaccggagaattttatgcgtaagcatcgcgccttgctggcggcaatgttgatatttcctgcgctggcgcaggcggatgaagcccatattaaagaggttcatgacgcgccacaggttcagggcagcattattgctaacctgctggagaagcatgataacccgtttgttctctatccttacgagaacaactatctgctttatacctataccagcgacctcaataaagaggcgatctcctcctataactggggagagaatgcccgcaaagatgaagtgaaattccagctcagcctggcgtttccgctgtggcgcggtattctgggcgacaactcggtgctggcagcctcttacacccagcgttcctggtggcagctgtcgaatagcgctgagtcatcgccattccgtgagaccaactatgagccgcagattttcctgggctgggcaaccgactattcgctggcgggctggacactgcgtgatgtcgaagtgggtctgaatcaccaatccaatggacgaagcgatcccacctcgcgcagctggaaccgcgtctatgcgcgtctgatggcagagaatggtaacttcctggcggaaatcaaaccctggtatcgtatccctgaaggggcgaacagcgatgataatcctgatatcaccaaatacatgggttactaccgcacccgtctgggctataagctcggcgacaatatcttcagcgtagagggcaactataactggaacagcggttatggcggcgcgaccctgggctggagctaccctatcactgagcacgttcgcttctatactcaggtgtttagcggttacggtgaatcactgatcgattacaaccatcgccagacgcgtctgggtgtgggtgtaacacttaacgacttgttctaatccataacgtaagacaggaatcgcgtggcaacctcggcagttcttaatcaggaagcgctggcgcagcaggtattgcaggataccttcggctaccagcattttcgtcccggtcagcagacgatcatcaatgaggcgctgagcgggcgcgattgtctggtggtgatgcccaccggcggtggtaaatcgctctgttatcagatccctgcgctggtgcgcgaggggctgacgctggtggtgtcgccgctgatttcgctgatgaaagatcaggtcgatcagctgctggcgaacggcgtggcggcggcgtatctcaactccaccatgacgcgcgagcagcagcagacggtgatggccgactgccgtaccggtagggttaagctgctctacattgccccggaacgcctgatgatggataacttcctggacagtctggcgcactggcaaccggcgatgctggcggtggatgaagcgcactgtatttcccagtggggccacgatttccgcccggaatatggtgcactcggcaagatgcgtcagcgcttcccggaattaccggtaatggcgctgaccgcgaccgcggatgaaaccacccgcaacgacatcgttaacctgctgcatatgcaggatccgctgatccagatcagcagttttgaccgccccaatattcgctacacgctggtggaaaaatttaaacccaccgatcagctgctgcgttacgttcaggatcagcgcggcaagtgcggcattatctactgcaacagccgggcgaaggtggaagacaccgccgcgcgactgcaaagccgggggttcagcgtcggggcataccacgccggtatcgacagcgagcagcgtggccgggtgcaggaagcgtttcagcgtgacgatctgcaaatcgtggtggcgacggtggcctttggcatgggcatcaacaagcccaacgtccgttttgtggtccacttcgatatcccgcgcaacatcgagtcctattatcaggaaaccgggcgagccggacgtgatggtctgcctgccgaagcgatgatgctttacgacccggccgatatggcctggctgcgtaaatgtctggaagagaaagtgcccggaccgctgcaggatattgagcgtcacaaactcaacgccatgggcgcgtttgctgaagcgcagacctgccgccgtctggtgctgctgaactattttggcgagggccgccagcagccgtgcgataactgcgatatctgtctcgacccacccaaacgttatgacggcctggttgaagcgcaaaaagcgctctccggtatctaccgcgtgggtcagcgttttggtatgggctatatcgttgaggtgctgcgcgggtccaacaatcagcgtatccgtgagcagggtcatgacaagctgccggtctatggactgggcaaagatcagagccacgaacactgggtgagcgtgttacgtcagctaatccatctggggctggtgacgcaaaacatcgctatgcattcggctctgcagctcaccgaagcggcgcggccggtgctgcgtggtgaagtgccactgatgctggcggtgccgcgtttaatcaccgcaaaaacaaaaagcagcagtccggcgaagtttcacggtggcaactacgatcgcaaactgttcgccaagctgcgtaagctgcgaaaagcgatcgccgatgaagagaatattccgccttacgtggtgttcaatgacgccacactgatagagatggcagaacagatgccggtcagcgcgtccgagatgctcagcgtcaacggcgtgggtcaccgcaaactggagcgctttggcaaacctttcctggtgatgatcaaagagcatcttgatgatgaagagtaaaggacactgattatgctgatgttattcgccactgtggcgctggtgcatctggtggcgctgatgagccccggccccgatttctttttcgtgtcacagactgccgccagccgctcgcgcaaagaggcgatgatgggtgtactgggcattacgctgggcattgtggtctgggcgggtgtggcgctgatggggctgcatctgattctggaaaaaatggcctggctgcatcagatcatcatggtcggcggtggactttatctgttgtggatgggctggcagctgatgtgctcggcacgtcagcgtcataaacagccgcagcaggatgagccggtggttgcgttgccgaaacgcggcatgagctttctcaaaggcctgctgacgaacctgtcgaatcctaaagccattatctacttcggcagcgtcttctcgctatttgttggcgacgatgtcggttcggcggagcgctggggtctgttcctgctgattgtcggtgaaacttttgcctggtttacccttgtggcggcgatttttgcgctaccgtggatccgcgctaagtatcagcgactggcgaaatgggtcgatggcatggccggcgtactgtttgccggttttggtatccacctgattctttcgcgttaaacaccgtttcagcccttatgccggcgtgcgcgttgcgcctccggcagaaacctcccttgctgtcgcttcctccagagagtttgcttgtgtgacggatgtcacattccagggctcagggagttttgctgttgcaaccgcagataaatcgtcactctttattaatcattcatatccatatctccattaaagtcgggaagcaggcgcaacgtttatggagaggatgatgagagtgaagttcatattactggtgttgatgacggcctgtatcagcgcctgcgcctcgccggatgccgcccgcaaccctgcgccagagccgggccagaccgatgaggtcacctcgatcctgatgcagacgctgcccgatgtcgatcagacgcagggcgaaaggattagccggatctctgcgacgtttctcggaacaccctatgaagcggatacgctgatcggttctcccacgcgtccggaagcgctggtgatcaatttcaacggtgtggattgttacacgctgcttgattacgtgcaggcgctgagccgcagccacgatcgtgccagctttgaggctaacctgattcaaacccgctacgctggcggtgaggtcagctaccggaatcgtcgccactttttttccgactggtttgccgatagcccgcgcaatgccgatgacgtgacccgcactcttagcccggatacggtgacggtggtgaagcacctgaatcgtcaggccagcggagcagaacaggtgcccggtctgggtgtgattgcacgtcctgtcacttacattccggcccgggcgatcacaccgcaggtgctgaagcaaattcagaccggcgattacgtgggggtttacgccaccagtcagagcctggatgttacgcatgtggggattgctgtccggcatgatggccgcttgtggttcaggaacgcctcttcgctggccgttaatcgaaaagttgtcgatgcgccgttcagggaatatatgcgttcgaagccgggcatcattgtgttgcgtgcggttccactgacagcgccgtagcggggccagggaagaagggataatctttcgcgccgaattcggcgcgtcagacgttaagcgatttttctggcgctggccagcagcgcgcctactgccataaacagcccgccaaaaatgcggttcattaacttcatctgttttggtcccttaatccagcccgcaatccgcgttgccagcgtggcgtagccaatcatcacgatgatatcgaccacaacggtggtgacgcccagcaccagatactgcataaatagcggctgatgcggctgaataaattgcgggaacagggcggcgagaaagacgatacttttcgggttggtcaggttaaccagcacggcgcgtttgaacaggcgacgacgcggcatcgctctggcgaccgcatccagatcaatgccacccgctgagcgccactgctgaatacccagccagaccagataggccgcaccggcccatttcagaatctcaaacgccagcagcgactgagaaaacagcgcgcccagaccgatgccgaccagcacgatatgcagcgccaggccgacctgcaaaccggagatagaggccaccgtgccgcgatagccgtggctgataccggtactcatggtgttgattgcgccggaaaccgggcgacaggctgagaattgtagtggtaagcagataggtcagccaccattcgatggtcatgggtcaggctctctttagtagcggaattgtgacacaatacgccagaaataagcgcggcgctacggcctgcgcatggcattcaggactctgtatccggtcatcaggagggcgaatgaatcaacacaaagccagctggctgcgacgagaaaaagcctttgctgccttcgctaccgggccactgctcgatttctggcacagccgcgaagagcttgagtttaccggcgtgggtaatctgacgctgcgctacgtccgcttcacatcaccgcaacacaagcgtgtgatcctgattgtgccgggacgcatcgagagttacataaaatatcctgagctggcgtacgatctgtttcactgcggatttgatgtggtaatccttgaccatcgcggccaggggcgttccgatcgcctgctggaagattcacatcgcggtcacgtggcggaatttacccattatgtcgacgaccttgaaacgctctatctgaaagagattatcagcggtcactaccagcagcgctatgcgctggctcactctatgggcggcgcaatcttaacgctgtttctggcgcgtcagccgcaggcgtttcatgcggtcgcgctggtggcgccgatgtttggcattgctttaccgttgccctcttttctggcccatcggatcctggactgggcggagaagcgtccggccatgcgcgatggctatgcgctcggcaccggccgctggcgtgcgcatccgtttggcattaaccggctgacgcacagcaccgagcgttaccggcgaaatctgcgcttttatgcggacgatccggcgattcgcgttggcgggccaacctaccattgggtacgtgaaggcatccatgcaggtcgcaacatcatcagtcaggtcgataagatcaccacgccactgctgctgttacaggccagcgatgatcgggtggtcgacaatcgttcgcaggaccttttttgtgccgcgatggcagcggcgggtcatccgtgtgagggcaataagccacgggtgatcgacggtgcgcgtcatgagatcctgtttgaaaaagatgagatgcgcgccgaagcactcaatgcagtggtcgacttcttttcctcgcaccactgacgttatttatccgaccggttaaggccggcagaaccagacacccgaggttttcatgtatcacatcgttgcatccgatctggatggcacgctgctttctcccgaacatcgtctgaccccttttgcgcgtgaaacgctgcagcagctggtcgcgaaagatattcactttatattcgccaccggccgtcatcatatcgatgtcggacagatgcgcgacagcctggcgattccggcctatatgatcacctcaaacggcgcgcgcgtgcacaacgcagagggcgaactggtgttcagtcataatctggatgaggatatcgccagcgatctgtttggcctgcaatatcatcacagcgatattctgacccacgtttaccgcgacgatgagtggtttgtcagccgctcaagcccggctgagcaggactatttccgcgagtcggtgttcaactatcaggtctatgagccgggtctgctgccaaccgataatatcagcaaggtctttttcacctgcgaaaatcccgagcatctgatcccgatggaacaggcgattgaagcgcgctggggcgatcgggttaacgtcagtttctcactgcctacctgtctggaagtgatggcgggcggcgtgtcgaaagggcatgcgctggaagcggtcgcgaaaacgctgggccactcactggaaagctgtatcgcctttggcgacggcatgaacgatgtggagatgctgagcatggcgggtaagggatttatcatgcagaacgcccatcagcggttgaaagatacgctgccggagctggatgtgatcggttcaaatgccgatgatgccgtgccgcagacgctgcgcacgctctatcttgcttaagccgtcagcgcaaaaaaagggccggatatccggcccttttttattgccgtcaggcaggggtctttttgtgtttgtgttcgctgaccatggtcagtaacagcaggataaccgccagcacacagccagcaatcatcaccatgaagccgccgtcccagccgaagtaatcgacggtgtaaccgacaatggcgctggccgccaccgatccacccagatagccgaaacaggccggtgaagcccgccgccgtccccgccgcttttttcggggccagctccagcgcgtgcagaccaatcagcatcaccggaccgtagatcaggaagccaatcacaatcatacaggccatatcgacgccaggattgcccgccgggttaagccagtagatcacggtcgcgatggttaccagcgtcataaagaacaccccggtcgcaccgcgattaccgcggaacactttgtccgacatccagccgcacagcagcgttccggggatccccgcatactcatacaggaagtaagcccacgacgatttatccagcgtgaagtgttttacttctctgagataggtcggcgaccagtcgagaatgccgtagcgcagcagataaacaaacacgttggccagcgcgatgtaccacagcagcttgttcggcagcacatatttcatgaagatctgtctggccgtcagctcctcctcatggctggcatcgtagtcgggcggatagtcgtttttgtactcttcaatcggtggcagaccacaggattgcggcgtatcgcgcatcagcgcaaaggccagaatcgcaatggcgatggcgccaaatgccggcatatagagtgccgctttccagtcgttgaaccacgccataccgagcaggaacagcagaggcggaataccgccgccgacattatgggcgcagttccagaccgaaacgatcctgccgcgctctttctgcgaccaccagtgaaccatggtacgtccacaaggtggccagcccatgccctggaaccagccgcagataaacagcagcacgaacatcaccataatgctggaggtggcccagggaacgaatcccatgatcagcatcactgtcgcagccagaatcaggcctgccggtaagaagacgcgcgggtttgagcggtcagagaccgatcccatgatgaattttgaaaagccgtaggcgatggatatgccggataaggcaaaaccgagatcgccacgtgaaaaaccctgctctaccaggtagggcatggcgagtgcgaagttttttctgaccagatagtaggcggcgtaaccaaagaagatcccgatgaaaatttgccagcgcagacgacggtagagcggatcaacgtgatcctccgccacctgcggctgacgtggtgcaggtttaaaaatgctcagcatcagtgaggccctccagggcacattatggtttttaattcccagcaggttggggcaggaaaagagcagaagaaaatggacgcagaatgttccatttcgcgcaaagaatagtgttagttgcgcaacgttactgtgatgaatgacacatttgttacacttttattacattctggagcggaagtgatcatgcgatggatcatttcgcgcattttatctggctgaaagatctttatgcagacagttatgtcaggaagcgaaagcccttttccgatggctattctgatcgcctggtttgtaatcagatgtcaaccagatttcacagcctgatggcagcacattgtttacactgacggcctgttaatttcggggtcgtcaccgtgtttttattgattattaccaccattctgtgggccttttcgttcagtctgattggcgaataccttgccgggcaggtggacagctggttctctgtactgatgcgactggcgctggctgcgctggtatttttacctttcctgcgctggcgtggtcatcgcccttcaacgctgttgctttacatgctggtcgggatgctgcagctgggcgtgatgtatctgctgagtttcgaagcctatctctaccttagcgtgtcggaattcctgctgtttacggtgatgacgccgctttatgtgacgctgatttacgatctgatcagccgtcgtccactgcgcatcggctatatcttcagtgcactactggctgtggcgggtgcggccattattcgctatgacaaagtcagcgatcatttctggtttggtctgctgttagtgcaactggcaaatatctgctttgcggcgggaatggtgggctataagcgtctgcaggagacccgcccgatgccgcagcacaccgccttctcctggttctatctgggtgcggtgttgattgcggtgatcgcctggtgtgcctggggcaatccacagaagttgccgaccacctcattgcagtggggcattctggtctggctgggcattgcggcttccggtctcggctattttatgtggaattatggtgcgacccaggtcgatgccggcacgctgggcattatgaataacatgcacgttcctgccgggctgctggtgaatctggctatctggcaggagaaaccgcactggccaagctttattgcgggcgcgctggtgatcctcgcctcgctgtgggtgcataagcgctgggtggtgggacgcggtgaccgatcataaacagggctgttgcatgggtgcggcctcccgggctggcgcgtccgatcgcgaaggaatctcacatccctgtggatcggccgggccatccctggcccggacgcttcgctcttcagacgcgccagccctggagacttaacagcatcatcgcagttgaaccaggggctcagagcgaatatgaaggaggggatggagcgctgaaacgtagagcattcgcgatggagctggcgtgtgcgatcgcgaaggaatcttccaggatggttcagaaatgctcccggcgcttttttcccctgcgacgaaggctctaccgatgacccgctttcactccccatggctggcctggtgttgctaattaaaaagccatgaagaagcttaaaggaagaggtggcgcaactgaggagcaaagcgtccgagccagggatggcgaggccgtgctgcatggatgcaggctttctttgcgatcagatgcgccacttctgaccacgcaggtacccgaagcgatcagccacagacgttaagcaggcttttcactcttaggacgctgaatcatcgccagccctttcaggaagttacgcagaatctgatcgccgcattcgcggtagttcttatgatcaggtttgcggaaaatcgcaccaatctcagcctgtgaaacggtaaaattcacgcgcttcagtacatcaggaatgtcggtggttttcagatcaaaagcgatacgcagctttctcatgaagatgttattagtcatcttgcgctcaatcgacggcgcgggcgcatcttcacttttgccgcgacggtagaagatcaggccattcaggaaataacccatcagcacatcggggcaggggcggaacgcagcatcgtcatcttttttcagccacgcctgaatatccgccagcggcacgtcacattgcgccagcgcaaaaatctccaccattttggcatcgctcaggttgagcatatagcgcacgctgcgcagaatatcattgttagtcatggtgaaattttctcgtggtcagtcgacaggctgcgcattataggggattttgcccgccttcgcgcaggtttgtgcccgccagattatcgctgcaacaccgcaccgggcagcgcggcgtcgcgcacaaaaggcagatgctcacaggcgtgctgacgggcaaagcggataaacgcttccagcaccggctgacgttgctccccttcgcgcacggccgcataaagacggctccacaggccatcgcccagcgtgcgggtgaccaccagaccctgcttctcaaaactctcaaccacccagtgcggcagtgcggcaatccccatacgcgccgagaccatctgaatcatcagcagggtgttatccacacttttcagtgccggactgacgcctgcgggctgcaggaagtgacgccagatatccagacgctgacgctgcaccggatagatcatcaacacctcatcggctagatcttccggcgaaatctgctcaacctgcgccagcgggtgatccgttgccagcaccagccgcacttcataatcaaacatcggggagtagaacagacccgagcgcgccaggatatcggaggtcagcaccacatccagctcaccctgttgcagggcgggttgaggatcaaaggtcacgcccgatttaaaatccatcaccacctgcggccagctctggcggaatttatccagcgcgggggtcagccactggatgcagctatggcactctatcgccacccgcagcgtggtctgatgcggctcatggcaggcctgcaatgcctgctgaatctgcggcagcacctgctctgccagctgcagcagaatatcgccctgcggcgtaaagcgcagcggctgacttttacgcacgaacaggcggaatcccagccgctgctccagatcgctgaactgatgagacaacgccgattgcgtctgatgaagctgggccgccgccgccgccagcgagcccgtattgcgcagagcctgaagcgtccgcaggtgcttgagttcgatcatgagagtccttcacatcgaaaatgaacatattgcgcttgagcaatatacagtacccgcagagtatagcagtgtaaacatctggacggctaaacatctttggctgcccatttaagccaaagtgaaagattatctggagaacagcacatgactatcctgaaccataccctcggctttccccgtattggcctgcgccgtgaactgaaaaaagcgctggagagctactgggctggcgacagcacgcagcaggcattactggcgacgggccgtgagctgcgtgcgcgacactggcaacaacagaaagaggcgggtgtcgatctgctgccggtcggcgatttcgcctggtatgaccatgtgctgaccaccagcctgatgctgggcaacgtgcccgcgcgtcatcagaacaaagcaggcactgtggacctcgacaccctgttccgcctgggacgcggtcgtgcgccgaccggcgagcctgcggcggcggcagaaatgaccaaatggtttaacaccaactatcactacatggtgccggaatttacccagggtcagacgtttaaactgacctggacccagctgctggacgaggtggatgaggcactggcgctgggacacaacatcaagccagtactgctggggccggtgacgtatctgtggctgggtaaagtgaagggtgagccgtttgaacgtctttcgctgctggagggaattctgccggtctatcagcaggtgctggcggaactggcaaagcgcggcatcgaatgggtacagattgatgagcccgctctggcactggagctgccgcagacgtggcgcgaagccttccagccggcgtatgacgcactgcagggtcacagcaaactgctgctgaccacctattttgacagcatcggccagaacattgatgtgattcgttcgctgccggtgcaggggctgcatgtcgatctggtccatggcagtgatgatattcaacaactgaatcagcaactgcccgccagctggctgctgtcgctcggcgtgatcaacggacgcaacgtctggcgcgccgatctgagccgctggttcagccgcttgcaaccgctgacaagagcgcgtgaacaggtgtggatcggctcctcctgctcgctgctgcatagccctatcgacctgagcgtcgagacccgtctggatgatgaagtcaaaagctggttcgcctttgcgctgcagaaatgtgccgagctctcgctgctgagtcaggcactcaacaacaacgatgcgacggcgctggaagcctggagcgcaccggtacacgcccgcgctcactcccgccgcgtgcataatgcggcggtgggccagcgtctgcaggccattaccccacagcacagtgaacgccagagcgcttatccggtgcgggctgtcctgcagcgtcagcgttttaatctgccagcctggcctaccaccaccatcggctcttttccgcagaccactgaaattcgcggcctgcgcctcgactttaaacagggccggctcgacagcaaccattaccgcaccggcatcgcggagcacattaagcaggcgattctcgaacaggagcggctggggctggatgtgctggttcacggtgaagcggaacgtaacgacatggttgagtacttcggcgaacatctggaggggtttgtcttcacacagaatggctgggttcagagctacggttcacgctgtgtgaaaccgcctgtcattattggcgatgtcagtcgtccggaggcgatcaccgttgagtgggccagatatgcccagtcgctgaccaacaagccggtaaaagggatgctgaccggtccggtaaccatcctctgctggtcattcccgcgtgaagatgtgtcacgtgaaaccatcgcgaaacagatcgcgctggcgctgcgtgatgaagtcgaagacctggagaatgcgggcatcgggattatccagattgatgagcctgcgctgcgtgaaggtctgccactgcatcagtctgaatgggccgcctacctgaaactgggcggtggaggccttccgactgaatgcggcggtggcgcgggatgaaacccagattcacacccatatgtgttactgcgagttcaacgacatcatggacgctatcgcggcgctggatgccgatgtgatcaccatcgaaacctcgcgatctgacatggacctgctggaggcgtttgaaaacttcgactacccgaatgaaatcggccccggcgtctacgacatccattcgcctaacgtccccagcgtggagtggatagaagcactgttgcttaaggcggcgaaacgtattccggaagcgcgtctgtgggtgaacccggactgcggtttgaaaacacggggctggacggaaacgcgtcaggcgctggcgaacatggtgacggcagcgaagaaattgcgtggagaaacggcgtagggaatcgggtctggtggacgaaaaaatcaggggcgcataagcgcccctttttcatttactgcgatgcaacaccatactgcctgaaccaggccagcatccgctgccagccatcattggcagattcagcatggtagcttgcacgatagtcagcattaaaggcatggcccgcttcgggatagacgatgatctctgcggttgcattggcggcatgcagtgcctgacgcatctgctcgacgctctccagcgggataccctcatcctggccaccatacaaacctaatactggcgcattcagatcgaccgcaatatcaataggatgtttctgctgcttcagcgtgcgctcaccggtcagtcgtccataccacgccacggcggcgcgcagttgcgggttatgcgcggcgtagagccagctaatgcgaccaccccagcaaaaaccggtgatgcccatgcgacgaatatcgccgccgttgcgtgcggcccagttagcggcatgatcgagatcggccagcacctggctgtcaggcactttgctgaccagctcgctgaacagcgtcgggatatcattatactcagcgggatcgccctcgcggaaatagagctcaggcgcaatcgccagatagccttccagcgccaggcggcggcagatatcccggatgtgttcatgcacaccaaagatctcctgcacgaccagtacgactggccacgggccttccgctgactggggttttgcaaagaatgccggcatattttcgccctggctgggcactgaggtttcacccgcgtgaatcgccgggctgtctgtaatgatggtggtggaggcggtgggctgcacggcaggggcaaagccgcccgtcgccggtttttgtgccatattatcactgggtttcattattctctccgtgcaagcatttgcgcaatcacgtaactatagcctggccggaaagcgtatgcgccaggtgtcgggtcacagaatcagcagcgaataaaatcatccttctctttaacattgcgcagaccctgacacagccccaccgagagctatccgcaccaggaagatgctattgtgtgattgtcgtcacaatttatctttcgggaaatgtaactttcattttcttaagtgaatgttgtcacatatttattgggcgtgctggcgtagagtggcgcgctaccttcccttaacaggagtctgaaaatgacacagtctgacgttttccatcttggcctgaccaaagccgatctgcagggcgccaccctggcgattgtgccgggcgatccggagcgcgtgaagaaaattgccggactgatggaagatgccacgcatctcgcctcacaccgtgaatttacctcctggctggcaaaaattgatggtaagccggtcgtggtctgctcaaccggcattggcggtccttcgacctcgattgcggtcgaagagctggcgcagcttggcgtgcgtaccttcctgcgtgtcggtaccacgggcgctatccagccgcatatcaatgtcggcgatgtgctggtgaccaccgcatccgtttcgcctggacggggccagcctgcattttgcgccgatggagtttccggcagtggctgatttcgcctgcaccaccgcgctggttgccgccgcagaagcctgtggcgcgaaaacacatattggcatcacggcctcttctgacaccttctatccgggtcaggagcgctacgacaccgtctcgggccgcgtagtcagtcgcttcaggggatcgatgaaagagtggcaggagatgggcgttctcaactatgagatggaatccgctacactgttaaccatgtgcgccagccagggtctgcgagccggcatggtggcgggcgtgattgtaaaccgcactcagaaagagatcccggatgcggtcaccatgaaacagacagaaagtgacgcagtgaagattgtggtcgaagcggcgcgtcgcttactataacgaccgcgtctggcagcaggttttttgtccagactcaaaacctgctgccggtagttaacggcgcgtaatatcagtgaaacctgagagtttttatgcgcaatactattcccgtccgacgtcctgcccctggtgctaatccggccgcactcaaagccatgctggaacgcagtgccgaacgtttccgtgccgccatgcaacagggcgactatgcgctggccgctcaatgctgtgaagaggtattgcgcacgatgcccaatcagatgcaggtgctgagcgactacgcgctctgcctgctgcgtctgggtcagtacaataaatcgtacaaaatctaccagaaaatttatcagtcaccgcccgctgtacagtctaccgcctctgaaacctggctggatggtctgaccgaagtgtgtggctggctggataaaaaggacgaggtggcgcgtcatgggctggcctcgctgatgcgctctgatgcgcgtttcagtcaggggcagcgcgccgcgtttcccgctccgcaaccggagcctgtcgatctcactcatccgcaccagaatgtcatcgctttctgcctctatggcgatcagccgcgctactgtgaaaccttaatcaaaaacgttgaagtggcgcttgaactctatcccggctgggtctgccgcatctatctcgatgacagcgtgccgcagcatgtctggcagcgccttgaccagccgcacgtccagctgatcgatatgtcccacgagaaaacgctgtttccgaccctgtggcgtttcctggtaatggacgatccgggcgtgaagcgttttatcgtgcgtgatgccgactcgctgctctcggagcgcgaagcggcagcggtaaacgcctggctggcgtcgccttactggttccaccatatgcgtgactacttctcccatactgagctgctgctggcagggatgtggggcggctgtcacggcgttttccgggatgtggaacaggcgatgcgcgatttcattgcgcagtatcagggcagccagcgcttcaccgatcaatatttcctcaaggtggcgttgtggccgacggtgcgtgaaagcctcctgagccacgatgagttgtttcattttcatcaggcccagccgtggcctgaccatgcccccgtgcgctggcagacgccgcatttccatgtgggcagcaatgccggttttgccagtatgaccggcaaatccagcgccgctgagggaagcagacagcgcgtcgcgattacctcgggcgggacaacctggcactatctggcgcaggttaaaaagggtgaatggctattgcccatgccgtttttcctgattgatgagtggcaggctggcaagctcacggtagcggcgctgtaaggcgctgaatcctgctaaaattatctggacattcatacagtgcgactctacctttccctcagcagcctgagtcgcgggggaaatcatggatcagcacatcattatcagcgcctgtctggcgcttgccgggttagggattggctggatgctggcacagttacgtgccggccatcaggtcgccagtttccagaccgagcgccgtctgcaggaagaggcgcaacagcgtcagcagcagcaaatcgaacagcttcagcagcagacgcagcagcgtgagcaggagcttcgtcagctgcacggtgctctgagcggcgccaatgagcggctgcaacagcttgattactggcgtaatgaaagtgagcagcttaatcgtgaactgcgcaatcagctggaggtcaacagcgcgcaggaagcggagctgcgtgaggtgaccattcgccttgaagagacccgtttcgccgcagaagagaaacagcgcctgctgaccaacagcgaacaacgccttagcgcccagtttgaaaacctcgccaaccgtattttcgaaaacagcggccgtcgcgtcgatgaacagaaccggcaaagtctggacgggctgataggcccgttgcgtgaacagcttgatggcttccgtcgtcaggttcatgaaagctttggcgcagaagcgcgtgagcgacataccctgacccatgaaatccggcagttacagcagctgaatgcgcagatggcgcaggaggcgcttaacctgaccaaagcgctgaagggcgataataaaatccagggtaactggggtgaagtggtgctgagccgggtactggaagcttccggactgcgtgaaggctacgaatatgaaacccaggtgagcattcagtcagaacagcagggcaggatgcagccggatgtgattgtgcgcctgccgcagggcaaagatgtggtggtggacgccaaaatgacgctggtggcctatgagcgctacttcaatgcggatgatgagatcgaacgagagcaggctattcaggaacatgtcgctgccatgcgggcgcacatccgcctgctgggacgaaaagattatcaacaattgcccggcttacgatcgctggattatgtgctgatgtttatcccggtggagcccgcctttttgctggccattgaccgccagcctgagctgattggtgaggcgctgcagcagaacatcatgctggtcagccccaccacgctgctggtggcgttacgtaccattaataatctgtggcgctatgagcatcagagccgcaatgcacagcgtattgccgatcgggcaacgcggctctatgacaagatgcggctgtttgtcgatgacatgagcggcattggtcacagcctggataaggcgcagaacagctatcgcgaggcgatgaaaaagctgtcagaagggcgcggcaacctgattgcgcagactgaaggatttcgtgcgctgggcgtggagatcaaacggccaattaatcctcagctggccgaacgagccatgccggaaaaccgggcggctgatgacgcagatgatgacagtgatgcggatgagagtgagatgcatgtgaggcgcctccacgaatagtatgggcgcagcgtgcctgacttccgtgactctgatacacttcgggaagtattgtttgtggagcaggtaaaaccgatggcagatgaatcacagcaggaaactacccattttggctttcagacggtcgccaaaagcgaaaaagctgacaaagtcgcggacgtgtttcactccgtagcggcaaaatatgacctgatgaacgatttgatgtcgtttggcgtccatcgtatctggaagcgttttaccattgacagcagcggcgtacgtcgcggtcagcgcgtgttggatctggcgggtggtaccggcgatctgacggctaaattttctcgcctggtgggcgaaacgggtcaggttgtactggccgatatcaacagttccatgctgaagatgggccgcgaaaagctgcgcaatcagggcgtggtcggcaacgtgagttacgtacaggccaatgccgaagccctgcctttccccgataactatttcgactgcattaccatctcttttggcctgcgtaacgttacggaaaaagagaaggcgctggcctctatgttccgggtactcaagccgggcggacgcctgctggtgctggagttctctaaacccgttctggatccgctgagcaaagcgtatgacgcctactcgttccacattctgccgcgtatcggacagctggtggcgcaggatgcagagagctatcgctatctggccgaatcgatccgcatgcatcccgatcaggagaccctgaaagcgatgatgaacgatgttggttttgaaaataccacttactccaatatgaccggcggcattgtggcgctgcatcgtggatttaagttctgagtgagatggtaatgaacctgacgcccttgattaccgcgggcctggaaacggcgctgaaccgtattctctatcgcgatcgtggcctgaaaccggcgcggcaacgcctgaatggcaaagtgctgacgctgcgcctgaatgagttctctcatccgctggtgctggtcttcagtgaacagcaggtcgatgtgttggctgactggcaggatcgcagtgactgcacggtgatcacctcgctgaaaaccctgccgaagctgcgcgatcgccagcagctgacgccgctgatccgtagcggtgaactgcaggttgaaggcgacctgcaggtggtgcagcagttctctgcgctgatggatctggctgagctggatccggcagaatatctggctccctgggtcggcgatatcgccgcacaggggatcagccagcgctcacaacaggcattacgctttttcaaaggtgaagtgcagcgtcgccaggattatctcggacaggccataaccgaagagtggcgtattgcgcctggctcgctggaattagcctggttttctgaggaggtcgacgcgatggaacgttcgcttgaggcgcttgatgcgcgtctggcgcagctggaggcaaaatgagttttggagagatccgccgcttatatctgatcatgaaggtgtttctgacctatggcctagatgaactgattcctcagacacgcctcactttcctgtttcgcctgtggcgtcgctctgttttctggatccctaatctgcatcagcatgaaccgatcggcgcacgtatgcgcatggcgatggagcagctgggtccggtctggatcaagtttggccagatgctgtcgacccgtcgtgatctcttcccgccgctgattgccgatcaactggcgatcctgcaggaccgtgttgcgccgttcgatggcgtcaaagccaaagcgcagattgaagcttcaatgggcgcgccgattgaaacctggtttgatgattttgatatcaagccactggcttcggcatccattgcgcaggtgcacaccgccacgctgaaatcaactggcaagaaagtggtgatcaaagtgattcgccccgatattttgccggtgattcgggcggacatgaaactgatctatcgcctggcccgctgggtcccgcgcctgttgccggatggccgtcgtctgcgtccggtcgaagtggtgcgcgattatgagaaaaccctgcttgatgagctgaatctgttacgtgaagcggccaacgccattcagctgcgccggaattttgaagatagccgcatgctctatgtgccggaagtctattccgactactgcagcgaaaccatgatggtgatggagcgcatctacggcattccgatttcagatgttgccacgctggagcgtcatggcgttaatatgaagctgctggcagaaacgtggcgtgcaggtcttcttcacccaggtcttccgcgacagcttcttccatgcggatatgcatcctggcaatatttttgtcagctatgaacatcccgaagatccacaatatatcggcatcgattgcggtatcgtgggttcactgaacaaagaagataagcgctatctggctgaaaactttatcgccttcttcaaccgtgactaccgtaaggtcgcggagttgcacgttgactcaggctgggtgccgcccgataccaacgtagaagatttcgagtttgcgattcgtacggtctgcgagccgatttttgaaaaaccgctggctgaaatctccttcgggcatgtgctgctgaacctgttcaacaccgcacgccgctttaatatggaagtgcagccgcagctggtcctgctgcaaaaaacgctgctctatgttgaaggcatcggccgtcagctctatccgcagctcgacctgtggaagacagccaagcccttcctggaagagtggatcaaagatcaggtgggattaccggctattatccgtgcggtaaaagagaaagcgccattctgggctgagaaactccctgagctgccggagctgttttacgacagcatgcgccagcacaaacttttgcggcacagcgtcgataaattagtgggcgatatgaatgcgcagcgcgtccggcaccatcaggcgcgttacctgttcggcgtcggtgcaacgttgctgttaagcggaacggctgtgctgctcacccgaccggattgggactttttcccggcggtgttgatggcagcaggaattgtctcctggttaatcggctggcgtaagacaaactgattgtcacgtccgtctaaaaaaaggtaatgtcgctggctcaggcccggttgaaaagggcactctgtggtgcattacctcatcgttttcacagaatattagaggctatctcatgggcggtatcagtatctggcaattgttaatcattgccgtgattgttgtacttctgttcggtaccaacaaattacgtaatctgggttcagatttgggttcttcgattcgtggcttcaaaaaagccatgggtgacgaggacgacaaaaaggatcaaccgaaagagcaggacgctgacttcgctgccaaaacgctggcggacaaacagcaaacttcggctaacaaagaagaagccaagaacgacaagcaggtgtaaaccgtgtttgatattggttttagtgaactggtattggtgttcgtgatcgggctgattgtactcggcccgcaacgtttaccggttgcggtgaaaaccgtggtcggctggatcagggcgattcgttcgctggcagccaatgtacaacatgaactggcgcaggagctcaagctgcaggagttgcaggagagcctgaaaaaggtggaagaagcgggccgtggcacgctctcacccgagctgaaagagtcgatggaagagctgcgtaaaactgcggattcaatgaaacgctcggtcagtcagagcatcgacattgaaaaagaggaagacgaggcaaacaccatccattcggctcagcacaggcccgcgcctgctccggctgagccttcggcgacaccggctacagcagaacatcaggccagtgccccggcacagacaccgtctgcggtttcagactcaggcccggcggtgcagccctctgccgcaccttctgccgtcgccaatgctcctgcaccggcttcttcagcggtttcatcaggtccggcggtgcagtcctctgccgcaccaaccgctgtggccagcgcaccggcacaggcgcccgctggcgacgttgccaggccggcagatcctgcgcgtcattccgctaccccctcttctgcaagtgatgaacgataatggccgttgaagatacccaaccgctcatcagtcatctgattgagctgcgtaagcgactactgaactgcatcattgccgtattagcgattttcctggtgctggtttatttcgccaacgacatctaccagctggtcgcggcaccgctaatcagccagatgccggtgggctccagcatgatcgcgaccgatgtggcctcaccgtttttcaccccgattaagctgaccattatagtgtcggtgtttcttgcggtgccggtgatcctctatcaggtctgggcatttgttgccccggcgctttaccggcatgagcgcaggctggttatgccgctgctgttttccagcaccttcctgttctacttcggcgtggcctttgcctatttcgtggtcttcccgctggcatttggttttttcaccaagacagcgccgatcggcgtgactgtagcaacggatatctccaaatacctcgattttgtcatgacgctgtttatggcatttggcgtggcgtttgaagtgccggtggcgattgtgttgctgtgctggaccggtatcaccagcccggaagagttgaagaagaaacgtccctatattctggtgggcgccttcgtggtcgggatgttgctcacaccgccggatgttttttcccaaactttgctcgctattccgatgtactgcctgtttgaagtcggcgtattcttttcccgttactatgtgggtaaaggccgccggttacaggatgaagaagagaataccgactcctgatgcggacagctttacccgcactggcgggaagcgatcaatccaaaccgccctgatgggcggtttttgtttataaactgtgggaaaaattatgtttgatatcggtgtaaacctgaccagcacgcaattcgcctccgaccggcaaaaggtggttaaacgcgcgcgtgatgcgggcgtcaccggcatgcttattaccggcactaacgcgctggagagccagcaggctcagcgactggctgaagatcaagcgggcttctgttggtctaccgcgggcgtccatcctcatcatgccagcgaatggtcaacggaaattgccagcaccctgcgtcgcctggctgaaaaaccggaagtggttgccatcggtgaatgcggactcgatttcaatcgcaatctgtcggctcatgagcagcaggagtatgcgtttgatgcgcagctggctctggcggcggaactcaatatgccggtctttctgcactgccgcgaagcccatgcgcgtttcgccgcagtactggcgccctggctgccaaaattgcctggcgcggtaatccactgctttaccggcacgcgtgacgaactggaagcctgtctgggcatgggattatcggtagggattacgggctgggtatgcgatgagcgccgtggtctggagttgcgcgagctgctgccactgattccggccgatcgcctgctgctggaaacggatgccccatatctgctgccgcgcgacatgcgtccacgcccgacttcgcgccgtaatgaaccctgctttttaccgcatattgtgcaccaggtggcgacatggcgtggtgagagtgctgaggaaactggcgacccgcatcgaccataatgcgcggacgttattcagactggcttaaatcttgcggaactgcttgttgtcgacgctgcgcattacctgcttgttcagcaaattaagcaacagaattgagcgcgtttcaccatccggctcggcaaagatagcgcgcagcccttcaaacgtcccgtcggtgatgaccacttcatcaccgctttgcggcgtttcagggtcaagcaggatttgcgggacgtctgtttccagcgcttcaatcacggctgaaggcactgtcgcgggcgtcgtgccaaagcgcacgaagtggctgacgccacgggtgctgctgatcgtcgtggtgtgaatggcttccggatcaaactcgataaacagataattcgggaacagtggctcactcacggtggtgcgtttaccgcgcacgatcttttccagagcgatcatcgggctgaggcaatgcacttcctgccgctccagatgctccttcgcgcgcagtagctgtccacgtttgcaatagagtaagtaccaggattccataactgctcccattgaatggacgctaagaatagcaaacctgttgccagagttatagcgcaggggcagggtaaagcgtcccgcaaagaaaataaactgagacttttcttaagatgcccgatggcagcagaaaaggtgactgaaaattgacgtctgctattgctctgtatcagactcaatgaccatcacatctgcaaaaggatcctctgatggaactctttctgttgagcaacggcaagctggcggatgatgcgccgctgctgggctatgcgcagccgcagctgcacgccatgatcgcccgacgcgctatccgctcggcggtactgatcccctatgcgattattcgtggcgatcagcagcaacgcgccgccgaaactcagtgcctctttgggcattcaggttgagcgggttcaggcattcgcctcaccggctgaagcgattgcgcaggcagagctgattttagtcagcggcggcaacacctggttcctgaatcagatgctgcatgagcagggtctgatcggggcgattcagcgcgcggtgcgggagcggcaggtaccttatgtcggctggagcgcaggctgcaacgtggcgacgccctcaatccgtaccacgaacgatatgccggtgcgcagcagcgtggtgctgcctgcgctgggactctttccggtgcagattaatccccactatctggatgccagcgtcagcggtcatatgggcgaaacccgtgacgaacggctggcagagttctgtgcagttaatccgactgagtcggtgattgcactgcgtgaaggcagttttctgcacgttcacgacaatcagctgcgctatcacagcgtgcgaaacgaagattttaaactgtttcgccacggcgagccgattcaggggtatcacgatgcccgcgcgttacaaccgctggttccctttcagtgcgtatgacgctgccatataaacctcagcataaccgcttaatcagacctataatggccgattcactctggccggaaagctaaagccgcatgaaatatcacgatttaagagactttctcgcgctgctcgaacagcgcggtgagctaaagcgcattacccagtcgatcgatcctgaactggaaatgaccgaaatcgccgaccgcactctgcgtgccggtggcccggctctgctgtttgaaaacccgaaagggtacgacatgccggtgctgtgcaatctgttcggcacaccaaagcgtgtggcaatgggcatgggccaggaagaggtcagcgcactgcgtgaagtgggtaaactgctggccttcctgaaagagccggagccgccaaaaggcttccgcgatctgttcgataagatgccgcagtttaagcaggtcctgaacatgccgaccaaacgcctgcgcaatgcaccctgtcaggaagaggtgttcagcggcgatgaagtcgatctgacgcggattccggtgatgaagtgctggccgggcgatgcggcaccgctgattacctgggggctgaccgtgacgcgcggcccgcacaaagagcggcagaatcttgggatctaccggcagcaggtgatcggcaaaaatcgtctgatcatgcgctggctgtcgcaccgtggcggtgcgctcgattatctggagtggacgaaagcgcatccgggtgagcgttttccggtctcggtggcgctgggtgccgatcccgccactatccttggggccgtaacaccggtgcctgatacgctgtcagaatatgcgtttgccggtttactgcgcggcaataaaactgaagtagtgaaatgcctctcgaacgatctcgaagttcccgccagtgcggaaattgtgctggaagggtatatcgaagcgggcgatatggcgccggaaggaccttacggcgaccacaccggctactacaatgaagtagatagcttcccggtgtttaccgttacgcatattacgcagcgccataagcctatctatcactccacctataccggccgtccgccagatgaacctgcggtgctgggtgtggcgctgaatgaagtgctggtgccgattctggtgaagcagttcccggagatcgtggacttctatctgccgccagaaggatgttcataccggctggcggtcgtgacgattaaaaagcagtacgcggggcatgccaaacgtgtcatgtttggcgtctggtcgtttctgcggcagttcatgtacaccaaatttgttattgtgtgtgacgatgacgttaatgcgcgtgactggaacgacgtgatctgggcgatcaccacgcgtatggatccggcccgcgatacggtattagtggaaaataccccaatcgattatctcgatttcgcttcgcccgtttccgggctgggatcgaagatggggatggatgcgaccaataagtggccaggtgaaacgcagcgcgaatggggtacacctatcgtcaaagatcctgcggtcaccgcgcgcattgatgctatctgggatgagctaggtatttttgatcagccgccacagcgttgatggcgagcacaaccataaagacgacccgacagagggaacgcatgacaacgttaagctgtaaagtaacttcggttgaggcgattaccgacacggtctatcgcgtttcgcctgatccctgaagcggaattcagttttcgcgcgggacagtatctgatggtagtgatggacgagcgtgacaagcgtccgttctcactggcctcaacgccgatggaaaaagatatcattgagctgcatatcggcgcgtccgatctgaacctctatgccatggccgtcatggatcgcatccgtaacgatcgccagattacggttgatatgccgcacggcgatgcctggctgcgtgaagagagcagcaagccgctgattctgattgcaggcggcaccggtttctcctatgcccgttcgattctgctcactgcactggcggaacagccagagcgcgatatcgccatttactggggcggacgtgagctcaagcatctgtacgatctggaagagctggatgcgctggcggtgaagcacccgaatctgaaggtgatcccggttgtcgagcaacctgaagcgggctggcagggccgttcaggcacggtactgacagcagtgatgcaggacttcagtacgctgagcgagcatgagatctacatcgccggacgttttgagatggcgaagattgcccgcgatcgtttctgtgccgagcgtggcgcggtggagtcacagatgtacggcgatgcgtttgcctttatctgattccctgtagcagcctgtagcagacagaaaaaacccgccgatttactggcgggtaaatctgacaaagtaagactcaacgtattacagacgctcgaatacggtcgcaatgccctgacccagtccgatacacatggtggcgaggccaaaacgggcgtcgcgtcgctccataatattcagcaacgttgtgctgatgcgtgcgccggagcagcccagcggatggcctaacgcaatcgcgccgccattcagattgaccttatcatctatccgttccagcaaacctaagtccttgatgcagggcagcgtctgcgcggcaaaggcttcgttcagctcaaacacatcgatatcactgacgctcagtcccgcccgtttcaatgccagtttgctggccggtaccggtccatagcccattatcgaaggatcacagcccaccaccgccatgctgcggatgcgcgcgcgcggtgtcagccccagctcacgggcgcgtgattcactcatgaccagcatggcgaccgcgccatctgacaacgccgacgatgtacccgccgtgacggtgccgttaaccggatcgaaggcgggtttgagtgccgccagtccttcggcgctggtctcctcgcgaatcacctcatcgaagtcatagcgtttaagaatgccgtcgctgtcgtgaccataggtggcgacaatctctgttgcaaagtccccacgctgggtggcctgccaggcccgctggtgtgaacgcagggcaaatgcatcctgctgctcacggctgatatgatgcatccgcgccagcatttcagccgttaagcccatcatgcctgctgcttttgccacagtacggcccagaccgggatgaaagtcgacgccgtgattcatcggcacatgtcccatatgctccacgccaccgatcagacagcactgcgcatcgccgaccataatggcgcgggccgcatcatgcagcgcctgcattgaagagccacacagtcggttgacggtggtggccggcactgaatgcgggatttcggccagtagcgcggcgttacgcgcgatattaaatccctgctccagcgtctgctgtacgcagccccagacgatatcgtccagtgatgtcgggttcaccgccgggttgcggctcaggagttcgcgcatcaggtgcgcagagagatcttcagcgcgcacgtgacgaaaggcgccgccttttgaacgtcccattggcgtgcgcaccgcatcaataatcaccacattttccatctttttgccctcaggcgcttttcagcgcggcttcatcaatcggtttggcggcgggataccagctttcatgctgatgggctttctgcaccagcagcgcaggcagggcatataagcctccgagcgcgctataacgccgggcctgatccaccacgttgctgttgcccagggtatcgagatagcggaaagcgccgccacggaaaggcgggaagccgagaccatagaccagcgccatatccgcttccgctggcgaggcaataatcttctcttccaggcagcgcactacttcattcagcattggcagcatcatacgattcaggatctcttcgtcgctgaagacccgcttaggctggcagacctgctccagcagcgtatccacttcggtatcagccacttttatcagcttgccctttttatcttcttcccagcgccagaagcctttgccatttttctggccaaaacgaccggcatcaaatagcagatcgatcgcatcacgatagtcatgcttcatacgatccgggaaaccgtcagccatgacgctttgcgcgtggtgcgcggtatcgatgccgaccacatccagcagccatgaggggcccatcggccagccaaactgtttttccatcactttatcaatctgacggaaatcggcgccgtcgcgcagcagcaggctgaaagcggcgaagtaagggaacagcacccggttaacaaagaagcccggacagtcattcactacgatcggggttttgcccattttgctggcccaaaccaccactttgctcagggtcgcttcactggttttctcgccacgaaccacctctaccagcggcatacgcggtaccggattgaagaagtgcatgccgcagaagttttccggacgctgcagcgcctgcgccagctggctgatgggaatggtcgaggtattggaggccagaatcgcatcttcacgcagatgctgttcggtttccgccagcacttttgccttgatcagcggattctctaccaccgcttcaaccaccacatcagcctgttcaaaaccggcgtaatccagcgtgggctggatagtggcgatcacactggcgagtttgttgccgtcgattttgccgcgttccagcagcttattgagcagcttgctggcttcgttcatccccagcgttaacgcctgtggattaatatctttcattctgaccggcacgcctttccacgcagactggtagctgatgccgccacccatgatgcctgcgcccagtaccgctgcctgagcgggtgcgccgctttcgctgccgcgctttttcgccagacctttcacgtactggtcgttgaggaagatgccgaccagcgcgcgtgcttcatcagactgggccagcggcacaaacgctgcggtttcaagtttcagcgcgtcatcgcggccaaggctggctgcggcttcaatagtttttaccgccatcagcggagcgggataatgcttgcctgcggtttgcagcaccatggctttcgcgatagtgaaactcatggccgcttcaatcgggctgagtttcagcggagccagcttaggggcccggcgggcgcgccagctgccatcagtggcagcagctttgagcatggtgattcccgcctcacgcagtttctcgcgagacaccaccgcatcgaccagaccgagtttaagagcggcattgccatcgacatcttttcccgccgcaataatttccagcgcactgtcggcgcccagcaggcgcggcaatcgcacgctgccgccaaatcccggcatgatgccgagtttggtttccggcaggccaatacgggcgtccgcagtagcgatacgcagatcggttgccagtacgcattcacatccgccgcccagtgcatagccgtcaatggcggccagagtcggtaccggcaaatcttccagacgattgaagatgctgttggcgtaactcagccactggctcagtttttcggtgggtgcatcaaacagtgaaaggaactcggtgatatctgcccctacaataaatgcaggtttagcggagctcagcagcaggccgcgcagtttctggctgctgctccagcacagctattgcctcgcccaggctggcgacagtttgcgtatcgagcttgttgaccgagcccgtagcgtcaaaaaccagctcggcgatgccatcgtccagccagtgaagagtaaggttagcgccttggtagagcatgtgcgtctcctgaaaccgcgaaaggtgatctggtcataccagatgatcgtgagtgtgggagcgatgttaattttttgcaaactggtctttgcttatttgctaacaagatcacagctgcgccgacttcggcatctgcgcaaggggtatgctaaactgcggccatttcgcgacactggagagacgtcaatggattcactgaagaccttgtatcacgcgcacatcgccacgttgcaacaacgggcgcagcaggtgctggcacgcaataaactggatgcgatgttgatccattccggtgagttgttgacggtgtttctggatgatcacacttatccgtttaaggtgaatccgcagttcaaggcctgggtgccggtgacgcaggtgcccaactgctggctctggattgatggggtgaacaaaccgaaactgtggttctactctccggtggattactggcataacgttgaaccgttgccggatagcttctggaccggggatgtcgacgttatcggcctgaaaaatgcggatgagatagcgcagttgctgcctgcacagcgtgataacgtcgcctatatcggcccggttaacgcgcgtgcatctcagctcggcatcgcctctggcaatattaatcccaaagcggtaatcgacttcctgcacttccatcgcagcatcaaaactgattatgaactcgcctgtctgcgccaggcgcagaagctggcggttgccggtcatcgcgcggcgaaagaggcgttctcggcgggcttaagcgagttcgatatcaatcaggcgtatctgaccgctaccgttcatcgcgacaccgatgtaccttacggcaatatcattgcgctgaatgagcacgctgcggtgctgcactacacccggctggatcatcagccaccggcgaaacgccatagctttttgattgatgcgggtgccgagtatcttggctatgccgctgatttgacccgcagctatgcggcgcagagcagttcgctctatgccagaatggttgaggcgatgaacactgaagagctggccctgatagccacgctgaaaccgggcgtacgctacaccgattaccaccttcagatgcatcagcgtattgcgaagatgttgctgaagtttgagctggttcagggaatcagcgaagaagcgctggtggctgaagatctgaccggtccgtttatgccacatggcctggggcatccgctgggtctgcaggtccatgacgttgccggttttatgcaggatgagcagggcacccatctcgccgcgccagcgcaatatccttatcttcgctgcacccgcgtgctgcaaccgggcatggtattaaccattgagccgggcttctatattattgactcgttactgacgccgctgcgtgaaggccgtttcagtcagcactttaactggcaggccattgatgcgcttcggccttatggcgggattcgtatcgaggataacgtggtgatccatgcgcatcgcgttgagaacatgacccgcgatctgcatctggcctgatggaggcctttgatattcccgctgtgccagtaagcagcagtgaggagacaatcaaaaagagtcgcttcattacgctactggcgcacaccgagggtgcagaggcggcgcgcgcgtttgtccagcaggttaaaagcgagcatcccactgcccggcatcactgctgggcctgggtagcgggcgcgccgaatgattctcagcaactcggtttctctgatgatggtgaaccttcgggtacggcagggaaaccgatgctggcgcaactgatgggcgcggatattggcgagattaccgctgtggtggtgcgttactacggtggcatcatgctgggaaccggcggcttagtgaaagcgtatggtggtggcgtccagcaggggcttaagcagctgccactgcagcgcaaagtgccgatgaagctgttcactttgcaatgtgactatgcacagctcagtgatattgaacggctggtacagcgttttgaaggtaaggtgaccgacagccagtttcaggatcgtattgcattgacgctggctgtaccttacggacagatcgacgggttcaaaaaaaatctgtcagactttagtcggggcgcgttatcgctgatcccgctcacaccatgatgttcatctcttttatttaaaggaacggctgaatgcactttcgcgccattacccgcatagtcggtctgctggtgatcctcttttcagtgacgatgattttgcccggcctggtcgccttaatttatcgcgatggcgcagggcgggcgtttagccagacctttatgatggcgctggtgatcggctcgctgctgtggtggccgaatcgcaaaaagaaaaccgaactcaaaccgcgggaagggtttctgattgtggtcctgttctggacggtgctgggcagcgtaggggcgatgccctttatctttgccgaacagccgcatctttcggtgacggatgcgttctttgaatctttctctggcctgacaaccaccggtgccaccacgctggtggggctggactcgttgcctaaggcgattctcttctatcggcagatgctgcagtggctgggcggtatggggatcatcgtattagccgtggcgatactgccgattctgggcgttgggggcatgcagctctatcgcgctgaaatgccggggccgctgaaagataataaaatgcgaccgcgtatcgccgagacggctaaaacactctggctgatctacgtcctgctgacgatagcctgtgcgctggcattgtggctggcgggaatgccagcgtttgatgctattggccacagtttctcgactatcgccattggcggcttctcaacccatgatgccagtatcggctattttaacagtggcaccatcaataccatcgtggcggtgtttctgctgatctcaggctgtaactacggcctgcactttgccatgttaagcggacgtaatctgcgtgtgtactggcgcgaccctgagttccgcatgtttattggcgttcagctgacgctggtgttgatctgtaccctggtgctctggttccataatgtctatgaaagtggctggcagacgctgaaccaggcctttttccaggtggtctccatggcgacgacggcgggattcacgaccgacagcatcgcacgctggccattgttcctgccggtactgctgttgtgctccgcctttatcggcggctgtgccggttcaaccggcggtggtctgaaggtgattcgcatactgctgttatgcaagcagggtaaccgtgagcttaagcgtctggttcaccccaatgcggtctacaccattaagctgggcaaccgggcgctgccggaacgtatccttgaagctgtatggggattcttctcggcttatgcgctggtgttcctgatcagcatgctggcgatcatcgctaccggtgttgatgacttctcggcttttgctgccgttgccgcgacgctcaataacctcggccctggcttgggggtcgtagctgataacttcacttcaatgaatgacgtggcgaaatggattcttatttccaccatgttgttcgggcgtctcgaggtattcaccttgctggtgctgttcacgcctactttctggcgtgaataattaataaggatgctgacatgaaagcgctgattctctattccactcgcgacggacaaaccaagaagattgcctcttctattgctgatgtgatccgccagcagcagcagtgtgatgtactgaacattcaggatgccactctgcctgactgggcacagtatgatcgtgtgttaattggcgcatctatccgctatggccattttcagccggtcgtcgataagttcgttaaacaacaccttcatgagttgcagcagcgtaccagcggtttcttttcggtgaacctgacggcgcgcaaacctgagaagcgctctcctgaaaccaatgcctatacgcagaagtttcctggcacactcgccgtggcagcctgattgctgtgccgtgttcgcaggcgcgctctattacccgcgctatcgctggttcgatcgcgtcatgatccagttgattatgcgcatgaccggtggtgagacagattcgacgaaagaagtggagtatacggactggcagcaggtaagcacttttgccaatgattttgcacagttaccaggcaaatcgtagcgaaatagcgcgatttgatgaaaattactgcgaacgataatcttttcgtaataaacacttgtcagcccgcgcgaactccctataatgcgcctccatcgacacggaacaccggcaacgggatgacaggttgagaggcacaggagactgcgccgccggagaaaaacttctgagaaagaggttgactctgcaggaggaaagcgtaatatacgccacctcgcgacaggacgctaacgcactgttcgcactgctctttaacaatttatcagacaatctgtgtgggcactcgcaggattgatatcagcgtctccggacgtaaaaaaatatcaagcctcacgagtgaacacataatgaaattcattatgacgttttacagatgagcaccgcttaacttgtttaagcaaatcaaacttaaattgaagagtttgatcatggctcagattgaacgctggcggcaggcctaacacatgcaagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccctgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttagcagagatgctttggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaagataccttcccgcgcagtgtccacacagattgtctgataaaaagtaacgagcagaaaaaacctctacaggcttgtagctcaggtggttagagcgcacccctgataagggtgaggtcggtggttcaagtccactcaggcctaccaaattcgcactcacgctgcgttatgtctccggctcgcatagttcactatgcttcgcggaaacatgccttgcctgagcacgaattacatttctcacgaagtgtactcggttgagtggtagtagtggtctctgcagtaactgtatggggctatagctcagctgggagagcgcctgccttgcacgcaggaggtcagcggttcgatcccgcttagctccaccataccgtttatctgttttttctgaaatacctcagagcataccggcgacggtgtgctgcgacgtattatgctctttaacaatccggaacaagctgaaaattgaaacgacgcagcgcgtcattcctccgtaataagggatgacaaggcgatgcgttcgagtctctcaaatgcttgcaattcgcagcgttgtaaaacgcctgtgggttgtgaggttaagcgactaagcgtacacggtggatgcccaggcagtcagaggcgatgaaggacgtgctaatctgcgtaaagcgacggtaaggtgatatgaaccgctacagccgtcgatgtccgaatggggaaacccggtgcactctgtgcatcattgcagcatgaatacatagtgctgcaaggcgaaccgggggaactgaaacatctaagtaccccgaggaaaagaaatcaaccgagattcccccagtagcggcgagcgaacggggagcagcccagagcctgaatcagtttgtgtgttagtggaagcgtctggaaagtcgcagggtacagggtgatactcccgtacacaaaagcacacaagctgtgagctcgatgagtaaggcgggacacgtggtatcctgtctgaatatggggggaccatcctccaaggctaaatactcctgactgaccgatagtgaaccagtaccgtgagggaaaggcgaaaagaaccccggcgaggggagtgaaacagaacctgaaaccgtgtacgtacaagcagtgggagccttctttatgggggtgactgcgtaccttttgtataatgggtcagcgacttatattctgtagcaaggttaaccgtataggggagccgcagggaaaccgagtcttaactgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaactcatcttcgggggtagagcactgtttcggctagggggccatcccggcttaccaacccgatgcaaactgcgaataccgaagaatgttatcacgggagacacacggcgggtgctaacgtccgtcgtgaagagggaaacaacccagaccgccagctaaggtcccaaagtcatggttaagtgggaaacgatgtgggaaggcacagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagccgtcgaaggtgtgctgtgaggcatgctggaggtatcagaagtgcgaatgctgacataagtaacgataaagcgggtgaaaagcccgctcgccggaagaccaagggttcctgttcaacgttaatcggagcagggtgagtcgacccctaaggcgaggccgaaaggcgtagtcgatgggaaacaggttaatattcctgtactcggtgttactgcgaaggggggacggagaaggctatatcagccgggcgacggttgtcccggtttaagcgtgtaggcggagtgtccaggtaaatccggacgcttgttaacgctgaggcgtgacgacgaggcactacggtgctgaagtgataaatgcccagcttccaggaaaagcctctaagcatcaggtaacacagaatcgtaccccaaaccgacacaggtggtcaggtagagaataccaaggcgcttgagagaactcgggtgaaggaactaggcaaaatggtgccgtaacttcgggagaaggcacgctggcgcgtaggtggagggacctgctccccgagccgaagccagtcgaagataccagctggctgcaactgtttattaaaaacacagcactgtgcaaacacgaaagtggacgtatacggtgtgacgcctgcccggtgccggaaggttaattgatggggttatccgtaaggagaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactacagcttgacactgaacattgagccttgatgtgtaggataggtgggaggctttgaagcgcggacgccagtctgcgtggagccaaccttgaaataccaccctttaatgtttgatgttctaacgtaggcccgtaatccgggctgcggacagtgtctggtgggtagtttgactggggcggtctcctcctaaagagtaacggaggagcacgaaggtcagctaatcacggtcggacatcgtgaggttagtgcaatggcataagctggcttgactgcgagagtgacggctcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgctggagaattgaggggggttgctcctagtacgagaggaccggagtgaacgcaccactggtgttcgggttgtcatgccaatggcattgcccggtagctaagtgcggaaaagataagtgctgaaagcatctaagcacgaaacttgccccgagatgagttctccctgactccttgagagtcctgaagggacgttgaagactacgacgttgataggccgggtgtgtaagcgcagcgatgcgttgagctaaccggtactaatgacccgtgaggcttaaccttacaacgccagaggcgtttttgagagacagattttcagcttgttcaccggatacagttgtgtcctgcggactgaagtccgaaggattttgcgctgaggcaaggcggcaaccgagcgatacgaaggagcatactgaagtatgtgacggagtagcgcgagggcggccaacgcagcatcagcacaaaagacacaggacagagcacaaagaatttgcctggcggctttagcgcggtggtcccacctgaccccatgccgaactcagaagtgaaacgccgtagcgccgatggtagtgtggggtctccccatgcgagagtagggaactgccaggcattaaataagtgaagaagccccgcacgaaagtgcggggcttttttacgtctgcgctttgccacgttaagctgaaacattttcattttctgcatcaaacctcgacatcttacaacgaacaggctaatgttgggcatctggatgtctaaacgtttatatggttgtaagaggtgagcaggttatgccaatcagggttcccgacgaattaccggcagtgaattttttgcgtgacgaaaatgtctttgtgatgacatcgtcgcgcgccagtgttcaggagatccgcccgcttaaagtgctcatactgaatctgatgccgaaaaagatcgaaacggagaatcagtttctgcgtctgctttccaactcgcccttacagatcgatattcagctgctgcgcatcgacagccgcgagtcacgcaatacgcccactgagcacctcaacaacttctactgcaattttgaagatatccagcatgataactacgatggcttaatcgtgacaggtgcaccactcgggctggttgattttaatgatgtcgcttactggccacagattcagcgcgttctgcactgggccaatgagcatgtcacctcaaccctgtttgtctgttgggcggttcaggccgcgcttaacattctgtatggtatccccaagcaaacccggcataacaaactgtctggcgtctatgaacatcagatactgcatccccatgcgttactgacccgcggttttgatgataatttcctcgcaccgcactcacgctatgctgattttcccactcatttgataacggattacaccgatcttgaactgtttgctgaatcggaacaaaccggtgcctatctgatggcgagtaaagacaaacgtctggtgtttgttaccggtcacccggaatatgatgccctgacgttgtctggtgagtaccatcgcgattatgaagcgggggtgaatccggaagtcccttataactatttcccgcaggataatccggtattgccaccccgcgccacctggcgcagtcacggcaatctgctgttctcgaactggctcaactactacgtttaccagatcacgccgttcgatctgcgtcacatgaacccaacgctggaatagtcctgtctgaagatcaactgaaccgtgttagccgatggcaacacggttttttatcgcctttaaaacgttaaatgaaagcgattcctttaatggattaaagttttatttcatataaaacatcaggataggttaatttatatttaaaaatggaaatagtttttgatttaaaaaaataaatgcttatgctctgatcctgtagctcacaaaataaacaccgtgtggatccgctgctttcgatcctttgaatacaggagaacgccagcatgacagactcagtgatcagccataccctgattttcagccagccctttagccatgcagaacagcaactgttaacgcccgaggctgtttcttttttagagtctctggtcgcacgctttgcaccgcaacgcgaagagctgttatcggctcgccagcagcgtcagcagcaatatgaccagggctatctgccagacttcgatatggaaacggcttccataagagccagtgaatggcgtattcaatctattccggcagatttagaagatcgtcgggtcgagatcaccggtccacccgatcggaaaatggtgattaacgccctgaactcaaacgttaaagtctttatggccgactttgaggattcgctgtctccggagtggtcaacgttgattgaagggcagctgacactgcgcgaagcagtacagggcaccctgagttataccagcgacaaaggcaaaatttatcagctcggcgctacccctgcggtactgatgtgccgggtgcgcggtctgcatctgtcagaaaaacatgtcagctggcagggaaaggcaattccgggcgggctgtttgatttcgcgctctatttcttccacaacgtccggccgttactggccaaaggcagcgggccttatttctatctgccgaaaaccgagagctggcaggagatcgcctggtggcgtgagatcttcagtttcagcgaggatcagttcgatctgccgcgtggcacgatcaaagccactgtcctgatcgaaaccttacccgccgtgtttcagatggatgagatcctgtggaatctgcgcgatcacattgttggcctcaactgtggccgctgggattacatcttcagctatatcaaaacccttaaacagcatgcggatcgcgtgctgccggatcgccagtccgtcaccatgtctcagccgttcctggacgcttattcgcgactgctgattaaaacctgtcatcggcggggggcttttgcgatgggcgggatgtcagcgctgatccccgctaaagatcccacgcgcaatgcctgggtactgcagcgcgtgacggaagataagcagcgggaggcaggtaacgggcatgacggcacctggattgctcatcctggtctggcagagaccgcgatggcggtcttcaacgctgcgctgggcgaccggccaaaccagctgcaggtcatgcgggaagaggatgcgccgatcacagcggagcagttgctggcgccctgtcagggtgagcgcaccgaagccggtatgcgcgccaacatccgtgttgcgctgcaataccttgaggcgtggatcagcggtaacggctgtgtcccgattgacggactgatggaggatgccgccaccgctgagatcgcacgcacctcaatctggcaatggattcgtcatcagcaaatgctgaacaacggccagcaggtcacagctgaactgtttctgcgctggcttaacgaagagctgcatctgctgcaaaacgcgctgggcgaagcccacttcagcgccggtcgctatgacgacgcggcgcagctgatggctcagatcaccaccgagcgcgagctggtttcctttcttaccctgccaggctatcgcctgatcccctgaacagaggagctattgccatgacacgtactcaacaaatcgatcaactggaacaactctggcagaccactcgctggcagggcattacccgcccttacagcgcagcagaggtcgtcaatctgcgcggctcggtcctgcccgcctgtacgctggcagagcgcggtgcggaaaaattatgggcgttgctgaatggcgaggcgaagaaagggtatatcaatagcctgggtgcgctgagcggcgggcaggcactgcagcaggccaaagcgggcatcgaagcgatctacctttctggctggcaggtagcggcggatgccaacgtggcggggcagatgtatcccgatcagtccctctacccggtgaactcggtgccggaagtggtgacgcgcattaatcagacctttcagcgcgccgatcagattcagtggtccagcggcattgaagcgggagacagccggcacaccgatttcttcctgccaattgtggccgatgctgaagccggttttggcggcgtgctgaatgcgtatgagctgatgaaggcgatgattcaggcgggcgcggcggcggtccacttcgaagatcagctggcagcggtaaaaaaatgcggtcacatgggcggcaaagttctggtaccgactcaggaagccattcagaaactggtggcggcacggctggctgccgatgtgatgggcgtgccaaccgtgctgctggcacgtactgatgccgacgccgccgatctgattacctcagactgcgatgaatacgatcgtccctttatccagggcgaccggacggcagaaggcttcttccgcacccacgccggcattgaacaggcgatcagtcgcgggctggcctatgcaccttatgctgacatcctgtggtgtgaaacctcaacgccggatctggcgatggcgcagcgctttgccgacgccattcatgcccgtttccccggcaagctgctggcctacaactgttcaccgtcgttcaactggaagaagaacctcgacgaccgcaccatcgcgaagtttcagcaggcgctcagcgacatgggctatcgcttccagttcatcacgctggcgggcatccacagcatgtggttcaacatgtttgatctggcccacgcctacgcccagggcgaagggatgcgtcactatgttgaaaaggttcagcagcctgagttcgctgcccgcgatcgcggttacagcttctcttcgcatcagcaggaggtgggcaccggctattttgatcaggtgactaatatcattcagggcggtaagtcctcggttaccgcgctcaccggttcgaccgaagagcatcagttctgacccttttcctctgactgatttcccgtccgcaaaccgcgggcgggcgtttaccggagctgattatgccgccacgcgaatcattgatcgcccacactatcctgcagggttttgatgcacagtatggtcgctttctcgacatcactgctggcgcacagcagcggtttgagcaggcggaatggcaggcggtgcaacatgccatgaaggcccgtattcatctctatgaccatcacgtcagcctggttgccgatcaactgcgggtgttgagcggtgcggccagctgggatgagatgttctggctgcgggttaaggaccactatcaaagcctgctgcccggctatccacggcatgaaattgccgaaagcttctttaattctgtctactgccggttacatggacatgccgatctgcagcctgaccggctgtttatcttcagctctcaatccctgaccgcaccggtcacacctttgcgcccgttatcgcgccgttatcagccggagcggggctggctggcactggtggatcaggtgttgagcgatttaccgctgacgttgccgtggcagcagcgcgctcgcgacgtcggctggattgtccgccacctgcagtcgcattttccccggctgaaccagggctggctcgaggttaacagtgaactcttctatcgtaacaaaaccgcctggctggtggcgcggctgcatctgccggaaggcatcttgccctgtctgctgccgatccagcgcagtgaaacgggcgaactgtggatcgacacctgtctgaccgatgtgaatgacgccagcattgtctttggttttgcccgcgcctatttcatggtttatgcgccggtgcctgcggcgctggtcgcctggctgcaaccgattctgcctggcaaaaccctggcggagcgctatatggcgattggctgccagaagcacggtaaaaccgagagctatcgcgagtatcttcaggcgctggcagagaatgagacggcctttgagatcgcacccggcgtgcgcggcatggtgatgctggtcttcacgctgccgggctttgactgggtgttcaaggtcatcagggatcgcttcgcgccgcaaaaagaggtgacggaagcgcaggtccgcgcctgttatcagcaggtcaaagagcacgatcgcgtgggacgtatggcagatacgcaggagttcgagcagtttgcgctgccgctgtcgcgtatctcaccggcgctgctggcagaaaactccacgcctgcgtggctgagaagctgcatatcgaaggcgatcgcctgattattcgtcacctgtggctggagcgccgtatgcagccgcttaatctctacctggcccaggcgaatgccgcagagcgacgtcacgcgattgaagaatatggcaatgccatccgacagctggcggcggccaatatctttcccggagacatgctgtttaaaaacttcggcatcacgcgccatggccgggtgattttttacgattacgatgagattcgcccgatgcaggagctgcacttccgggatgtgcccgcggcgcgctatgaggaggatgaactcagcgccgagccctggtacagcgtcgggccggacgatgtcttcccggaaaccttccgctatgcgttatgcagtgaagccgctaccggcgcattgctgttgcaactgcatccggagatattcgacgcccgctggtggcgcgcgcagcagcagcgcatcgcccagggtcatgtggaagaggtgatcgcctggcggcagacgcagcgtttcagcgtctgctacggcgcagataaagttaacgaccgctgtacgccagcgtaacctggcgcgcttcgcggatgaccagtgcacctaattcagtaatccgatcgtcagtcatgcgggcgatggggccggagatggagagcgcggcaaacgcctcgccatgttcgtcatagattggcgcggcgacacagcgtagtccaagcgcatgctcttcatcatcaaatgagaagcccgctttgcgcaccagcgccagattctctttcagactctgcggcgacatcagggttttcggcgtgtagtaatgcaatcctttctgatgcagcagggcggtgacctgctcatcgcccagatgggccagaaacgctttgcctgcgccagacgcatgcatcggcagcttgccgccaatcggcgcggacattcgcatcagctgggtacactgcacctgatcaatgatcaccgcctggtgatcgctgagatccagcaccgccagattcaccgtttcaccggactgctccatcaggctacgcagcaccgggtgtaccagcgccagcaggttacggctctgcaggaaactgctgccgaccacgaaggcgtgtgcgccgatcgtccacagcccgagatcgcccacctgccggacaaaaccctgctgttgcatggtgctgagcaggcgatgcgtggtggagttaggcaaacccgcctgctgagccagctcggtcagcgctacgctgccatgtgagtcagcaatcagctccagcagcgtcaggccgcgggtcagcgattgcacctgacctcccgcgggtgcggcgacaggggtgccacggggtttcttgccgcgcttaacaggaaccggggttgccatcattgttctccttttacattgtggaaatcattttcgttttaatcgcgcgctttgcaaacgctggttttctggtcagacctgtacagccgtgacctgaaaatctctcagtcgaggttactttgtcgcctgaccagcttgtgccagaatgaaaaacgggcttttccgccagcagactgacgtgaatggggcaacagtgagcaataaaatcgacgcgttaaaacagcagctcgcacaacgcattatggtgctggatggggggatgggcaccatgatccagagctataagctggaagaagaggattatcgcggcagccgttttgctgactggccttgcgatctcaaaggcaataacgatctgctggtgctgagtaaaccggcggtgatccgcgagatccacgacgcctatctggcggcgggtgcggatatcctcgaaaccaacacctttaacgccacgtcgattgcgatggcggactaccagatggaacgtttatcggcggagatcaattttgaagcggcccgcctggcgcgagcctgcgccgatgcgtggacggcgaaaacgccggatcgtccgcgttatgttgcgggtgtgctcggcccgaccaaccgcacctgctcgatctcacccgacgtcaacgatcctgcctaccgtaacgttacttttaatcagctggtggaggcgtaccgcgaatcgacccgcgcgctggtggagggcgggtccgacatcatcatgattgaaacggtgttcgatacgctgaatgccaaagcagccgtctatgcggtgcagaccgagatggaagcgctgggcgttgcgctgccgctgatgatctccggcactatcaccgacgcctccggccgaacgctctccggccagaccaccgaagctttttacaactcgctgcgtcacgccgaaccgctctcttttggcctgaactgcgcgctgggacccgacgaaacttcgtcagtatgtggcggaactgtcgcgcatcgctgaaggctacgtgaccgcccatcccaacgccggtctgcccaatgcctttggcgaatacgatctggatgcggaactgatggcgcagcagattggtgaatgggccaccgccggattcctgaacattatcggcggctgctgtggcaccacaccgcaacatatcgctgccatggtggcggcggttgaaggcgttgcaccgcgtcagttgccgacgatcccggtggcctgccgtctctccggtctggagccgcttaacatcaccgcagagtcactgtttgttaacgtcggtgagcgcaccaacgtcaccggctcggcaaaatttaaacggctgatcaaagaagagaagtataacgaagcgctggaagtggcgctgcagcaggtgcagagcggcgcgcagatcatcgatatcaacatggatgaaggcatgctcgacgccgaggcggcgatggtacgctttctgaatctgattgctggcgaacccgatattgcccgcgtgccgatcatgatcgactcctcaaaatgggaggtgattgagaaagggttgcagtgcattcagggcaaagggatcgtgaactcaatttcgatgaaagagggtgaagcggcctttatccatcatgcccgtcaggtccggcgttacggcgcggcgatggtggtcatggcgtttgacgaagtgggtcaggcggatacccgcgcccgtaaaattgagatctgccgccgtgcttaccggatcctcaccgaacaggtcggtttcccgccggaagatattatcttcgaccccaacatctttgcggtcgccaccggcatcgacgaacacaacaactacgccatggatttcattggtgcctgcgaagatatcaagcgcgagctgccccatgcgatgatctccggcggcgtctccaacgtatcgttttcattccgtggcaacgatccggtgcgtgaagcgatacatgccgtctttctctattacgccatccgtaaaggcatggatatgggcatcgtcaacgcaggccagctggcgatttatgatgatttgccggcagaactgcgcgaggcggtagaggatgtgattcttaaccggcgggatgatggcaccgagcggctgctggcgctggcggagaaataccgtggcggcaaaagcgatggctcgcaggaaaaacagctcgcggaatggcgcagctgggacgtggtgaaacggctggagtattcgctggtcaaggggatcaccgagtttattgagcaggataccgaagaggcgcgccagcaggtaccacggccgatagaggtgattgaaggcccgctgatgtccggcatgaacgtcgtcggtgacctgttcggtgagggcaagatgttcctgccgcaggtggtgaaatcggcgcgcgtgatgaagcaggcggtggcgtatctggagccctttatcgaagccagtaaagaagcggggcgcagcaacggtaaaatcgtgctggccacggtcaaaggcgacgtgcacgacatcggcaaaaacattgtcggcgtggtgctgcagtgtaataactacgaaatcattgaccttggcgtgatggtgccgggcgaaaaaattcttaaaacggcgcgcgaagtgaatgcggacatcatcggcttatcaggcctgattacgccgtcgctggatgagatggtcaacatggcgaaagagatggagcgtcagggctttaccttaccgctgctgattggcggcgcgaccacctcgaaggcgcataccgctgtcaaaattgagcagcattacagcggcccgacggtctacgtgcagaacgcctcacgtaccgttggcgtggtgtcgtcgctgctctccgccaccttaaaagaggatttcgtcgcccgaacccgcaaagagtacgagaccgtgcgcattcagcatgcacgcaaaaagccgcgcacgccgccggtctcgctgcaggcggcgcgcgataacgccacctcaattgactgggagagttacacgccacccgtgccgcatcgtcccggggtcagtcaggtggaggccagcattgaaacgctgcgcaactacatcgactggacgccattctttatgacctggtcgctggcgggcaaatatccccgcatcatggaggatgaggtggtgggtgaagaggcgcagcgtctgtttgccgatgccaatgcgatgctcgacaaattaagccagcagtcgctgctgaagccacgtggcgtggtcggtatttttccggctaaccgggtcggcgatgatattcatctctacagtgatgagcggcgtgatgagattttgtgtgtgagtcatcacttacgccagcagaccgaaaaaaccgacttcgccaactactgtctggcggattttgtggccccgaaatcgagcggcaaagcggactatctcggtgctttcgcggtgaccggcgggctggaagaggatgcgctggcggaggcgtacgatcgtcagcatgacgactacaacaagatcatggtgaaagcgctggctgaccgtctggcggaagcctttgccgaatacctgcacgagcgggtacgtaaggtgatctggggcttcgcgcccaacgaaaatctcagcaatgaagagctgattcgggaaaattatcaggggatacgtccggcgccaggctatccggcctgcccggagcacactgagaaagccgccatctggcgtctgctggcggtggaagaacagaccggcatgaagctcaccgaatcctttgccatgtggccgggcgcgtcagtctctggctggtacttcagccatcctgacagccgctatttcgccgtggcgcagatccagcgtgaccaggtggaagattatgcggcacgcaaagggatgtcggtcatggaagtggagcgctggctggcgccgaatctcggctacgacgcggactaaataaaaaagcggcctgagggccgcttcagactgctgacaaatccagctccggttaaatctggcagcaataatgaagaaactcaacgcgcagggaacccggtcagaggaggaaagcgtcccgcgccagggacggcgcgggccgagcggccagggatggcattagcgcctttccgatctgaccgggttccctgagcaggcgcgatctcattgctatgctttgcttcaggtgtatgctccctgagcctgctttctgttaaccgcatgaaacggccctgaggccgccatctgcttagttaaagcgcgcgtcgcgatcggacgtcagatcatacagctggtacttgcgacccagcatctgaccgccatcacgcgtcagcggcacccagttcacctgcgcgcgaccgcgcgttggcgtcacagtgaacagatccattgggatggagatatagaagcctttggtgaagtcgccttcgccatactcttcagacgagacgttggttttggtggcatagacacccaccatcacgccgctgtcgaagcgcttcgacacatcgaccgtcacacctttatctttcgccagatactgaccgacgctggttttcaccagtacatcctgcatgaaccatggacgccagtaacccgtcaggttgccggttgaggctttgtagcgattgaactgcatcatgttgtcccagtcacgctgacggacatagttggcatcgacgcccaccgcccagtttcgcatcgaccggacgatagagcagctcgccacccacgccgccatacatcgtctccaggtacccgccgtaaacctgaccatagaagccgttaccgaggtggcccatatagtttgcctgcagatcgttaacgtagacgttgttctcaacgtagtcgcggatatgggtacgcacgcgcggcagcgaagagtccgccggtgcgccgttgtagttgaacttgtcgtagttgttggcgaggttaccaaacagactaccgcccaccagcaagtgatccgtcagccagtaatcagcgttagccattacgccgacctgatacatatagaagctttccgggccgcccaccgactgattcagcacgggtgagaggctgtagttcaggcgatcctgacggataaacataccctgctcggtgctacccggatcgaccggttctttgcgggtctgttgcagtggctgctcatggcccagcggatagccttccagattgttacgcaggctggcgacctgcgtctcagtcgtcacctgtggcatgttaaagcgcgactcggtgacattgatggtgtcgatgccgtcaggcaggtggttcatgatgatgcggttcgcacgatccaccccttcacgggtatcgcgatacttcgtctgctcgcctgacacatagatcgtgtgaccctgagtctgaatacgcggaccatcaagaccggcattgtatttcagatcggtcagctgagtgcccaccaccgtcggctccagcaacttaggttgcggctgcggattgtaggaaggcttctcgctgtcgatgtgcgcctgacgcagatcgttgaagttggtgcgaatggtgacaccaaacataaaggtgttaccgcgttcgtagctggcgttgatgtcagcccagtcggtcacgcgataaatcgcgccgacgttgagcttgctgcgctgctcaaggcggccagcaaagtcattctggtagtcgttgccctcatactccattttaaggcgcagcggctgccagggcgtctgatactccacgccgccaaacagcgccgtcggaccgtggaacatctgcgagccgttgattgaacccgcttcgcccacctgcggacgctggcaatagctgtcgctgtatgagcagaaacgggttcttcacggtgccgctattgccgagatagccccagccaagccccagggtaaagtcgaacggtccccatgctttggtcgccaccaggtattcactgtcgaacagaccggtaccgcccagatcgcgggttcccaccgccacttccggcagccagaagccctcctgccacagacggagtttcaggtcgaaggctttatctttatagctctgcgtgccgctgaattctgagaccgcactgtactgacgggtgcgcacgtcggtataccgcacagtggtctccagccagggaaagagctgcagtgacgcggagtagtatcggtactgatcgttgtcgcgcgcgttgaggctgaactcgccctctttggccatgcgcgccgtcggcacctgcatcagacccacgccgccgaaatcggattgtgaagggcccaccggctcgggccaggtgtcagcctgcgcctgacaggctgctgccactgaaacagccaacaggctgaagagataacgttttttcatcagtctggtatccggtgagtcagtacggaaaggatgcgttcattaaggtcttcatagctgcctggcaggctccatgacgaaaagccgagccagataatgctacctggctccacttccgcgtggcgatgattccagtaggcaaccggcacctgctgtgtggcgcctgaaggtgcaatcacggtgacaaaattgcgttctgccccggagagtgcgtcatgaccatccagatagtcgcgtactgatttacccggctgccagctcactttgcctgcgccgctctgcgcgccgagcagcagtacagaatctgagggagcctgcagatagaggtcatagctgccttccagccgacggttgtcagccgtatgcagacggatccagtccgggtcgagcgacgtgaactggcgacctgctactttgatggcgctcagctggcggatcacctcatcaatggccgccgcccgatcgccgctgctgtcggcacgccaggcacgtaacgcacccagcgtctgttgatagtgctgctgtgccactgcgctggcgccgcgctcggcaataaaggtcgcacgccagtcagtgttgacctgcagtggaggcagagtcaccagctgggagagatccgcgacctggctcagctcagcctgaccgccgttgtgcggtgcatgaacgataacctgcgcagttgcctgcgcttctgcggcgctgaacaggctcagcccggccagcaaaaaagtgatttttttcatgatttcgccggcttcagaatagtgatatctacagggaaggcgtctgccgccagcatctgatgggcctgcaccacatcgccgctgctgttatcgatccagaaggtgttttcccactcgcggttactgctgtcgatgctcacctgctcatgccagacgcggcacggaatgcggttgcccgccacgatcaggacttcgtcggtgccgcgctggaaggttgaacgcacagtcgcgccgcgaaccttgccctgttcggtccactgcacgatgcgggtccagcctgcgccgttgctgatatgcaggctgtcagcgagcggatcctgttgcagattgctgacgctcagcaggttatccggcaagcccagggttttaaccaggcggccatgctgtgtcaccagcatcgcctgatcctgtgtcacccatttttgctgacctttctcgttgtagccgagcactacaaaaatgcgcggaccttcattcaggcgagcatagagactggcatagggaagattgttgacctgttgatcggtaacggtcacgtcgtccggaccgttaaccgcaagcagcagagtctgttcaagacctttttgcgtttgtgtacaggcctgcagcagcaggcaagcgagcagcagaggaagttggcgcactgtgtgtccctgataagtcatgccaaagtaaaaaataaccacacaggcgtgtggttatgtttaaaggtgctctgcccgtcccgtttccggctgcagaaatacaggttacgtggctcagcgtcctcactcaccgaagtcagtggttcagcctctgcccgtttgctgtagatcagcaatcagacggggtcgggcatccatcaacgagtggtgctcgtcgtggtcgtggttgttgtaccggtatttgcaccgtcaccaccgccagaagcggcaatgccgagcccgaccagcgcgccaagtgcaccgatacccacagcggtcgacgtgccagcagagattgctcccgcctgcgcgccagctgcggtaccagcttcttccggcgcagcaaatgcgctggaagagacggcaacgaagatcaaggctgcaccggcaaccatagtttttttcataacagcgtttcctgcattgagtgaatgaaggatctctgtccgctgaggttgcaacgcagtcagactgcggcaaaatcgacagacagtcccattgcgggcgcgttcagtatagggcaacaaaataccagagttcagcaccggaaaaaccagggtgaatagcggggtgggcgcgtgatttaattagctggattggggataactactttttatatcggaatatttcgggctgatgccagatatttcgctgctggcgaatcaattgcaaagcgtaatgttcttttttattaatatctggtacggaataagaataatcagaatttactcaggattgctgaaactgaatatgattatgaatcaatagctaacaatagagattacccgatttcaggaccattttatactttatgctggcccgttcagcgcatcgatgttcagaattatcttaggttattttaagacttttccctgacaacccatgctctccaacgatataaacagcccattcagatgtaaaaacagtcaaaaaaagggcggcaaagtggccgcccgatgaaattaacgccgattaacgccaggatttatagcggttaattaaggcattagtggagctgtcgtgagtggtaacttcgtcctcgttttccagttccggcagaatacggttcgccagctgcttacctaattccacaccccactgatcgaaagtgaagatattcaggatggcaccctgagtgaagattttgtgctcatacagggcaatcagcgcgcccaggctgtaaggggtaatctcacgcagcaggatggagttagtcgggcggttaccttcaaacaccttgaacggcacgatatgggctacagactctgcagatttaccggcatcggtaaactctttctctacgacgtcgcgtgacttaccaaacgccagcgcttcagtctgggcaaagaagttagagagcagcttcggatggtgatccgcgagcgcattatgggtaatggccggcgcaataaagtcgcacggaaccagcttggtaccctggtggatcagctgataaaacgcgtgctgaccgttggtgccaggttcgccccagatgattgggccagtctggtagtccaccggatgaccggcacgatccacatacttgccgtttgactccatattgccctgctggaaataggcggcaaagcggtgcatgtactggtcgtaaggcagaatcgcttcggtttcagcaccaaagaaattgttgtaccagatgccaatcagtgccagcagcaccggcaggtttctgctcagccggcgcagaggcgaagtgctggtccatggcatgtgcgccgctcagcagctgctcgaagttatcgaaaccaatcgagagaatgatcgacaggccgatcgctgaccacagtgaatagcggccgccaacccagtcccagaattcaaacatgttgttggtgtcgataccaaattcgcccaccgctttggcgttggtcgacagcgcagcaaagtgtttcgctacgtgctgctggtcgcctgccgttttcaggaaccagtcgcgcgcgctgtgggcgttggtcatggtttcctgggtggtgaaggttttcgatgccaccaggaacagggtggtttccgggctgaggtctttcagcgtttcggcgatgtgggtgccgtcaacgttagagacaaaatgcatgttcagatggtttttgtacgggcgcagcgcttcagtcaccataaacgggccgaggtcagagccgccgataccgatattcaccacgtcggtgatcgctttaccggtatagcctttccattcgccgctgatgatgcgctcagagaagcctttcatcttatccagcaccgcgttgacctctggcatcacatctttgccatccaccagaatcggcgtgttactgcggttacgcagcgcgacgtgcagcaccgcacgatcttcggtgcggttaatcttctcacccgagaacatagacttaatggcaccgctcaggtcggtctctttggccagcgcctgtaacttatcgagggtttcctgggtgatgcggtttttggagaaatccaccagcatctgatcatcaaaggtggcagagaatttggcaaaacgatcggcatcctgggcgaacagatcggcaatttctaccgacttcatctgctcaaaatgctgttgcagcgctttccaggctgcggtttgtgtcggattgatatttttcatggcaacactcttgttgatattaagaaccgtcattccatcggaggcacatcatgcccgtttagcgtttcagtatgaccacagttgtaactgaaaggaaaaattttgtcagcgcgcgccggacaggcgatctgaacgccgctgtttatcgccagcattcactggcgcgaacagccagcggaccgcagaggcaacgcgcggtaaagtgtgacgcgaaagtctgcgcaaaacgttgtgccgtatcagggattgctgcatgggctgaacccattaagcactgtagccgctgcgacgcagagccatttgttttctgatgcggcgctccgggcatcgctgacattgacagcaggtccagaaaaggctagatctatgcgcctacttgcgcacctgtgcgcaagccagaagaggcgcgtcgcccaggcagtgtgttggaggaaccgtatccggtgaaaacacatgatggggagcgacgccgaggtgggtcagcacgcggtgtgctgcctgtcggctacaggggctgaatcctctgggttgtcaccagaaacgtctgcagtcgacgtttcgcaaggtggggcgcttctgggtgactcgtctatccgatcttgtccgcccgtttctgctctttccttgtgcctggctgaaagaatgtttctcgaccctttcatcggcgagaacaagataacctgacacgaggtcctacatgtctcaaacactgatagtggcaaaattcggcggcaccagcgtagccgattttgaagcgatgaaccgcagcgccgatgtggtgttgcaggacgccagcacgcgtctggtggtgctctctgcttcggcgggcattactaatctgctggttgcgctggctgaaggccagcaggctccccagcgcgctgtgctgcttgatgatatccgccgtatccagtacgccattgttgatcgactgcagcgtccggaagtgatccgcgatgaaattgatcggatgatcgacaatatcagcatgctttccgaagccgcctcactggccacctcgaatgccctgaccgatgaactggtcagccacggcgagctgatgtcatcactgctgtttgtggaaattctgcgtgaacgccaggttaatgcggagtggttcgatgtccgcaaggtaatgcgtaccgacgatcattttggccgggcagtaccggatgtacaggtgctggcggagcaggcgacggcgcagttacagccgcgcattgagcaggcattagtcattactcagggtttcatcggcagtgaaagcgaagggcgcaccaccaccctcggtcgcggcggcagtgattacaccgccgcgctgctgggcgaagcgctgaacgcggcgcgtgtggatatctggacggatgtgccgggcatctacaccaccgacccgcgcgtggtgccgacggcgaagcgtattgatgaaatcacttttgaagaagccgctgaaatggcgacgttcggtgcgaaagtgctgcacccggcgacgctgcttcccgctgtacgccggggtattccggtattcgtcggttccagtaaggatccggcagccggtgggacccgcgtctgcaatgaaacccgcaacccgccgctgtttcgggcgcttgcgctacgccgtaagcagacgctgttaacgctgcacagccttaacatgctgcatacgtttggtttccttgccgaactcttcaatattctggcgcgtcataacgtctcggttgacctaatcaccacctccgaagtgagcgtggcgctgacgctcgacaccaccggttcgacctcaaccagtgccagcctgctaacccaggctttactgactgaactctcgtcgctgtgccgggttgaagtggaagaagatctggcgctggtggcgattatcggtaaccagctgtcaaaagcgtgcggcgttggcaaagaggtgtttggtgtgctcgacccgttcaacctgcggatgatttgctacggtgccagcagctacaatctctgcttcctggtgccgggcaacgatgcggaaagcgtggtacgtacgctgcatcgcaatctgttcgagtaggcttctgtggcattcaggccgcgtcagcgcggcctgaaaagcggcaaaaaaggttcatatctccctcattactccccggcacgcgacttccgataaatcccattaatacagaaagttacagcctgttattgccaaatggcaatccctttctctgcgcatttcgtgcacctgcattgcgctccctttccgcagatttataatcccgccgctgaatcaattcacccaaatttaggaaatatcatgaaaaggttagtcgcagaggcgctgggtaccttcgtactggtggccggcggttgtggtagtgccgtgctgtcagctgcgttcccggagctgggcattggcttcatgggcgtggcgctggctttcgggctgagcgtgctggtcatggcgtatgcggtcggtcacatctcaggcgggcactttaacccggcggtgaccctgggattagtggcaggcggacgttttcccgcgtctcaggctatcccttacatcatcgcgcaactggctggcggcattgccgctggcgcggtgctctatctgatcgccagcggtaaaggcgacttcagtgcagcggccagcggctttgcggcgaatggctacggtgaacactcgccgggcggcttcagcctgcagtcaggtatgatcgccgaaggggtgatgaccgctatcttcctgattgtgatcatgggtgccaccagcgagcgcgcgccgaaaggctttgcacctattgcgattggcctggcgttaaccctgatccacctgatcagcattccggtaaccaatacctcggttaacccggcacgcagcaccgcggcagccctgttccagggtgactgggcgatctctcagctgtggatgttctggttaatgccgattatcggtgccgtgattggtggtttgatctaccgcggtttagaggaaaaagcagcgtaatttcttcgatatgcagcggatcggcagcagtcgatccgcattttgccgcctcgccccatcttcgccttacgccatgataatgaaatgttatgatcccgccttcgtcacggcagtcgttcctgcatgatgactctctatggcaaatctgcataaaacataacattcttataaggaagtctggctatgctcgccacgttaacccgcctgttcccgctctgggccgtgctgttgtctgtcgccgcttattactctccaggtacgtttctcggcatcggaccctgggtcacttatctgctgatgctgattatgttcggcatgggtgtgaccctgaatatcgacgattttaaacgggtcctgacccgacctgcgccggtgattgccggaacctttctgcactatctggtgatgccgttagccgcctggggactggcaaaactgtttcatatgccgcccgatctggctgccggtatgattctggtcggctcagttgccagcggcaccgccagcaacgtcatgatctatctggcgaagggggatgtggcgctgtcggtgaccatctcgtcagtctctgcgctggtgggtgtgttcgccacgccgctgttaacccgcttttatgttgatacccacattcaggttgatgtggctggcatgctgctgagcatcgtgaagatcgtcgtgatccccatctccctgggactgatcatccatcacagcatgaacagcgtggttcgccgggtggaaccctggcttcctgcgttttcgatggtctgtattctgctgatcatcagtgcggtggtggcgggcagtcaggcctttattggatcggtgggtctgatggtgatcgcggcggtgatcctgcataacgcgattggcctgcttggcggctactggggcggtaagctgtttggcttcgatgagtcaacctgccgtaccctggcgctggaggtcggcatgcaaaattccggtctggcggcgacgctgggcaaactctacttctcaccgctggcggcattgccaggcgcgctgttctcggtgtggcacaacctgtcaggttcactgctggcgggttactggtcaggaaagccgattaagaagaagtaacagtggcggcgcattattacactgcgccgcatttcactgctgccgcgccggacgatcgccgctccggcgcggcaggttattcactccgctcagttttattcatagtcacgttcatcgtcgggctgttccagcaccgtgtaggccacactacaaaacagtgaattcaggcgcttcatgtcgcccagtaaaccgagatgcagcgaactggtctcaatactctgcacgttcttctggtgcaggcggtcaacatgcgcatgagagtagcggcggatcatcagacggaagcgatgtttagcgcggcgcagacgtttagcactggtgatatcgtgtgacagaaacaccgacagactcattctgaggttagcgatcagcagctcatgcagctcctgcagctcttttaatccctcggcagagaacgcgcggcccgctgccagcgatttgtcagcgacatcgccgctcatccgctcgatgatgtccccggcctgctccagatttagtgacatttcaatgatttcaccccagcgacgagagtcctcttcggggaggtcctcttttggcatccgcgccagatagagtttgatggcggtatagagcacatcgacatcatcatccagcctgcgcaccgtgcgttcctcgcgggattcgccatgcaccactttattaaacgcctccagcatctgctccagcacgtcacccatgcgcaacgcttcgcgggcggcattcaccagcgccagcgccggcgtatccagcgcgctgcgatcgaggtgcttcggcttgaggtgcagcgcgttatccacgtcgtcggcaatcatacggcgacagaggcgcgccatcaggtcagcaaacggcaccatcgccacgcagcggatcaggttgtaaaacacatggaagaaaatcactaactcttcatcgttgaccggcagcttatccagccactccgccacaatatcgacaaacggcaggatgaacacacagccgattagcttgaacagcaggctgccgagcgccacgcgcttgcccgcggcattcgagccgctggcgttgatcatcgccagcaggccgctaccgagattggcaccaatcaccagacagagcgccaccttgaacgaaatcacgccggtagcggtgagcgtcgcggtgatcagcaccgcggccaggctggagtaactgatgatggcgaacaccgcacccagcagcgcatcgagcatcacgtcgccggtcaggctggagaaaagcacctggacaccggcggcctgggtaatcggccgagccgcttcgacaatcagctgcagcgccagcaatatcaggcccaggccgatactggcccggcctaactgacccgcacgggtctgcttgcggctgaggaagaacaccacgccaaagaagataaacagcggtgagagccaggagagatcaaacgtcaggatgcgcgccataatcgcggtgccgacatccgcaccaagaatcaccaccagcgcgggcgtcaggctgaccagattctgcgccacaaaagaggtcaccagcagcgtggtggcgttgctgctctgcaccagcgtggtcacgccaatgcccgccagaaacgccatcggttttttttctatgctgcgactcaggacgcggcgcagatcggcaccgtagacccgcatgatgccggttcgtacgatatgcgtgccccagaccagcagggccaccgcagagagtaaattaagcagggttaacacgtggtgtcgctcctcgaatgtcaggcttaaagcacagactgccagcctgacggaagagagcaatctgtgaaggggattgccgtgctatgcgtgattttttcctgtgttttaagccacctggcgcaaagtcgacatctccaattgtagaccaatcttcctgccagcgggatgcaaatccgccgccgatcggttaagcacatcaaccgaaagttccacatcatgcgcccggatacgatagcggatcacgttgcccagcaggctgtggctgaggatttccgcaggaatgccctggcccggcgcggtgaacagcatcgattccgggcgaatggccacctggctgtggaaaggccgaccggtcagtcgcgtcgcctgctcagcgctcagcaggttgtagttgccaataaatccggcggcgaagagatcgaccggctgggtatagagcgcttcggcatcgccgttctgcacgatttttccccggttcatcagcacgatacgatcggagagcgtcagcgcctcctcctgatcgtgggtgacgaacagggtagtgagattcagctcgcgctggatgcgccggatttgatcgcgcagatggcggcgaatacgcgcatccagcgccgacagcggttcatccagcagcagcagacgcggacgcgtcaccagcgaaacgagccagtgccacgcgctgacactgcccgcctgacaactggtgcggataacggcgtgcataatcattgagttcaaccagctccagcacctccagcacccgctggcgaatctgcgcttcgggcagtttctgcatcttcaggccaaatgcgacgttcttctctaccgtcatgttgggaaacagcgcatagctctggaacaccataccgatggcgcgcttctgcggggccagcggcacgatatctttgccctccagcctgatttcaccgctgtcgacgccggttaatcccgccagacaacgcagcagcgtcgatttaccgcagccgctggggccgagcagggtgacaaattccccttcagcggcgctgaaatcgatctgctcaaaaatgggcgtgggtccataggacttgttcagctctctgacctcaaggtaactcatattcagcctcgttcgggattcagggcgttggccagccaggtaaccagcagcaccacaaagaagtaggagatcaccagggcgctggtgaagtgaccgctgccgttgcgcatgttgaagaggtaaacctgcagggtttcatagcggttgccgaccagcaggttagcgaagacaaattcgccaatcaggaaggagaaagagagcagcacggcaatcagcatccctttgcgcaggttgggcagcacgacccacagcgccgcctgccaggtgctggcacccagcaactgcgcggcatcaatcagctctttgaggttgatcgcctgcatattgttcgccagcgcccggtagataaagggtaacgcgatagtgaaataacagccgattaagatccacggcgtgccggtcagcatcagcggtgacgaagagtagagttgcagtaatcccactgacgacaccaccggcggcacggcgaaaggcatcaggatcaggacgttcatcaccgcatccagtcgaggaaaatagtaagcgattacaaacatggcaggcagcaccagcaacagcgagaacagcagcgcacccaggcaaatcagcagcgaatggcccagcgccgtcagaaatcgcgggtcgctccagagctggatgaaccacttcaggctatagccctgtggcagaatggtgttactccagtcggacgacagtgcataaagcagtgtggccagtaaaggcagtgccagcagggtaaagagtaacccgaccattatccggtgatagaggtgctcagcacgtgacatggcggctcctttcatggctgtttcgcattgagatagctacggcgcaccagatattgctgcaccagggtgatcagcgccataatcgccaccagcagcatcgccagcgcgctaccggtgttgggatccagcgagatatcgccggagaccagcgcggcaatacgcaccggcaccacgttgaaattacccgtggtcagggcataaatcgtggcgtaagcgcccagcgcattcgccagcaggatcacaaaggtcccgagcagcgccggaaacagaatcggcaggccgatatgccaccagtagtgccagcggctggcacccagcagcgcagcggactcctgccactcttttttcagcccgtcgaacgccgggtagagcagcagcacgcccagcgggatctggaaccaggtgtagaccagcaccatgccgttgcgcgagaagagtctgaagctctcaaccagaccataatggcgcaacagcaatgtcaggcagccgttcagccccagcagaatcacaaaggcaaacgccagcgggacacccgcaaagttgctggtcatattggtaaaagcgatgagaaagcgctgcagtcgcccgccgccaagctgatgcagtgaatagccggtgaccagtgcaatcagtaagccgtagacgcttgaccagagtgagatatccagcgaaaaacgaaacgcctgctggtagaagggcgaggtgagaatgtcctgatagttatcccagccccactggctgttcatctcactccagaagctgttaatggcgatccacaacagcggtgccagctgaaaggcgacccagaacagggtgaacggtaacagcagcagcagcgcgactccttttcctctcatctcttcggctccgccagcagcccgcgacaaaccggcttgtcatgcgccacctcaagcagttcacacagcgtgccgcacagatcggtctgttgcggtgccaggtcaggctgcagcgagaaagcccggccaaagacaaacagcggcaccgtggtctcttccggcagaataccgccgtgggagcgatcgtcattcatgccgtgatcggcggtcaccatcacctgatagccctcagccagccacaagggcatccactgcgacagcaggccgtcggcgatgcgtgcccggttgcggtactgtggtgaggagaggcccgatttatgaccggcatcgtcgatattcatcgggtggattaacagaaaatcgggatcgtgacgcagccgcaggctctctgcatcttcaaacagatgcgagtcgggatagctatcatcagaataaaaatggccatactgaatgggcaggtccggcgcgtcagtgtgacgatcgcgcgccggaacgaacggcgttcggttataaagctcactcacccagtggtaggccgccgccgcagtcgtcagtcccgccgatcgcgcaaagtgaaagatgctacgctcgcggcttaaccgactgacgccattatgaataatgccgcttctgaccggcggaacaccggtcagaatgcactcataaagcgggcgtgacagcgagggtaattcacaggtcatacggtaataaaacccgttgccctgcgaacattcggcatgcaggtaacccattgcatgttgtgcgacctgattgctcaggccgtccagcactaccagaatggtcttcattccgtttctccctgccgcgaattactgctgcatgttgatgatgacgttttcctgccacaggcgcggcagcattttcgacgatttatcccaggcagcctgatccttcaccggacgggcatttttatattcagattgcggcagcaggcgagcctgaacgtccgctggcagcgtcagatgttcagcacggataggacgggcatagcctttcgccagattgatctgtccctggtctgagaagatatattcgcgcgtcagttttgcggcgttagggtgtttcgcatatttgttgatgacggtggtgtagccggaggtcacggagccatcagacgggataaccacttcgtagcggtttttgtcgatctggtcccggtagttaagggcgttaaagtcccacaccaccgccatctgcacttcgcctttttcgatattggcaatcaccggatcggtaacgccaagacgaccctgtttagccagatcggcaaagaaagccagcgccggtttcaggttcttctcatcgccacctaaggcgtagtttgccgccagtacgccgttagccgcctgagctgccacgccgacgtcaccgatagtaaccacatacttaccttttttcagatcggcccagctatgggggatatctttaacctgctgcttgtcgatcagaaaggcgatggtgccggtataggccagcgcccagtggccatctttatctttagcccaggccggaatctgatcccagtgagtgggtttatagggctgggtcacacctttagcgacagcgatcgggccaaaggcggcacccacgtcaccgatgtcagcgctggcgttctctttttctgcatcgaatttcgccagctcctgcgccgatgacatatcggtatcgctgtgcttaaggccatatttgctgctgatgtcgttccaggtatctttccagttagcccagctatccggcatcccgacgctgttgacctggccttcactgcgtgccgctttttccagtgcggcaaggtcgttatcggcggcctgcgcaacgggcagggtgagcactacagcactggctactacagaggcgataaacgctttcatctcagttgctccgggtgtaagttgatgggcctggctggtctagtccagcaagaaccgagccaatgtagcccctgtatatgaacgatttatgacagggcggcgctgtgcgggggatgggtgatgaaagatgtgacccgttcgcctgtcacaggcgcatttacctgaacagtaagagtgcggagtcgcaccaaaatgaggctactgttgtggagtcgatagcactcaaaacggcggatgcgatcgccagcgtcctgctgacgcgcattcaggccggagagttcagcgccgggcgactgccggcggagcgtgccttaagcgaagcgttcagcacgacccggattaccctgcgggaagcactgggcaagctggaagcccagggaatgatctaccgggaactgcgtcgcggctggtttatcgcaccgccgcgactgatctataacccgctgcatcacagccactttcatgccatggcaatggagcagggacggcaggcggccaccgaggtcatcgccgccgaacaggtcgcggcgcacgacagcgtggcgacggcgctgcggctggcctccggtttcggcggtttactgcatccgccgcctgcggcgcatcgacgggcgcgcggtgctctatgttgaacactacctcaatccgcgtttttttcctggtctgcttgatgaagatttgacccgctcactgaccgatctctatgaccagcgctacggcattcgttacggcggcgcgcgcttcaccatcctgcccggcccgctgccggaggtcgccgcacccatgctgaatgtggcaccgggcagccccggtttgttgatcacccgcatcaatcgcaaccagcaaaaagaggtgattgattgcgactgtgaatactggcgttacgatgcgctctgtgttgatgtggaggcctgaggagttattgtgatttgcgtcacactcgcgcatgataccgcgcgctaacaactccttttttaaggcgcaacatgagtgacaaaaatcctttggcccgccaccttgcaacggtactgcaatgggtgctgaatctgggtctgctgagtctggcgatcatcctgatcgtctttttaggcaaagaaactatccatctggcaaacgtgctgtttaacaccagcgagcagtcatcctcctatctgttgattgaggggattgtcatttatttcctctacttcgaatttattgcgttgattgttaagtactttcagtcgggatatcactttccgctgcgctattttgtctatatcggtatcacggcaattatccgcctgattatcgtcgaccataaaaatcccttcgatacgctctgttactctgcggcgattctgattctggtaatcactctgtggctggcaaacagcaaccgcctgaaacgcgagtaatctccctgccgtctgtcatgacggcaggtgttcgcatcgcgtctctgcgctaaactagcgtcctgaaaattattgggagtggtgctatgtcgcaagacgcgctcagcttattacgtgcgctcaactggctttctccgtcgcaggcaacccttgcgccgccattgctcgactggctgatggaggaggattcaatgacgcgccgttttgaacaacattgccagcgggtcacggttcagccgctgcgtgaaggctttatcgacgccagcgaattgggtgatgaaaagggcttgttgccagacgatcaacgcttctggctgcgcgaagtgttgctgttcggcgacgatcagccctggctggctggccgtacgctggtgccggaaagcaccctcaacgggccagaagcgatgctgcagcagctgggcacccggccgctgggtcgctatctcttctcctcttcaacgctgacccgcgattttattgagccggggcaggtggagggattgtggggacggcgctcacgcctgcgtctctcgggcaaaccgctgctgctgactgaactgtttttaccggcatcgccgctctatcgcgatctggtctgaggatcctgtggtgcaaaatagcttaagtataaataaatggcgggcctacacgcgcctgatgcgtatcgataagcctatcggtacgctgctgctgatgtggccaacgctctgggcattatggctggctgacatggcgatcccgccgctgccggtgctggcggtgtttgttgccggggtcatcgtgatgcgtgcagccggttgtgtgatcaatgactatgccgatcgcaaagtagacggtcatgtcgaacgcacgaaacatcggccactggccagcggcgcggtgagtgcaaaagaggctaagctgctgttcgtgatactggctctggcggcttttgcgctggtgctgaccatgaacatgatgacgattatgctctccgtggtagggctggcgctggcctgggtctatccctttatgaagcgctatacccacctgccgcaggtagtgctgggtgccgcctttggctgggccattcccatggcatggtccgcagttagtgagtccttacctctggtctgctggctggtattcatcgccaacatctgctggacggtcgcctatgacactcagtatgcgatggtggatcgggatgatgacctgaaaattggcgtgaagtcgaccgcgattctctttggccgtttcgacaagctaattattggtctgctgcaactggcgacgctgctgctgatggcgctggttggcctcatgctacatctgaacagcgccttctactggacgctattactggccgccgcgctgtttgtttatcagcagaagttgatcgccggacgcgagcggcaaccctgtttccaggcttttctcaataataactatgtcgggatggtgctgttcctcggtgtactgatgaacaccccgccgttcagccagctgttctgatagagagtttccagacataaaaaggcgatccgggaggtcgcgaaacctgatgaggatgaatctggcagcaatggatgagctcaacgcgcagggaacatgggcagaagaggaaagcgtcccgcggcagggacggcgcgggccgagcagtcagggatgacgcttttgcgtctttccgatctgaccatgttccctgagcaggcaccgtcttacagcgaatcggaccagacctggcctataaaaaaggcgacctcatgaggtcgcctttttactatgcgcgctggggtcagtcgtgcgccacagcggtttcaatcgtcatacggacatcgctggtgaccaggtctgccagcatatgccaggtcgccagagtctgcgcaacatcggcatcaccgctgtcgctgatatacccttcatcgcgcagggtcagaaccagtgaggtaaagaccgctttgtcgaagaattccggagcattgataccgtgcagcaccgacagacgctgtgccagcgtccggctctctttttccagcgtgccgcggttaatcgtcggcttggcgctgagaatggagaacgtaatagcatagcgctgcagtgtttcacgcacaccggcggccagcagttgcagcgtgcgatagcgcgctgaggaaaagcgcaattcgccagcttcgagcgtaatcaggccctgacgcgccagctcctgactcagttcggtcagcagttgcggcagttcatcggtctgccagcgcaggaacagctcactcttcagcatcgggtagatcaggctcacctgacgcagcagttctgcttcgctcagcgtctgatgttgctgaacaatggcggcaatcagcgacggcatcaccagcatatgatgaatattgttgcgatagtaggtcatcagcaccgcctgctcacgcggcagaatgatgatgtcgccaatgctatccttttcactctcaaacttattcatacccatggcgtgatccagcagcgcttccgctgaaagatcgggtacggtcgcatttggcgagtaaggcacgttgcgcagcaattgggtatagcactccagttgttcaatcagctgttcacgggttagtgagcgctgacgtgacgccagcagggcggtgacacagaggttcatggcgttagccgcgcccgcttcattgatacgcaccatcaggctggcagcaatatcgttgacggttggggttaaccaactgggacgctgcggctcaatcggatcgatggcatcgcgccattccggcacccgcttattgagatagttgaccagcggcaggggttcgccaaagttcacgtaaccctgaccgagattgcgcagcttgcgtaagccgcgcaccatctgcatgaagccctctttctctttcgccgcgccgcgcagttctttagcgtaagtgcccacttccatcacgtgctcatagccgatatagatcggcaccagcgtgatggggcgatttccgcctcgcagcatcgcctgcagcgtcatggctaaggtgccggttttagggtccagcaggcgaccggttcgtgaacggcctccttcgacaaagtactcaaccgaatagccgcgggtgaatagctcgccgagatattcgcggaataccgtggcgtagagcttgttacctttaaaggtacgacgaataaagaaagcgcccaggcgacggaaaatcgggccggctggccagaagttgagattgataccggctgcgatgtgcggcggcaccagtccctgatgatagagcacataggagagcagcagataatccatgtggctgcgatggcacggcacatagacaatctcgtggccatcctgcgccagctggcggactttttcgccgccattgacgttgatgccctgatagagccgactccagagccagcccatcacgcggtcagttacgcggatggcttcataggagaagtttgccgcaatctcctccatcatttcgacggcgttctgctgcgctttctcatgggagatttttttgctgcgagcttcatcttctactgctttttcaatcgctttggattgcagcagacgattaaacagatcctgacgcgccggcaagcgcgggccaatcgccgccagccgctggcgggcaaaatgaatgcgcgccacgcgagccagcttctgggcgatcgactgatccgtaccgtgttcagttgccatgcggcgcagcgacactgtcggcgagaagcggacaaaactgtcgcgcccgtgccagatcaccgcaaaaaacttctgcaccccgttcagcacccgcaggtgtggcgttgcttcgccctggacttcacgtcctggtgcgcggccaaacatcaccgtgaccggcagcatctgaatatccagcttagggttattgcgatgcaggtccaggtaatcgtgaaagattttcacggattcaacgctgggcacaaaataggggaagacgcgagggccattgtggataaagacgtggcgcggcagcagagaaccatcaatctccagcggagtgagcgggtcgggcagatgatgccgcagacactgtgcgcgtaaagtcagtaagtcggccttcgaatcgtaaggcaaaacatacataataggtcgggtcggatccagaccatgttcagacacgggatcggccggaatggccttactttttaccaaaaacgacagtggtaaattaagcagtttgtaatagagtttacgccaacctgacatagacaacatgaagcctcttgttagcaaagcgccgcaagcataccagaaagcgcagcgaagatctgtggtggtgccaattgcacgcagcccagacattgacgtcaatccgatgaaagggttcccacatcatggcaaataatgccaccggacttatcagaatagtaaaagctgcaggttactcatggcagggactgcgtgccgcctggcaacatgaagcggcgtttcggcaggaagcgctggctgcgctggccgctattgttatcgcgtgctggctggatgtcgatgtggtctcccgcatcctcatgattggggcggtggtgctggtggtcattgttgaaatcctcaatagcgccattgaagcagtggtcgaccgcatcggtcaggagcatcatccgctggcgggccgggcaaaagacatgggctcggcggcggtgttgatcagcatcttactggcactcttcgtctggatcgcgctgctctggacacatttgcgataagccttccataacgcgtctgagggcgcgttttccctgacaatcggtttccatttcaccaatacctgtatatactcacagcgactgtataaacaaccagggggcgggatgaaagcattaaccagcaggcagcagcaggtctatgacctgattcgcgaccatatttcttcaacgggcatgccgcctacgcgtgccgagatcgccgcgcagctgggcttccgttcgccgaacgcggcagaagagcatctgaaagcgctggcgcgcaaaggcgtcattgagatcgtttccggtgcatcgcgcggcattcgactgttaatggaagaagaagcctcagaagggctaccgctgattggccgggttgctgccggtgagccgatcatggcgcaggaacatatcgaaacccactacaaggtcgatccgggcctgtttaagccgtctgctgacttcctgctgcgcgtcagcggaatgtcgatgaaagatatcgggattatggatggcgacctgctcgcggtgcataaaacccaggatgtgcgtaacggccaggttgtggttgcccgcattgatgatgaagtcaccgttaagcgctggaaaaagcagggtgctatcgtgcatctgctgccggaaaacagcgattttgacccgattgttgtcgatacccgtgcgcagtcactgaccatagaaggtctggctgttggcgtggtgcgcaacggcgagtggctctgattcttctgccagcgtgcattcgccttctctgatgctattctgtctgccctaattttgtcgctgcctcttttgcgcagcgacactgagcacggaacggcgaatgcgctttattacggcaaccgataaaaatctctggcggcttgcgctgccgatgatcctttcaaatatcaccgttcccttactgggagtggtcgatactgcagtaattggtcatctcgacagccctgtctatcttggcggggttgcggtcgggactacagtgaccagcttcctctttatgctgctgcttttccttcgaatgagtaccactggccttacggcgcaggcatttggcgcgggcgataaaatggcgctggcacgcgcgctgactcagccgctgatcattgcgctgctggcgggcgtactgttcatcgctttgcgttatccgattattcagctgtcgacccatctcgttggcggcaatcccgatgtactcgagcaggcggcactgtttattcagattcgctggctcagtgcgcctgccacgctggcaaacctggtcattctgggctggctgctgggcgtgcagtatgctcgcgcgccggtgatcctgctggtggtgggcaacctggttaacatcgtgctcgatctctggctggtgatggggctgcactggggtgtcgcgggggcggccaccgccacggcgctggcggaatacattacgctgggtgtcggcagcatcatggtctggcgggtgttaaaactgcgcggaattacgcttagcctgctgaagcagagctggcgcggtgacagcggccggctgctgcgactgaaccgggacatcatgctgcgctctctgatgctgcagctctgtttcgcctcgctgaccgtactgggtgcccggctgggtccggatgtggtggcggttaacgcagtattactgatgttcatcacttttacggcttacgcgctggatggctttgcctatgcggttgaagcttttgcgggtgaggcgcatggtgcaaaagatggcagcaaacttctgcgcgtctggcactctgcctgtcggcaggcggtggtggtggcgctgttcttctcgctgatctatgccatttttggcccgcaaatcgttaccctgctgacctctcttcagtcactccagcagacagcggaccgctatctggtctggcagatgattatgccgctgatcggtgtctggtgttatctgctggatggcatgttcatcggggcgacgcgcgggcgcgagatgcgtaacagcatggtagttgccgcagccggctattttctgacgctgcttagcgtaccggtgctgggtaaccatggtctttggctggcagtcacggttttcctggcgctgcgaggcctgtcgctgtggctcatctggcgtaagcactggcgtcagaacagctggtttgatgcatgagtcagccgtggctgcacgcaagccgatacggattattctgtattattccacggttaagaaattggctactacaattaactctatgcagcgcagttaaccagcgctttgtatcgttattttgttaagtagcaagataatcatcaaaacccgaggattggaggtctgccatgaataaagacgaagcaagcggcaactggaagcagttcaaaggcaaaatgaaagagaaatggggcaagctgaccgacgatgatatgcaggttatcgaaggtaaacgcgatcagctggtcggtaaaatccaggagcgttacggctctaccaaagatgaagccgagcgcgaagtaagcgactgggaaggtcagaacaaagatcaccgctggtaatcagacaatagcttgataatcagctgaatgtgttccggtgggccctcaccggaaaccgcacaaggatgtgccgattacccgcgtttcccccgctttttaccctcatcctgatggtcatgctcgcagctttcatggtgcgtacaggcttcaaccgcagcacaattttcacataaaccatgcgcttcaatcacgctatggcgtaatgcaaactgcgcttcacctgccagactagcaataatcttctctacgccctgcgcctgcttctctgtaacggcggcacagcggtcacagaccagcatcaccgatgtatgtgctggtgcctcaaaatggtgacacatgacgtagctgttgttggattccacccgatgaatgaaaccctgctccagcaggaaatcgagcgcccggtaaaccgtgggaggcttggcctgtggctcgctgacccggagttgatccagcagatcgtaggcgctgatcgagccaggctgctcggccatcaggcgcaacacttcagcacgctgcgaagtcagacgcacaccgcgctgcaggcacatcttttcggcctgaatcaaaatttgctgcgacgtcatgtttgtcatgaaaattctccgctggataagtgatgttattttatcacacatagtttcgcggcgctgaggttggttttcgtctgaaaaaacagcatcatttgcctgataaagcagcatattcagaatttaagccgtcttctatctcaaatctgacgacaaatcagatccattctgaatccacctgaagcggaatttgttggcattttgctttgcatctcactgagttaagaagtaatgttcagaaagacttaagaaaagcctggcattatttgaaatatcccaatgcagtttgaacaattacaacggttttttgattggaaaacgtccaatcctttgaattaagacactgtttcctttgaattcacagcaataacgcgttagccagggttcacaatagggctaacaaactattcagtcattgaatgtttcaatggcaatttctcaggtgatggcaggcaaatggtgaaaaaatccgctcaacgttcagcgctaatctacacagctgtaacgaccgcgcttttcctttcttcttccgccatggcggcagggacctggtatgatgcacgtaatgacgccatgggcggcaccggcgtagcatcttctctttatggctccgcagtgctggcgaaaacccggcattaatgacgcgcgccaaacccgacgatagcgtcagcattatttttccctcagcgggcattcaggtgactgacaaagataagctgatagataaagtggatgatattaccgacaccgtggaccgttaccgcgacgtgctcagtaatttaaccttcgctgattatctgcgtggctatcctgaagtgcgcgccgcctcaggcgatgtcgccaaccagctaaatgatttacgcggcaacaaagcggacggtaacgccggggttgccctggccgtcactatccctgacgagacgctgcctttcgcctttatcaccaaagcctatggctcagcgcacgtgcgtgccaatgtggtccagagcgatatcgactatctgcgcggtgtggctaacggcacagtgcttcctcgtcctggcgatcaaaataacctgcgctccagcgcgaatggcttagcggcgctggtcaccgattatggtgttgcggtggcgcatgagttcaccatcgctggtcagccagtatcggtaggcgttacaccgaaagtgcagaaaacctggctctataactacaccgccagtatttacaactacgacaaaagtgacatcaataacagccagtatcgcagcaccgacaccggctttaacgttgatgccggtctggcgaccacctttgctgaaaactggacgctgggtgtaaccggacagaacctggtttcacgcgatctgcagaccaaagaggtcaatggtttccgcgacacctaccagatccgcccgctggtcaccaccggtctggcctgggataaaggtccgtttaccgtgacgggcgatgtggatctgactgaaaccaaacgcttcaaaactcaggataacagccagtatgcggcagtgggcgcggaataccgcgtacttgactggctgcagctgcgtgcaggttatcgtgcggacatgcgttctaacgacgaaaatgtcgctacggccggttttggtctgtcaccgtttaacaaagccgtacatctggatctggcgggctctgtaggtgctaacaacacctggggcgcgatgatgcagctgggctttaacttctaagcgcgttaatcagactgttcgggggcgggcgatgcactatcgcccgcccttgtgttatccttgcacagaattccatcaccccttaattaccggattgtctgcgcttcatgcctaatttctcttcgcaacgtttctctatcgcccctatgctcgactggaccgatcgtcactgtcgctattttcatcgccagctgaccggtgacacgctgctctacaccgaaatggtgaccacgggcgcaatcattcatggcaaaggggattacctggcttacagtgaggctgagcatccggtcgcgttgcagcttggcggtagcgatccggcggcactggcgcagtgcgcgaagctggcagagcagcgcggctacgatgaagtgaatcttaatgtcggctgtccctctgatcgggtgcagaatggccgtttcggcgcctgcctgatggccgaggcgaatctggtcgcagatgccgttaaagcgatgcgcgacgtagtttcaattccggtcacggtgaaaacccgcattggtatcgatgagctggacagctatgaattcctgaccgattttatcggcacggtggcgggacgcggtgagtgtgagacatttatcattcatgcgcgtaaagcctggctctccggcctcagcccgaaagagaaccgcgagattccaccgctggattatccccgcgtctatcagctgaaacgcgattttccgcaactgaccattgccctcaatggcggcgtgaaaaccctggaagaggtactgacccatctgcaacaccttgacggcgtgatgatgggacgtgaagcctaccaaaaccccggcattctggcgcaggtcgatcagacattgtttggtcgtcagcatccggcggcgaacccggttgaagtggtgcgcgccatgtacccctatattgaagcggaactggcaaaggggacgtatctgggacatgtcacgcgccatatgctgggtctgttccagggaattccgggcgcccgccagtggcgacgccacctgagtgaaaatgcccacaaacccggtgccgatgtccgtgtgctggaggcggcgcttgcgctggtcgccgataaaatcccgcaggaagcctgacgcctcatctgaacccgaaaaaaccagctctgtttgctggtttttttacaccactatgtggtttttctcaccaggttgcgctcttctgtttatctcttatcagaatgaaatcaatgagttaactgttggcacgttttttgtaatagctataacaatcaatctcaaaaaggagcgctgacgtggaaattttattcgtattggggtttttcctgatgctgttgctgaccggcgtttcgctgttaggcgtgctggcggcactggtggtcgcaaccatcgtgatgtttgtcggtggactgtttgcaattgttattaaagtgttgccgtggctggtgctggcggtgattgcggtctggctgcatcgtgccttttttggcgacagcgatgagcgagcacgtcgcaagctgcggcgtaagatcaacaggttagaccgcaaaggctggcgctaaatgcggtgaagatcacagtgtgagagattggtcggggctgatctgcaattaaacatattttttacttatgttttctggcaggatgcctgtcgtcaaatcgatgtgccatcgactcgacacgaattcatcgccgctgtccctacaccagcgcgaacaaaaaataaaaaaagagaagggcttcccgcgggaggccctttttgttgctcactactatggaattaagagacaggatccctgcgtggcgcggctctccagcatctggtgcgctttgctggcctctttcagcgcaaacttctgctgctccggcacatcaactttaattgcgccactcgccagcagcgagaaaagctcggcactggcggtttccagctcctggcggttggtgatatagccaaacagtgaagggcgggtcacaaacagcgagcctttcttattcagaatgccgagatcaatccctgtcaccggacccgaagcattgccaaaactgaccatcagcccatgacggcgcaatgagtccagcgatgcttcccaggtatctttgcccacggagtcataaactacgcccacttttttcccgtcggtcagtttcgctgacgcgttgcgcaatattctcttcgcggtagttaaccgtcgcccaggcgccggcctttttcgccatcgctgccttttctgctgacccgactgtgccaatcaaatgggcacccagcgcttttgcccactgacaggcaattaacccgacgccgcccgctgcggcatgaaacaggaaggtctcaccggcgctgattttataggtctggcgcagcagatattgtgtggtcagccctttcaggtagctggctgcgccctgctcaaagctgatcgcctccgggagatgcatcaggcgatcttccgccacgttgtgcacttcgctataggcccccatcgacgccagacagtagaccacgcgatcgccgggcttaaataatgtcacgccacgtccaacccgcgacaccacgcctgcggcttctgtacccaggccagagggaaaagcggcgaccggataaagcccgctgcgaacataggtatcgatgtaattaatcccgatagcgcgatgttctacctgcacttcatgttcggccgggtcagcaggttcaaaatctgtccactctaaaacgtccgggccgccatgtgcgctgaactgaatacgctttgccattctgactcctgtgattgtttcatcatgagggtgaggcacgcaccccaactaaggtatacttgcgcgtccccacagaagatcggtaatgcattcactatggcaggaaataaacccaccaacaaatcgaacgaaacgcaggatcgccagctcgcaggcgtgaaaatgcccccgcattcgctggaagcggagcagtcggtgctcggtgggttaatgctggataacgagcgctgggacaatgtctctgagcgcgtcgtcgcgaatgattttttcaaccgctcgcatcggctgattttttcagagatgcagcggctgctggaaaacagcaaacctattgacctgattacgctctccgaatcgctggaaacccgtggcgagctggagatggcgggcggcttcgcctatctggcggaactggcgaaaaacaccccgagcgcggcgaacatcggcgcctatgctgacatcgtgcgcgaacgtgcggtggtgcgcgagatgatcgccgtcgctaaccagattgccgatgccggttatgatccgcaggggcgtaacagcgaagagctgctcgacttcgcggagtcgaacgtctttaaaattgcggaagcgcgcgcggataaggatgctggcccgaaaaacatcgagcagattctggaatcgaccgtttcccgtatcgaatcgctctatcagacaccgcacgatggcgtcaccggcgtcgataccggctatcaggatctgaataaaaagaccgcgggcctgcagggttctgatctgattattgtcgcagcacgtccttcgatgggtaaaaccacctttgcgatgaacctgtgcgaaaacgccgccatgctgcaggaaaaaccagtgctgatcttcagtctggagatgcccagcgagcagatcatgatgcgtatgctggcgtcactctcccgcgtcgatcagacccgcatccgtaccgggcagctggatgatgaggactgggcgcgtatttccggcaccatgggcatcctgctggagaagaagaacatgtacattgatgactcttccggcctgacgcccaccgaagtgcgttcgcgcgcccgacgcatctaccgtgaaaacggtggattaagcatgatcatgatcgactatctgcaactgatgcgcgtgccgtcgctgtcggacaaccgtacgctggaaattgctgagatctcccgctcgctgaaagcgctggccaaagagctgaacgtgccggttgtggcgctgtcgcagcttaaccgctcgctggagcagcgagccgataaacgtccggtcaactcggatctgcgtgaatcgggctcgatcgagcaggatgcggatttgatcatgtttatctatcgcgatgaggtttaccacgaaaacagcgatcttaaagggatcgcggagatcattctgggtaaacagcgtaacggcccgatcggtacggtacgcctgacctttaacggtcagtggtcacgcttcgacaactacgctggcccgcaatacgacgacgaataatccccggtttgtgctgtcatgcacgatctgtgcatgacagcccccatcatcacaaaatagtgttggacaacctctcgggttatcgggttatctgtaacaaagtgacgcctggcaccgatgtggaaacggaatgactcacgtagacgattacgaccttaaaatcctgactttattacaatccaacggccgtctgaccaatcaggaactcagcgatctggtcggcctttccgcctcacaatgttcccgccgtcgtatcaatctggaacaggctaatctgatcctgggttatcatgcccggctgtcgcccgacgccatcgggcttggcatggtgggattgattgaggtgcgcttaattaaccacaccgctgaatatgtcgagagctttcaccggatggtggagcaggagcaggcgatcgtggatgcctataaaactaccggcgatgcggactatctgcttaaagtggcggtggccgatctcaattcccttagtgcgttaatcagccagttagtcgcgggccaccagagcgtttcccatgtgaaaacctcggtagtgctgggacgcatgaaagagaacgggctgatgatgctgcctgagcacaagacgcgctaaaaaggtgcgcgctgtacgcttttggtgcacacttgcggcaattaatgcgaagagcgtgcatcgaaacggactttaacgcataggttgacggtatcagccggaatttatgcacaaagttctgttttaaagcgccttagatatcaatgggatatcgctggcacccggtttacagcagttcagtgctgtggcgatggtgcgttttttgcatcgaaaccgcatcatttgccctgagaaaaccccatggataacatcgcagaaccctcccgcgtcccgcattcgcgcattgaagatgcgctggcgatggtgcttggcaccctgatggtctcgttcggcgtcattatgctgaaacaggcgggggcgctgaccggcagcaccgcaggcatcgcctttctgatcagctacctgtcgccgctttcgttcggcagcgcgttcttcctgatcaacatccctttttactggctggcggtaaaacgcatgggctgggaatttacgctgaaaaccttctgcgccgtcggtctggtgtcgctgtttacccagctgcacccgctgttcgtccacttttctgaccttaaccccttctatgcgacactgttcggtaacgtcatcatgggaatcgggtttatagtgttatttcgtcataaggcgagcctgggcggcatcaatattctggcgctgtggctacaggatcactttgggatccgcgcggggaaactgcaaatggccgtcgatacctgcgtcgtgctggcgtcactgtttgtggtgagtggccccatcctgctcgcgtcgattgcgggtgcggtgatcctgaatctgattattgcaatgaaccaccgtccgggacgctatcgggtttaatccgcatcttccctctggaccaatcatggagacctacaccgtgtttcaaaacgttgatgcctatgctggcgatccgattctgtcgttgatggaagccttcaaacaagacccacgcgaacacaaagttaacctgagtatcggcctctattacgacgaaaagggcatcatcccgcagctgaaggctgtagccgctgccgaagagcagatctatgctgagccgcatcaggcatcgctctatctgccaatggaaggactgaacagctaccgtagtgcgattgcaccgctgctgtttggtgccgatcatccggtgttaaacgcgggccgtatcgcctctattcagacgctgggcggttctggcgcgctgaaagtgggcgcggatttccttaagcgctacttcccgcagtctgcggtctgggtcagcgatccgacctgggagaaccacgtcgcgatttttaatggtgcaggttttgaggtaaatacctatccctggtatgacgcagagacccacggcgtgcggtttgatgcctttatcagcaccctgaaaaccctgccagcgcagagcgtcgtgctgctgcatccctgctgtcataacccgaccggcgctgacctgactgatgcgcagtgggatcagaccgttgaggtgctgaaagcacagcagctgattccattcctggatatcgcctatcagggctttggggccggcatgcagcaggatgcctatgcgttgcgcgcggtcgcggcggcgggcctgccagccctggtgagcaactccttctccaaaattttctcgctctatggcgagcgcgtgggcggtctctctatcgtctgtgacagcgccgaagagtcagcgcgtgtgctgggccagttaaaagccacggttcgccgcaactactccagcccgccgaatttcggtgcgcaggttgtcgcgcgcgtactcaacgatgacgagttgaaagccagctggctggctgaagtggaagcgatgcgcttacgcattctggacatgcgtcagtcgctggtggacgtgctgagcactgcactgccaggtaaaaacttcgactacctgctgaagcagcgtggcatgttcagctacaccggcctgagtgcgcagcaggtcgatcgtctgcgcaacgaatttggcatctatctggtgggcagcggccgcatgtgtgtggccggtctgaacagcaaaaatgtgcatcaggtggctgaagcgtttgccgccgtgatgtaacggccgccaggctgtaaaaaaaaccgtcagggtgctctctggcggtttttttatgggtcagggtttacctttcggcgacatgctgcacacttaaacggggtaaccgtttcaggaataagctatgtggcatcaacaaactattacgctgagcgcgaagccgcgcgggtttcatctggtcaccgatgagatcgtgaactcgctctccggactgcgtgatatcaaaaccggtctgctgcatctgctgttgcagcacacttcggcgtcgttaaccttaaatgagaattgcgacccgacggtgcgcagcgacatggagcagcatttcatgcggcacgtgccggagaatgcgccttatcagcacgattacgaagggcgtgatgatatgccggcgcacatcaaatcgtcgatcttaggggtttcgttgttattaccggttcagcggggacgtctggtgctgggcacctggcagggtatctggctgggcgagcatcgcattgagggcggtgccaggcggattgtcgccactttacaaggggaatcgtaatgaataactcagacttactgacctattgcatgagcaagccgggcgcggagcagagcgtccacagtgactggaaagccacgcagattaaaagcaacggcgtgctgtttgcgatggtacatgaggcgaaagggcggccagcggtctcgctgaaatcgacgcctgcgctggccgaattactgcgcgaagagcatagcgatattattcccagcgagcatctgaacaagtcacactggagcacgctgtttcctggacggttcgctgaaagattcgcagatctactatctggtcgatgcctcattccagcaggttgcaacggcccgctaaacggcaataaaaaaccctcttacctgagtaagagggtttcagagaccgcgggttacgcggcaggctgctcgcgcagggtattaatgtcgataacgaagcggtatttcacatcgcttttcagcatgcgctcataggcttcattgatctggtccatcgcgatcagttcaatgtctgacgtaatgccgtgctcaccacagaaatcgagcatctcctgggtctctgcgatgccgccaatcagtgaaccggcgatgctgcgacgcttgaagatcaggttaaatacctgcggtgccgggtgatcgtgctccggtgcacccaccagcgtcatgttgccatccagcttcagcagggtgatgaaggggttgagatcgtgctgagccgccacggtattcagaatgaagtcgaagctgttggcgtgctgcgccatctgctccgcatctttagagatcacgacttcatcggcacccagacgtttgccatcttcaattttggaaggcgaggtggtgaacagcaccacatgtgcgcccatggcatgggcaattttcacgcccatatggcccaggccgcctaagcctacgatacccactttcttgcccgggccgacattccagtggcgcagcggcgagtaagtggtgataccggcacacagcagcggtgccacgcccgccagctccaggttctcgggaatgcgcagcacaaagctctcatcaaccaccatcgacgttgagtaaccgccgtaggtaatggcgccggtttcacgatcttcaccgttataggtgccaacaaagccgttttcacaatactgctccagaccctgctgacagctcggacagctgcggcacgaatcgaccatgcagcctacgccgaccagatcgccgactttgtatttctgcgtctgcgggccaacggccgtgacgcgaccgacaatttcatggcccggaaccacgggaaaaatggtgtttttccactcattacgggcctgatgcaggtctgagtggcaaacgccacagaacagcacctcaagctgaacgtcatgggcgcgcagctcacgcggcttaaaatcgaacggtgccagtttggattttgcatcctgagcagcatacgcatgcgtaatattcatggtgtctccagtttcgatgtgtcgtgagtgttattcgatgaagtgcagcagcgttgatgtgctgcgaaaacagggcgacgccaggggcgtgccaaagaggaaccgcttaaggatagtcagcgtggggaaaagcgtatatgcctatacatgtctgaatcttgcctgattctgcaattttctggctgaatcgacaggggagagtaaaaggcccgcacgcggcgggcctgacagaattacttctgtaacagtggcttcaggaagcgcgcggtatgtgatttctcacactccgccacggtttctggcgttccagccaccagaatttcaccgccgccgctgccgccttccggacccaggtcgacaatccagtctgcagttttgaccacatccaggttgtgctcaatcaccacgatggtgttgccctgatcgcgcagcttatgcagcacttccagcagctgctggatatcggcaaagtgcaggccggtagtcggttcatccagaatgtagagcgtctgaccggtgccacgctttgacagctcacgcgccagcttcacgcgctgggcttcaccgccggaaagggtggtggcggactgaccgaggcggatgtaggtgagacccacatcgatcagcgtctgcagcttacgcgccagcgccggcaccgcatcgaagaactcacgtgcctcttcgatggtcatttccagcacttcgtgaatgctcttgcctttgtacttcacttccagcgtttcacggttatagcgtttgcctttgcactgatcgcacggcacataaatgtccggcaggaagtgcatttcgactttcagcacgccatcgccctgacaggcttcacagcgtccgccacgcacgttaaagctgaagcggcccggattgtagccgcgtgaacgtgcttccggcacgcccgcaaacagttcacgcaccggggtgaagatgccggtgtaggtggccgggttggagcgcggtgtacgaccaatcggactctggtcgatgtcgattactttgtcgaagtgctccagtcccgccacgtcacggtaaggtgccggttcggcgatggtcgcaccgttcagcgcccgctgggcaatcgggaagagcgtatcgttgatcagggtcgatttacccgagccggaaacaccggtaatacaggtgaacagcccgaccggcagcgtcagcgtgacatccttgaggttgttgccgcgtgcgccggtaatcttcagtactttggccgggtcgcctttgacgcgctcctctggcactgcaatgccacgcttgccgctcaggaactggccggtcagtgacgcttcctgcgccatgatctgatcaaccgtgccttcagccaccacctggccgccatgtacgcccgcacccggaccgatatcgatcacatggtcagcggcacgaatcgcatcttcatcatgctcaaccacgatcaccgtgttaccgaggtcgcgcagatgaatcagggtgccgagcaggcgttcgttgtcgcgctggtgcaggccgattgaaggctcatccagcacatacatcacgccgaccagaccggcaccgatctgactggccagacggatacgctgtgcttcaccaccggacagggtctcggcggaacgcgacatcgaaagatagttcaggccgacgttgaccaggaagctcaggcgatcgccaatctctttcaaaattttctcggcgatctgcgcacgctggccgctgagtttcatgttttcaaagaaggacatcgcatggccgatgctcatctcagagatggtcggcagcgtggtgttctccacgaagacatgacgcgcttcacgacgcagacgggttccttcacagctggcacaggcgcggttgctgataaatttcgccagctcttcgcgtaccgctgaggactcggtctctttgtagcggcgctccatgttattgagcaccccttcaaatggatgacggcgcaccgaggtgtcgccgcgatcgttgatgtacttaaattcgatgctctctttgcctgatccgtacagaatcactttctgtacgttttctggcaggctgccgaacgacgcttcgatatcaaaatcgaggtgttccgccagcgaacgcagcatctggaagtagtagaaattgcggcgatcccagccgcggattgcaccgcccgccagcgagagttcaggattctgcaccacgcggtcagggtcaaaatattgctgtacgccaaggccgtcacaggtcggacaggcgcccgccgggttgttaaacgagaacaggcgcggctccagctcgctcatgctgtaaccacagatcgggcaggcgaagttagccgagaagagcagctcttctgcggcgctgtcatccatgtccgccacgatggccgtcccgccggagagctccagcgtggtctcaaacgattccgccaggcgggttgcgagatcttcacgtaccttaaagcggtcaatcaccacttcaatggtgtgcttcttctgcagctcgagttttggcggatcggagaggtcacacacttcgccatcaatacgcgcacggatataaccttgcgtcgccagattctccagcgttttggtgtgctcacccttacgatctttcaccaccggcgccagcagcatcaggcgacggccttccggctgggagagcacctgatcgaccatctggctgacggtctgcgccgccagcggcacatcatgatccgggcagcgcggttcgccaacgcgggcaaacagcagacgcaggtaatcatggatctcggtgatggttcccacggtcgagcgtgggttgtgtgaggtggatttctgttcaatggaaatggcgggcgacaaaccttcgatatgatcgacgtccggcttctccattaacgaaagaaactggcgcgcatacgcagagagcgactccacatagcggcgctgaccttccgcatacagcgtatcaaacgccagtgaggatttaccggaacctgacaggccggttaccacaatgagtttgtcgcgtgggatggtcaggttgatgtttttcaaattatgggtgcgggcaccacgaaacttcgatcttatccattcacctttcccggattagcagcactcaccgcgccttgccgacacggccagaataaacgtgtcattatggcacaaaaaatagactgaataaatatccagtactcttagcctctggcgcgcagagtattaaaactggaaccccgctcgaaagtgggaaacagaccgcaggacgtgttagaattgatagattagactgtatgcattaactcatcgggagacagcaacatggccagtcgtggcgttaacaaagtgattcttgtcgggaatctgggtcaggatccggaagtacgttatatgccaaatggtggcgctgttgccaacattacgctggctacgtcggaaagctggcgcgacaagcagaccggtgaaaacaaagagatcactgagtggcaccgtgtggtgctgtttggcaaactggctgaagtcgcgggtgaatacctgaaaaaagggtcgcaggtctatatcgaaggccagctgcgcacccgtaaatggcaggatcagggtggccaggagcgttacaccaccgaagtcgtggttaacgttggtggtaccatgcagatgctgggtggccgtcagcagggcggtaatgccggtgcaggcgctccagccggtggtggcgcgcagggcggtggcaacaacaatggctggggtcagccgcagcagccgcagggcaacaataaccagttcagtggtggcgcgcagtcccgtccgcagccgcagccacagagcgcgccggccagcaacaacaacgaaccaccaatggatttcgacgacgatattccgttctgattccgttggccagagagtacaaaaaaagcccgctttgcgggctttttttatgcgcggcgtctggcggccagctacgaccattccgccagaatcgcctccgtgctcagcacacgtggcacgttgccggggatcagcagtgaggcccacacatcattgtgctggttaatcagtgcttcggcgctgacccagcggcgatctgccgtggtgtgcgcatcggcggcaacggtaatcgcatagcccgcactggcaccgacttttatcgtggtatccaggcagtagtcagtggcacaaccgcacaccacaaattcctctaccgccagcctctttaacagcgtggccaggtcggtgtgccagaagctgtcgcaggcagttttggtcacatagtgtgcgccagcaggctgagcgatttccggcagcagcccgaaagccgcattaccctcgcacatctcgccttcgcggtgctggataaatattgtgatatcggcgcgtttcggtcagccggttaatctgtgcaatccttcccgctgtgtcgaagcgtggcgtgctgaagacgccattctgcatatcaatgaccacgactacccgctgtgccatgcttaatcccatccggtttgaaaaaagcagtgttacctgaggcattgcggaaagcaatcttttgcattttcccccctgtcacaggcatgctaaaccgactggttaaataaggagagagaagtggaaggtgttccggcgagttttccctgtgagaaagaccgcgcccggtttcagcaactcgccgagctgcccggtgtggaactctatcaggcccacatctcccgctacgcatttgaaccccatacccatgaagcctttggtatcggcaccattgaagcgggtgcgcaacgctttcgctaccgcggcaccgaatatactgcgccggagaactcgctggtcatgatgaatccggatgagctgcataccggtgagtcagcgtgtgaagagggctggcgctaccagatgatctacattcagccgcagctgatggatgaactgaccggcgatcgcggctggtggttcaacgaggcgctgttgaccgatccgcgcgtggcgcggccgctctcccgcacgctggcgacactctggcaggcggaatcaccactggcgcgccagagcctgctggctgaactgctgttgcagattcgtccgctggcacgcatgtcctcacagggcagaccggatgcacggcatcgttttgatcaggtaagagattttctgcgctcaaacctcgcagaaccggtgcggctggatgagctggcggcgctggcctcgctctcgccgtggcacttcttacgcgcctttcgtcagcactatcacgttacgccgcatcagatgctgatggctttccggctttacgacgccaagcaaaggctggcacagggtgaagcggctgccagcgttgcggcggcggtgggattaaccgatcaggcccatctgacccgcgcctttgcaaaccgttatggcatcacgccgggccgctatcaaaagcaggtgcgccagccctgataccaccgcaatctgctacaagcgttccccgcccgaacccgccacactgaacgaaaaagctatataaggaagaaattatgtttgctggtgtcatgtttgccgtcaccgccggactgctgtgggggctgatctttgtcgggccgctgctggtgcctgactatcctggcgcgctgcaatcggcgggacgttatgtggcgtttgggctgattgcgctgccgctggcctggcacggtcgtcatcgcctgcgcaagctggcccgggctgactggcgtgaagcggtaaagctctcgctggtgggaaacctcttctactatgcgtttctggcgaacgccattcagcgcactggcgggccggtctccaccatgattatcggcacgctgccggtggtgatcgctgtgacggccaatctctgttacggccatcttgaaggacgcctgccgtggcggcggctgtttccggcactggtcatgatggcggccggattactctgcgtgaatgcggcggagctacagagtcagggccacacccttgatctcagccgttatctgaccggtatcgcgctggcgctgctggctgtggtctgctggacctggtatccgctgcgcaatgcccgctggctgcgtacacatcccgaactgcggccctcgacctgggcaacagcgcagggagtcgtgacgctgccgatggcgctaatcatgtacgcgctggtcagcgcgcagctcgcctggcaacagccggctttttcgctgccgtttgggccgcgtcctgcagtgtttatctccctgatgctggcgattggtctgctctgtttcctggctcgggaccttatgctggaacgctgccagccagcgtctgcccaccgtactgatggggccactgattgtttttgagatccttttcggcctgttgtggacttttctctggtatcaaagctggccacccctgctcaccgtgacggggattatttgtctgatggctggtgtcctgtgggcaatgcgcattaaaccgcagcctctcgtcgtcgcgattaaagagtaaaccgcgaagatcgccaaaagacctctgccgcgcggataacacgccgcgcggctttttaagattaaaccctaccccgatttgctcgctctccggcagatttgtgccgcgaaatcgatttcatgcctctgcgtaatcgtaccttaactcccgaaagcctctttcatcccctgtttgtcagtgaaaaaacgggactgatggtctcctgaacatagccatgtttagcgttgccagggaggaactgttcagatatcggtcattaatcaggaaaaatcgcgcagcattatggacgttatgcttttatcagcggctttttattgcggtatggtcctgagaaagggaggctgaaaaccactattaacttcactcagtgatgaatgagtaagaaaactccgccgctgcgttaataattaaagattaatctctggcatcaatgatgcgcaatgaagagagcgaaaagatagacacataacgttagtgataaggagcaataaactatttatcctggattaatcctggagaaagtatatgccattaacccattccccggaattaaacgcagccgcaaaaatttgagtcaggtccagcattaactcaaatatacggtgattgttttttgcgcgatgtttaaattggcttaatgatattgagacgatttagttccgacgattagctgggcttacgtaagaaagggagggcccaatcccgcgtaaacgagattgggaagggaagaatagccgtataatgcgagacgtttgctgttgtgaatcaattttaccgcaaaaaaagaagcttagccgtgaagccattcattagttataaatggagcggaaaagggtgccgcaattgtcctgttaaatgatcttcatctcttctggtaagaacaaatctcagcgttaagtctaaaaagcgcggtagcattggggtttagcggttctccgtgcctgacggataatggtatacgctgcgactgatatctaataagcggcagctgcgacgggtgccgatgtcaaaggtggcctgcaggaaatccacagcctgacgtttttcattagtggtaaagaagtgcttcagaacgctctgcagcatctctttgtccgagttgagcgtctgcagttcacgcgtgatgttctgcagtttttcttccagctctttgatttttctgccttcttccgaagacaacccagaaaacttcttcttccagctgtagaaacgtggcttcagagatgcctaactcttcacaaatctctctgactttcacgcccgattcagaagctttaatggcatttgtgatttgatcttcgctgtatcgtgactttctcataaatgctcttacctttcttatcgattaatggatgagaatgactttaataatttctggcactgtaagattctattaaggcagtattaaagtgcgcgaattgaattgcgaagcctaaattaagatatttagaataaatatcatcatgggataaatcttattttattcttatccggtgggcgtgccttcctggaggggggtttttgttataaattcatcgcatccaaaatacgaaaaaattctacgtacattggatatttagcctgaccgacttgattaatatggcgggaagggctcttaaaggttgttttattttcagcctgaaatcgtttccatctgaagtgattcgcgccatttataataagaattatcctgaattaacactccggatcatgatttacatctcaattttcggaccagcttggtctgaagtcttacattttcgccaggcccactgagcgcttattaattcgttacagggatgttgtaccgaagcggttgtagttgagtaatactaaggaagagtcgatgaaattgagcgtaatgtctaatgccgcctggatgatgtctgagaagatcatctccgtttttggcgtcatttttgtgacgtcttacgtggcgaaatcctttggcccaacggtgtttggccagatggcgttttctacttcactatttgcgatggtgcaaaccgttgcaatctttggcaccgaaaccattctgtttaaacgcgtcagcaaaaatgcgtcaaaaggcctgcgcctgatgaccatcgcccgcacgatgagaatggtgctgttgctggtcacttcggtgccagtcttaatctgggtctggtacaacatgcaggaaaatttcctggcgtttgcactggcctcatttgttgcctcggtttttgtcacccaggacaccttcagcgtttataacaacgcgcgtcttgcctcgcgtcttaacaccatcgccaacgccgtgggcatgctgctgagtttcggcatcagcttcaccgtcgcctggctgcgtcttaatccgctctggctgacgctgtcgattgtcgcagtgactctggtgccttacctgattaagcgtcacaacttctatcaggaccatcaggatcagatgccaccacgcgaaaagcgcacggcctatctgcgttatctgatgtatgccggtctgccgctggcgatctccagcatctttatctctgtgcaggtaaaagcggcgcagatgttcctggcaggcacggcacccgcgcgcgacctcgggctgtttgcggcggcgaataccatttccgcctcatggatttttatcccggtggcgctcatcacctcctgcttcactgaaatcttcagggagcgcggcgaggtcgccattaagctggctgcgcggctcaatggctatgttatggcggtttcattgctgatgctgctgatcatttcgctttatggcgagcggatcatcattgcgttgtacggcccggaattcacacagtcaggaagtctcattacgttgctgtcgatagcgaccagcttttcggcaatggggaccgtagcgtatcgctacatggtcaaagagggaggatttaactacttgctgaggaaaatcatctgcctgatggtcatcagtttgccgctctcctggtggttgatccagggtcacggcatcatgggggccgcgtggagcgttttcctttcagaacttttgtccctgaccgtaatgaattacttctttaaaaacggcgtcattcaaaagattcaggtttcctcactcaactacaaaacatacaaatgaggtcagatatgctcaagttgaaagaagaactcagaagaagtgtgcagtattttattaagaagatgccctgggcttatcaggaccgcatctactacttccataagttcagaaagctgcccaatctgcgtcagccaaaagtgttcaacgagaaggtgttgtaccgtaagtttatcttcggcgattaccagagctatggtcgtctgtcagataagtactcggtgcgcgaattcattgctgaaaaaatcggtaatgaatacctgatcccgctggtacacgaaacgactgacccgaccacgctgaacagcttaccctgctggaaggggacggtgatcaagccgaaccacgcctccaacatggtagagattctgctggaggagccggacgcactgcgcaagcagcagatcattcatgactgctatcgctggctgaagaccgacttcgccaacgaagcgcgtgagattcactatcgctacatcaagccacgtatcctggttgagaagtacattggtgatggcaaaagcgcgccgattgattacaagtttcatatgttcaacaagcgtgatggcaagttcgaatatgtgctgcaggtgatctacaaccgctgccagccgctgctgtcgatgaatttctacgtgaataacctcaatgaggcctatcacaagattcgcgataccggtctggatgtctcaccgattatgccgtcactggaacatgcgctcgaactgagcaagaagctggccagtgatttcgactacgtgcgtgtggactggtatatccatgacgagcggatctactttggcgaactgaccttcaccccaggtgcaggactggtcaccggattagatcgtggtttaaatcagatgatgggagatatgtggattcaggaccgccgcggaacgcagagcccgggcgttacagtgcaggatgttaatattcctgccatgttgaagaaaatttaagcacacacagcaatataaaaaaccccgcttagcggggttttttatgcgcaaaaatcagggcatcggccagtcagcaggcgcctggctcatcacatcgataaaggcatgctttgagatttccagaaagttatgcacgttatccatactcagggtaatgcccatcagaccggtaacaaaccagcaggtcatgcctaaaccaatcccgccacacataaatgccatcacgtgacggctatcctgacgaagtttggttttcagggtgctggcaaaaaacatcatgattgcgctcagcaattcccaacgcataacaagtaaactggcggttaacgtagccatcggccggacctcaatatcagtaagtattcctgacaatctgcggacatcaccggcggcggaaaagtgtgtcagggggtgctttttcgccgtcaacccaggttcaaagtgtgatttgggtcacattatatcacccgattttaaattttgaacaaaatttgactctggtatggtagcggcgtgagggaatagtgagcagtagaagaagaacggcggggaaatcagtcagatgcgcccgggcgggcgcatctgaggggtcaacgaaccggacagcactcgccggtcgtgcgctgggtgaagctactgataccgtcattgcagccaaaactcagcaggcgagggcgctgaatcgcctggcggcgcatggtgtggcggtaagcggtaggcgtctgtgaaaactgacgacgaaacacgcgggagaaggtctgctgcgagtcatagccatactgcatcgcgatatcaaaaaccgggcgctgtgtctgtgacagcgcttccgctgccagcgtcagacggcgctcgcgaatatagccacccagcgtctgtttcgttaccgaacggaacatacgctgcagatgccatttcgaatagcccgattttgcggcaacctcatcgatcgacaggctcttatccaggttctggtcaatccagtgcgtcagggaatgaatgatctcttcttgcatcatggtctcatccttctggtgcttaataagcggtaatgggagtttagtggttttgatggagagcgagtataattcctcaagttaacttgaggtaaagagcctgatgaaaaaagaacgcaactatccgaaaccggtcttaacaccgggtgaagtggcgcgccgcagcggtgtggcggtttcggcgctgcacttttatgagacaaaaggacttattttcagcacccgcaacagcggcaatcagcggcgatatagccgtgacgtgctgcgacgcgtcgcaattatcaagattgcacagcgtatcggcattccgctggcaacggtcagtgacagcctggatcacattccgcctgacaagcgcatgtcgacaccggagtgggatgcgctgacgcagcactggcgcgaagagctggataagcgcattgaaaccctgacccgcctgcgtaatgacctggatggctgtatcggctgcggctgtttgtcgatgcgcgactgcccgctgcgcaatcccggcgaccggctgggtcagcagggctcgggtgcggtgctgcttgacccggaacaggatgataaacatccggatgtagagtgacgtctatacttggtgaaggtcaaaacacagggaatcatgatgatcaccgttcaccatcttgagaaatcgcgctcgcatcgggtgctgtggctgctggaagagctggaagtgccgtaccagattaaacgctatcaacgcgaaccgaccatgctggccccggaggcgctgaaaaaagtgcatccgctgggaaaatcaccggtcattaccgacgggaaccaggtagtggcagagtcaggtgccattctcgaatatcttgaagagaaatatgatcacgagttccggctcaaagtgagtgatgaggcatcacgactgcagtgccgctactggctgcactatgccgaaggctcgctgatgccgctgctggtgatgaagctgatcttcggtcagatgggtaaagcaccggtgccgtggctgctgcgtccggtcggggcggcattcggtaaaggcgtgcagaaagcgttcctggataaacagcttaagccacacatgcagatgatcgaacagcatctggctgcaaatccctggttcgccggtcagcgcttcagtatcgctgatatccagatgagctttccgctgctggcgcttgcgcgacgtgccggactggagcagatgcccgccagccagaaatggctgcagactgtgcaacagcgtgccgcctggcagcgcgcgatcgatcagggcggcgagctttcgctgccaggttaattcccctcttccactggcgggtcgtgtctcatcacggctgcgccggtgcgcatccccctgaaaatcgcgttaacttcagggcgtcagcgtttgacgtcggcttgggccacgtggctgctggccacttaagcctgatctttatgctgaagaatctccctctgacagttgaaaatgtgccgctaaacgccggataatcgcatgcctttttatctggccgcttctggcggccaactatctgcggcaaggtaaacgtttgcctgccgggtaaaacccgacagtgacgccgtctacccgcttattccagggacagcgatggtcgcagagcgatccacacaacaaaaatttttgaggctcaactatgtcaactgaatcacgcccggccagtggaaaactggacgcctggttctcgatctcggcgcgcggcagcagcgtgcgccaggaaattctggccggacttaccaccttcctggcgatggtctactccgttatcgtggtgccgggaatgctgggcaaggccggttttccccctactgccgtgtttgtcgccacctgcctggttgccagctttggttccatcattatgggactgtgggccaatctgccgatggcaattggctgtgcaatctccttaaccgcctttaccgctttcagcctcgtgctgggccagcacatcagcgtgccggttgcgctgggcgcggtgttcctgatgggcctgctgtttaccctgatctcagtgaccggcattcgagcctggatcctgcgtaacctgccgatgggcgtggcgcacggcaccggcgtcggaattggcctgtttttgctgctgattgcggctgacggtgtaggcctggtagtgaaaaacccggcaccgggcctgccggtggcgctgggccacttcaccacttttccggtaatgatgacgctgttgggactggcagcaattattggactggagaagcgcaggatgcccggcggtattctcatgacaattatcgccatttcgctgctggggctgatcttcgatccggcggtgagctacaaaggattgtttgcgctgccgagcctgcgtgatgccagcggtgagtcgctgctgttcagcctcgacattatgggcgcgatgcagccggtcgtgctgccaagcgtgctggcactggtgatgacggcggtctttgacgcgaccggcaccattcgcgcggtcgcgggtcaggcaaatctgctggataaacagggccagattatcaatggtggtcgtgcgctgactagcgactccgtcagcagcctgtttcgcgggtctggtgggcgcgtcaccggctgcggtttatatcgaatcggcggcaggaacggcggcggggggtaaaaccggtcttaccgcgattgtggtcggcctgctgttccttgccattctgtttatgtcaccgctggcgtatctggtgccggcttacgccaccgcccccgcgctgatgtatgtgggtctgctgatgctgagcaacgtggcgaaagtggacttcaatgattttgtcgatgcgatgtcgggcctgttaacggcggtgattatcgtgctcacctgtaacatcgtcacgggcattatgatcggtttcgccagcctggtcgtggggcgtctcttcgcgggggaatggcgcaagctcaacgtcggcaccgtcattattgctatcgcgctggtggcgttttacgccggtggctgggcgatctgactgtacaaccgggcgtgcggctgcacgtccggaatttttcactattttcccgcccggcgcacgcgtagctgacaatcttcaccgcagtttgttttacactttagcgcttaaccaatgattgaaagaaacgacgcctaaggaaagcatggaaatcttttttacaattctcatcatgacgctggtcgtgtcgctctctggcgtcgcggctcgtatcctcccttttcagatcccgttgccgctggtccagatcgctgttggtgcgatgctggcctggccaacttttggtctgcatgtcgactttgacccggagctgtttctggtgctcttcattccgccgctgctgttcgcggatggctggaagacgccgatcagtgagttcctgcatcatggtcgcgagataattggcttagcactggcgctggtcctgattaccgtgatcggcatcggctatctgatctactggctggtaccaggtatcccgctgatccctgcctttgcgctggcggcggtgctgtcaccgaccgatgccgtggcgctctcaggcattgtcggtgaaggccgtattcccaagaagattatgtcgatcgtgcagggcgaagccctgatgaatgacgcttcgggcctggtatcgctgaaatttgctgtggcagtcgccatgggtaccatggtgtttacctggggcggtgccagcgtagagttcctgaaagtggcggtgggtggtctgattgcgggtgtcgcgatctgctggctctacggtaagtcactgcgcctgctcagccgctggagcggtgacgatccggctacccagaccgtactgctgctgctgctgccgttcgcctcttacctgattgctgaacatctgggtgtctcaggcatcctggcggccgtggctgccggtatgaccatcacccgttccggtattattcgtcaggcaccgctggcgatgcgcctgcgtgccaacagcgtctggcagatgctggagttcgtctttaacggcatggtcttcctgatgctgggcctgcagttgccggatattctgcagacctctgttgatcaggcgcaggccgatccgaacgtcgagctctggatgctgtttgccgatatcgggctggtctatgccgcgctgatgatcgtgcgttttggctggctgtggattatgcagcgcttcagcaaacgcctgctgaagaagaagccgctggagttctccaactactcgttgcgtgaactgctgatcgcctcctttgcgggtgtgcgcggcgcgattaccctggccggtgtcctgtcgattccgctgttcctgaccaacggcgagcctttcccggcgcgttatgaactggtctttatcgccaccggcgtgattctcttctcgctattggtaggggtagtgattctgccgattctgctgcgcggcattgatactattgataaaggcgcacaccgtcgcgagttgcagaatgcgcgtgcggtaatggcaggcgcagccattgagagcctgcacaagatggaagagcggctggagaatgagtcggaagagaacatcgatccggagctgcttaaagaggtgagtctgcgggtgattggcaacttacgtcgtcgcgctgaagggaagaatgaccttgaacacgcgctgttcgccgagaacctggagcgtcgcttccgcctgaccggactgcgtgccgaacgtgctgaggtctatcatctgcgcgccacccagcaaatctccaatgagacgatgcagaagttactgcacgacctggatctgctggaagcgctgctgatcgaaaaagaggagtaagtcctgactggcacgcctgcgcgttaatgcggcgtgccagcctttcacaccgacaggcgcggcggctcatccggccaatgctcgcgacaacaggctatccacgcctgcgcactgcgcgacagataactcccttcccgccagatcaatcccagactccacttcagctccgattccagcggcagccacagcagcgactgcttatccagccgctgacagatcggctccggcagaatcgccagccccatctccgcctgcaccatcgccgccagaaaatcccactgtccgctgcgaaccgccaccgttggcgtcaggttgagcctctgaaacgcctgcatcagctgacgattcagcgagaactcctcattaaaaatcagcagtggatgctctgccagtttctgccagtccaatctgctggcggctgagccactccgggcgacgcggcagcagtacgcagagcggatgatgcatcaggggcagggtgttcagcggcagctcggcatcgaccggtagcgcggtcagggcgatatccagactgcccgccagcaccgcctgctggacggtcagaccgccgaactcagagattttcagcttcacaccgggatagcggcggcgaaacgcggaaatcgaaccggcaatctgcataccgaccatcggcggaatacccagtcgcagctcaccggttttgagctggttgatgtcaccaatctccgcttccagctgatgaaactcctgcaggatcgccaggccgcgttgatagaccgcctggccgctgtcggtgaggtgcagacgacgaccatcgcgcaggatcagcgtgcagcccagctcctcctccagctggcgcagcattttgctgatggtcggttgtgtcacaaacagcttctgcgccgcacgggtaaagctctgctggcgtactacttcagtaaagtaacgcagggcgcggacatccataactattcctttcaggcatgatttcgataattttaattcatttttttcaccttctgttgacgatttatactggtgacatcaatttaatcggggagacaaggtgatggcgttagcgctcactttacgcagcaaccgcgcagtgcaatggctcagcctgccgctccagctgggtttctatatcggcctgtttatcgcctgcgaccggctggtaagctggctgcatctgccgctgcccgccaatatcgtcgggatgctgctgctgctggcgttaatcgtgacgcggattgtgccgctgaactgggtgaaagccggatcacgctggctgctggccgagatgctgctgttctttattccggcggtggtagcggtggtgaactatggcgatctgctgcgggtcgatggctggcgcatctgtgtggtgatcggcgtcagtacgctgctggtgctggcatccaccgcctgggtggtggatcggctgtatcagtatgaagtcgcgcgcgccgcgcgtaagcaggatccgcatgcgtgattttctgctcagcctgctgtgtgtagccgttacgctgctggtttatgcactgaataaacggctttaccgccgctggcggacgctgctgctgatgccactggtgatgacgccgctggtgctggtggcattgctgctgctgacgcatatcagctggcaggattacatcgccgaaaaccactggctgctctggctgctggggccggcgacgctggcgtttgcagtgccggtctatgagaacgtggaaattattaagcgccactggctgtcgctgagcgcgggcgtagtgaccgcgacgctggtcgccatctgcagttccgtctggctggcgcggctgttaaccctgccggagtcgattcagcgcagcctggccgtgcgctctatcaccacgccgtttgcgctggctgcggcgggtccgattggcgggcagcccgatctggtggcgctgttcgtggtgattacaggcgtgtttggcatggcaatcggcgacgtgctgtttctgcggctcgccattaagcagggcgtggcgaaaggcgcgggatttggtgcggcgtcacacggtgccggcacggcacgcgcctatcagattggcgagcaggagggcgtggtcgccagcctggtgatgatgctctctggcgtggtgaccgtggtgctggccccgctgattgggcacctgatgtggacaatataggctacactccgtcgcacaggggctggtctgcgctgagacacgtatttttacgtaaagttttccagattttgttgtctccccatttcaggctgttaaccttgcggccgaattaattgtcctttcacggagtggaatcatgtttaagcaacttgttgccgggagcgccctcgggctggttttaatgagcggtgccgctcaggcgattgaaggcagtgttgatgtcagcgaacataacaccaacctgaatgtgggtctgggcaccacaacacccggtctgtttctgaaaggtaactggctgcgtagcgaccatgacggcagcacctacggtgccggtctgggttacaacgttgatttcgggccgctgcgtctggcgccgaccgcaaaagcgatcttcacccatcctgaagatggaaaagatggatttgcggtggcgctgggtggtgcagcacactacagcttcaacagcatgtggggcctgtatggcgaatattattacgcgccagagtctttcaccgatcagctcgacagctatcaggaagccggtggcggcctgagcttcacgccggtttcactgcttaacctgcgtgtgggttatcagtacatcgaactgaacaacaaagatggacgcaaagataacgtgctggtcgatggcccgtacgtgggtgcatcgctgcgcttctgattctgctgcgcaaaagaagagggcgactacttcggtagccgcccttttttattgcctgctcgttatgaacgaaaagccacgatcagtgcgctttgccctgttcgatgccggtgccggtctgcgagcggataaactgtgcacggaagcgtgaacgttcttctgcgccctgctgcgaatggtcggtaatggagaagagccagatgcccacgaaggccaccgccatggagaacagcgccggatactcataggggaaaatcgccttcgcgttgcccagcacctgtacccacaccgtcgggccgaggatcatcaggataacggcggtcagcagaccgagccagccgcccaccatcgcgccacgcgtcgtgagttttgaccagtacatcgacagcaggatgatcgggaagttacagctggccgcaatcgagaaggccagcccgaccataaaggcgatgttctgtttctcaaacagaatacccagcgcaatcgccaccacgcccagcgccagcacggtaatttttgaaacccgcagttcatctttctcgctcgcctgacctttacgatacacgctggcgtagaggtcgtgagacaccgccgacgcacctgccagggttaagcctgcgacaacggccagaatcgtggcgaaggcaaccgcagagataaagcccaggaaggtgctgccgcccacggcgttcgccagatgtaccgccgccatattggtgccgccaatcagcgcgccgctggcatctttaaaggccgggttagcgcccaccagcaggatggcaccgaagccgataataaaggtcaggaagtagaagtagcccataaaaccggtggcccagaagacgcttttacgtgcctctttagcatccgctacggtaaagaaacgcatcagaatatgcggcaatccggccgtaccaaacatcagccccagccccagagacagcgccgagataggatctttgaccaatccgccaggctgcataatcgcgatgccttttggatggaccgccatcgcttcggtgaacagcgtattaaaactgaaaccggtcgccttcattaccatgaccgccatgaaggtggcaccaaacagcagcagcacggctttgatgatctgcacccaggtggtggccagcatgccgccaaacagcacatacatcaccatcagaatgccgaccaggactaccgcaacatggtagttaaggccaaacagcagctggatcagtttacccgccccgaccatttgcgcgatcaggtagagcgccacgaccaccagtgagccgcaggctgacagggtgcggatcggcatctgcttcagacgatatgaggcgacatcggcaaatgtgtagcgacccaggttacgcagtctctcagcgattaaaaacagaatcatcggccagccgaccaggaagccgagcgagtagatcagcccgtcataaccggaggtgtaaaccagcgccgatatgcccaggaacgaggcggccgacatgaagtcacccgccatcgccaggccattctggaagccagtgatattgccgcccgcggtgtagtagtcattacgtgatcgggtgcgctttgaggcccagtaagtaattcccagcgtggccccgacgaaaatcgtaaacatgatgatcgcctggtagttggtcgcctggcgctgcacggcaccggttatcgcatcggcagccagcgctgaaaacggcagcattaaggccagcagccataaggtgagacgagtcatgatttcacctcgctgaggatcgctttcgttaaacggtcaaactcaccgttggcacgccagacatagacgccggtcagcacaaacgacatcacaatcagcccgaccccaatcgggataccgcgcgtgacgttggtgccggcatgcagcggcgtaccgagccagccgggtgcaaatgcaatcagcaggataaagccgacatagagcaccagcatgatcagcgacagcagcgtcgcgaacgcctggcgcttacggactaattcatgaaaaaggggattacgctcaatctgttgattgatggcatcctgattcgaaagggcgtcattcatcacattttctccagagggcttgcaggcgagaacctcgcgacagggcgcggattcagctggttataatatttgtgactaccgaaacagactgcgtagggcgggtgtggcgggaagcgatcttcccgccggacagcgtgcgcttaaggcattttgatcgactgtttctcctcaagcagtttttctactacgccaggatcggcgagcgtagaagtatcaccaagattactggtatccccggtggcaattttgcgcagaatacgccgcatgattttgccggagcgggttttcggcagtgagtcggtccagtgcagtacatccggtgtggctatcgggccaatctctttacggacccactggcgcacttcggtgtacaactccggcgacggctcttcgccatgattcagcgtgatataggcataaatcgcctggcctttgatgctgtgcggaatccccactaccgccgcttcggcaattttagggtgcgagaccagcgccgattcaatttcggcggtgccgagtcggtgaccggaaacattgagtacgtcatcgacgcgtccggtgatccagtagtagccatcttcatcacgacgggcaccatcaccactgaagtagacatttttaaaggtagagaagtaagtctgctcgaaacggtcgtgatcgccatagagggtacgtgcctgacccggccacgactcggtgatcaccagattgccttcacaggcgccttcctgtggctgaccttcgttatccaccagcgcgggctgcacgccaaagaaacggtcgggtggcggaacccgctttcagctcggtcgcacccggcagcggcgtgatcatgaagccgccggtttcggtctgccaccaggtatcaacaatcgggcagcggctgttgccgattttcttgtagtaccactcccaggcttccgggttaattggctcaccgaccgatcccataatgcgcaggctgctgcggtcggtgccggcaatcgccttatcaccttccgccatcagcgcacggatggcagtgggcgcggtgtagagcagcgtgactttatgtttatcgaccacttccgccatacggctcggagttggccagttcggcaccccttcaaacatcagtgtggtggcgccacaggccagcgggccataaaccagatagctgtggcccgtcacccagccaacatcagcggtgcaccagtagatatcatcctgatggtaatcaaagacgaacttaaaggtggtcgcggcatagaccagatacccaccggtggagtgcaacacgcctttgggtttgccggttgaaccggaggtataaaggataaacagcggatcttccgcgccgacttctgcggcagcgtggttggtgctcgcgttcagcatcaggtcgtgccaccactgatcgcggccctcaacccagcccacatctttaccggtgcgctggaacaccaccacatttttcacgctggtgacattaggattttttaacgcgtcatcgacatttttcttcagcggaatgctgcgaccggcgcggatcccttcatcggccgtgatcaccagcgaggcgctggaatcgacgatgcggcccgcgaccgcctctggtgagaaaccgccaaagatcaccgagtgaacggcaccgatacgcgcacaggccagcatcgctactgcggcttccggcaccatcggcatatagatcgccaccacgtcgccttttttcacttccagcagttccagcacgttggcgaagcgacagacttcggcatgtagctggcggaaagtcagggttttgctttcgctggcgtcgtcgccttcccagataatcgccgggtgatcgccgcgcgtggctaaatgacggtcaaggcagtttgccgccaggttgagcgtgccatcttcgtaccagcgaatgttaatgttacctggtgtaaacgagcagtttttcactttgctgtaaggcttgatccagtcaaggattttgccctgttcgccccagaaactgtctggatcgtcgacagattgctgatacatcgcctgatactgttctgcagtaatcagggtgtttgctgcaatattctctggaacgggatgtttgtgtatttggctcatggcggatctccttgaagatgttaatgatatgtcaatcaatggttaattaaagcctgcgccaaagctttgtttcttttttgcgccacagatcacgtgatacacatcccccgagaagcgttaagccattctgatctatcaggttaacgctctggcggcgctggagaagtcaggcatcggttttacgctttcatcctgaataaaaagcgagcaaacgcgccggatcagtttttaatcgtttctgcatagctatgcgtaaattcatcgaagtaatacttttcataacagcaggttagggtttttcagctctggcagcactttatgctgcttagatggtgaacttttaatcggatccgccaggggttgcatttaccacagtgaaaatggtacttatctcgcccctgttctgcaggtatcaactcagaccgcgtctgaaaatgggtatgggaatcatcagattttcatacgaggcgctgtttcaagacaccctctaatttaccgggctttttgctcactccctgtgtgtattgtcttctgcaccttcgcagtagagagaaacgggttttgactgaggaaattacacgttatgaaaggttttaaaatcagcctggcctggcagattctgacagccctggtgcttggcatcgttgtgggtgctgtgttgcataatcagccagacaatcgtgaatggttagtcaccaacattctcagcccggcaggcgatatctttattcatcttatcaagatgattgtggtaccgattgtgatttcatccctgattgtcggcatcgctggcgtgggtgatgcaaagaagctgggacgcatcggcgtcaaaacgattctctactttgaagtgatcaccaccattgccattgtggtcggtattacgctggccaacgtatttcaacccggcaccggcattgatatgtcaacgctggcaacggtggacatctctaaatatgaagcgacaacggcagaggtacagggcggtccgcacagcctggtcaccaccattctgtcgctgatcccgcagaatattttcgcctcaatggcgaagggcgacatgctgccgattatctttttctcggtgctgtttggtttaggcctgtcgtcactgccgtcagaacagcgcgatccgctggtgaacctgttccgtggcatttctgaagcgatgtttaaagtgacgcacatgatcatgcgctatgccccggtgggtgtgtttgcgctgattgcagtgacgattgctaacttcggctttgcctcgctctggccgctggctaagctggtgttgctggtttacgcggcaattctgttcttcgcctttgtggtgctgggcggagtggcgcgcttctgtaagctgcggattaccacgctgatgcgtatcctgaaggatgagctgattctctcttactctacttccagctcggaaacggtgctgccgcgcattatggagaagatggaagcctacggcgcgccgaaagcgatcaccagcttcgtggtgccgaccggttactcgtttaatctggatggttcaacgctttatcagagtatcgcagcgatctttattgcgcagctgtatggcattgacctgtcgctgaccgacgagattgtgctggtaataacgctgatggtgacctcgaaaggtatcgctggcgtgccaggcgtctccttcgtggtgctgctggccacgctgggcagcgtcggcattcctctggaaggtctggcgtttatcgccggtgttgatcgcatcatggatatggcgcgtaccgcgctgaacgtggtcggtaatgcgctggcggtgctggtgattgcccgctgggaaaaccagttcgacgtcgaaaaggcgaaagagtatgagctggagctgcggacacagaccgcaagctgaacacggcattaacgtaagaatgggctcaacgaaagttgggccttttttttatgagatttttcatggcagatatacaggttgactgaaaattaaaaggttatatttttataactaaaaaaccataattatgagacgatagtattgttattatgattgattatagttatatttcgttgcggtaagttgactgtcttctttgacaacatggagtgttgacggatgccagaaattaactggacgaaaaaggcattgaaacagctttatgggctgcctcagaaagagggtaacgctattgaagatgctgtagaggcgctggctaaatggccggatattccccatctgaaagtcgaaaagctgactgatgataaacagaagcgaatgaagctggtagtaggtcactaccgcgtactctggaagatagagaaaggtcagccagtagtgatagatatacttgaagtcgtaagaagaacatcgaccacgtacaaaaagcgctagcagtgtggcaggagcaatgtgcgtcatcaataagttctgtgcagccgggtttagcgttccgcagcacaggcagacgatcagacagtttccgcagcacaggcagacgatcagacagtgttgcctgccgtaccactaaggagtgattacccatgaatgctatacagtttctgacggacgagcgcgggaaccgcactggtgctgtcatccctatagagctgtttaataagctcatggctgaacgtcatttagatgatgtgtttgagtctgtcccttatgaagtgggtccagacgatgatgaaacgattcctcacgatgtaatgaaaatcagccgacggcaatctgttcctttgcatgttgcctggcgtttgcatcgtcacctgtcacaggaagaggtggcgaataaactgggcatcacgcaggctggcgtgtcgaagttagagtcgagaaaaaaacctcaaaaacaaacgcttgagaagctggctgctttatatgactgcagaacgtcacaactttatattgattaaatggatgcgcttttaacctgcgattggtgggttttaattgtcttttggatgagtgacataggatgggaggcgaggtctttgcagggaaaacagtgctccgttcagtcggataccagcagtgactgcgtaaagtcgtcgaaaacccatccctggggcctcggccgccggttcactcacctcatccatgaggctcgcccgcaagcgggccaacgctttgcattgttcaaaaacgctcccgacgtttttgaacaatgcggcggacgcttaactccgtcaatgctggtatccgccttctcatccacctcgggtacagattgtcagaaggacaaaaaccaggaaaggacatcttactccagcaggcctttttcaacgtttatgtccgactcaagcctcttttcaagcagccataaaaaagcctgagggatgaaaaggttcacctgaagagtaaagcgtcccacggcagggatggcgtgggcttagcgtcagtgtgcctgaggccgcgttccatcattcaaacagcaataaaaaagcttgaaggaagaaaaggttcacctgaagagtaaagcgtcccacgccagggacggcgtgggccgagcgtcatggatgacgaatgcgtctttacgatcaggtgaaccttttctgaccggcaccggtctcccagcgattgcactcacatgcaccgaacccaggtcgtaatgcttatactcatcactcaaccaatctgatcccccgcaacatgactcaccccacatccatcgaaaaaagatctcacccaatgaattaatcattcgttatgatggttagtaatttgaataatttattcctttgcggagcccgccatgaaacttgacctcagccaaatgatcaccgaaggccgcaacccggccagccagaatattgacgaactctccaccgaagcgatgcttcgcgtcatcaatgatgaagataaaaaggtggcgctggcggtagaggccatcgtgccgcagattgccgccgccgttgacgccatctgcgccgccttccaggccggtggacgactgatctattgcggcgcaggcacctccggtcggttgggcatactggatgccagcgaatgcccacctacctttggcacaccccgcgagcaggttatcggcctgattgcaggaggccataccgccatactccaggcggtagaaaacgcggaagacaaccgggagcagggcgcgcaggatctgaaagatatccacttcagccgccacgatgtgctggttggcatcgccgccagcggtcgcacaccctacgtactgggcgcgctggcatacgcgaacgaacttggcgcaaccactgtatcgctcacctgtaatccaggcagcgccatgtcgcaggttgccgcgattgcgctcacgccggtggtcggccccgaagtggtcaccgggtcttcccgtatgaaagcgggcacggcacaaaaactggtgctcaacatgctcactaccgggtcgatgatccgcagcggaaaagtgtacggcaacctgatggtcgatgtggaagccaccaatcagaaactggtacagcgtcaggttaacatcgtcatgcaggccactgactgtgatgaggcgacggccagcgccgcgctcaccgcctgtggcggacactgcaaaaccgccattctgatggtgctggctgacctggctgccgatgaggcgaaagcgctgctcagtcagcatcagggctttatccgtcaggctttacaggcagcgggagcacgctaatggccagaatcaccgaggcactgttgcgcgacatcctgcaggcggtcggtggcgcgcaaaatatcgcggcctgtggtcactgcatgacgcggctccgcctgacgctcaatcagccgggagagagtgatctggcacggttaaaaagcctgccgggtgtcttaggcgttatcgacagcgaggcacagttgcagattgtgctggggcctggcaaggcgcaaaccgccgccgaggggatgcagaaacctgctggctcagggtgataccgcgctggcaccgcagggcgaaacagcggaacttcgcgtgctggcgaagcggcagaagcagcagctaaaggcgaaacagaccagcggcgtgcatcagttcctgtcgcgcttcgccaccatcttcactccgctgattccgggctttatcggcgcggggctgctgctgggatttgccacgctgattgaacagagtctccacctcaacgcacccggtgaccacgcgccctggctgctgcataccgtggcgtacatgaaagtcttcggtaaagggctgttcacttttctcagcatcctgattggctacaacgcgcaaaaagcgtttggcggcagcggcgtcaatggcgcaatcatcgcctcgctgtttgtgctcggctatgtgcccacggccaccaccggctactacagcggcatggaaaacttctttggcctgacaatcgacccgcgcggcaacattattggcgtgctgatggcggcgattatcggggcgtggattgaaaaacagctgcgcaaaatcattcccgacaatctcgatatgatcctcacctcgctgtttacgctggtgatcaccggcgccatcacctatctgttgatcatgccgctgggcggcgaactgtttaaagggatgtcgtggctgtttatacatctcaataacaatccctttggctgtgcgctgctggccgggctgttcctgatcgcggtgatgttcggcatccatcagggctttattccggtctactttgcgctgatggaaacccagggttttaactcgctcttcccgattctggcgatggcgggagcaggccaggtcggcgcatcactggcgttgtggtgcaaagcagaaaaaggggcgctgctgcgggcgcagatcaaaggcgctatcgtgccggggctgcttggcgtcggtgaaccgctgatctacggcgtcactttgccgcgcctcaagccctttatcaccgcctgcggcggtggtgcgctgggcgggttctttatcgggctggtggcgtggctgggtttgccggtcgggatgaacacggtattcggaccctccggcctggtcacgctgccactgatgacctccagccaggggatcttcgctggcatggcggtctatctggccgggctgatggtggcctggatcggcggattcctgctcacctggtggtttggcacccgtaatgtcgacctcagctgacccgctgccggaattctccagtccggctaacggatggataatcaaccaaaaatgtgaaagccgctacaaagcggctttattattgccactaatttaacttaaacgctaaagagtaggcagaagcatgccgaaaacataaaaaaaggtaatcgttatctctcagcccacagttttcatgccgacactcagaccgtcgcgtgcaggacgtcgggtctccaaggacttttgatgcgtaacaaccagcctgtctctcagcgtgaatatctgttcgacgataatgcgacactgatgtcgaccaccgatcttaacagccacatcacctacgctaacgacgcgtttatcgaggcgagcggattcaccgccgacgagatcaacggccagccgcataacatggtacgtcaccccgatatgccatcagaagcgtttgccgacatgtgggcgacgctgaaacagggtgaaccctggacggcactggtcaagaaaccgccgtaaaaatggcgatcactactgggtgcgggccaacgccattccggtagtacgcgacggtaaagtgcagggctacatgtcggtgcgcaccaaacccacggcagaggaagtgcgtcagactgaggtgctctatcaggattttcgtgaaggccgcgccagagggcgacgttttcacaaaggcctgctggttcgcagcggctggcgtcgtcccgcctcaatcctgaagacgctgccccttcgctggcggatccgcacaacgttgctgacgttactgcccctctcggtggcaggcgtctgggcgctgggcatgacgcccgcggcactggcaggctttaccgcgggaatggctgcgctgcttctgctctgcagcctgtggctggagcagcagatttcacgccctattgagcggatgtgcaaacaggcgctgagcgtggcaaccggtgccagccataaagtggagcagatggaccgcgttgatgaggtgggtgtgacgctgcgcgccatcggtcagctcggattgatgttccgctggctggtggatgatgtcagcggccaggcgatcaacgtgctgagcgccagcgacgccatcgcccgcagcaacaacgaactcagccgccgtaccgaacaggcggctgccaacgtgcagcagactgcggccaccatgaacgaaatgactgccacggtgaagagcaacactgaaactgcgcatgaggcgaataccctctcagccggcaccagccacgctgccagcaaaggcggcgaggtgatgaccgaaatgatgggcatgatgggcgaaattgcggacagttcaaagcggattgccaatattaccagcgttatcgacgggattgccttccagaccaatatcctggcactgaacgccgctgtggaagcggctcgggccggtgagcagggcaaaggctttgcggtggtcgccggagaagtgcgcagcctggcgcagcgcagcgccaaagccgcgagcgaaatcaaaatgctggttgaaaccagcgccagccgggtcaactcgggcaatgagcacgccagcgcggcaggccgcacgatgcaggatatcgtgtcgcaggtgcagaatgtcaccgcactgatcgcccagatcagcgccgccacggccgaacaggcgaccgcgctcagcgaagtcagttcagcggtggaagatcttgatgatatcacccaccagaatgccgcccgcgtgacagaaagcgccgaggcttcaggtcgcatgactcatcaggctaaccgtctggtcgaagcgatcagcgtctttcgttaagagaagagattcagcggcccggttaagaggccagcgcctgcgtgccgtcgcgtccggcacgcagtgcgcctggtgactgaccgacaatccgtttaaaggcgcgactgaatgccgcaatcgagccgtagccgagatgataagccacggcttccaccgcttcaccgttgttcacaatccgctgcaccgccagccgcatccgcaactccgtcagatagcgcagcggcgtcatgccggtggcattgagaaaccgtccggcaaacactgagcgcgaacagcctgccacgctggccagccgcgccaccgtccagttttcgcctggctcccgatgcatcgcagcaatcgcctgactcagacgtggatcgcgcatcgcctgcaccagcccactgcgctcgccgcagccgttttctacccagccgcgcacaatcagcgcggcaaccacgtctgccagacgcgacagaatcccggcgaatcccgcctggcgggtgagcgactcccgctccatcgccgccagaatcggctgaatctccgggtattgcgacagcagagtactcaccagcatcacatcgggcatggtattgatcagcggctgcatgccgccgagctcaaacgccatgcaggcgctgaacaacagcacactgtgctcgtcatcacaggcatcttccggtgctgcaatggcgcagacgctgtcgcagagcggcttgctcgccatgttcttaatacactggcagctcgcctcctcactggagatcaggctgtgaggtttgccgtgcggcaccagcagcgcatcgccgctgttgagctgaaacacctcgccggaggcactgcgcaccatcagtgagccgcgtccgacaaagtggaactgcgcccggcccggcgcgtgatcataacgcagcccaaacggcgcgctcactgcgatacgctgatagttcacgccatagaggcgcatccccatcagcagttcactggtcagatctccatagtggctcatgtgattccagacgaattatcaaaaatgaaggtgtaagcatcatagatcgtcctgacacggcgttctatgctcacactcacttttttatcttccggagaagcagcatgagtctgacaaccgaagtggctgatgaggtttcctcgccgacccgtcccgcgtggggcgcggtatttgctatggcatttggggtgttcagcctcatcaccgccgaatttttacccgtgagtctgctgacgccgatggcccacagcctcggcgtatccgaaggccaggcgggacagaccgtcaccatcaccgcgctggtggcgctgtttaccagtctggtcaccggcagcgtcacgcggcgcatcgaccgccgcatcgtcatgctggtgttttcgttgttgctgatcgcgtcggcactgatggtggcgtttgcggctgacctgacggtgatcctgctggcgcgggtgctactgggtatggccattggcggcttctggacactctcaaccgccatcaccatgcgcctggttcccaccgatcaggtgccgcgtgcgctctctatcgtcttcagcggtatctcgctggcgacgattatcgctacgccactgggcagctatctcggcggactggtgggctggcgcaacatctttatgctgactgccggactgggtgcggtggcgctgctgtggcagtttctttaccctgcccgccatgccggcagagaacaaagcccgcaacggcggggtgctggcgctgctgcgtattggtgtgatgcgctggggaatgctggcggtaatcatgatgtttaccggtcacttcgccttctttacctatctgcgtccatttctggaaagcgttgcgcagctcaacctcaatcagctgtcgctggtgctgctggcctttggtgtggcgaacttctttggcacctcgctggccggtttcctggtcacccgcagcgtatcactgaccctgagtggcatggcgctgttgatgagtgtcaccgcgctgctgctggtgagctttggcgatgtcagctggatggtaggtgcaggcgtggcgatctggggtatggcgtttggttcgatgccaaccggctggtcaacctggatttcgcgcgcggtgccggatgatgcggagtcgggcggcggtttactggttgccaccatccagctggcgattactgtcggtgcagctgcgggtggctggatgtttgacctgcgcggcgcaggcggtgtgttcgttgccagcggagtgctgatgctgctggccgcgctgaccatcttcacccgggtacgacatcacggttaaatcctcaagggcagcaatatatgctgcctttttttatgggcgtagattattaaccttttgagtgataactgtgcgaaatgtgctttttatcatcaattttactgaacgagttaagcaaaaccctccgctttttactgatcaacttccggactaatatatctatcaacaaggcagcacgccttacctgataaaaattaaccgaggaattgaccatgaaatctatcaaaacttttgcagctgttatcgcgctttctgttctgccatttgccagcttcgcacaatctgtgaccgccatcgactctacgctggatggtgctgaagcgaaaatcgctgcgcaggctcaggaagctggtgcttcatataaaatcactgaagcttacactaacaacggcgttcacatgaccgctgagctgctgaaataagttaagttttaccctcttgtgctgacaggacgcctttgggcgtcctggcggcgtttatccgctaataatcctgtccctttccccccgaaataattattattctcaaaaacaattctgcatctgactgctgtcagctgtttctggttgcaatgtcgggctttcttttcactgcgtctgcagtggattaactatggagaagttatgaaagcgattaccaatacgtgccggaccctgcgtccgctgttactggctacagccctgttctctgcctcaggatggctggcggtgcaggctgaagatctcaatcaggccgtgggtaaaggcgtctatgaactggcagtcagtccgaaagataacgcgctgttcgtggcgacagcgcagaacagcagcggtgacggcggcacagttttccgtctcgacccggctacgctggcggtacagcagtcgatcaacacggagctgaaatcgttcggcgcggcgatcaactcgcaaaccaacgtgctctacatcggcaacaccgtaaacggctcggttacggccattgacgccagcagcggcaaagtgctcaacacgctggtgctggatagccgtaagcgcagtgagacagtgcgcccattgcagccgcgtcaggtggcggttgatgctaaaactaaccgggtttatatcaccggcctgggaccgcaaagcgtggtctgggtggtggatggcagcacgctgaagcttgtcagtaccatcccgaataccggtaaaatgggcaccggcctggcggtagattcagacgcgcaaaaggtctacgtcaccaacggtgatggtgaactggtgacgatcaatgcgcgcaccaatgccattgagaaaaagcagaagattgacggagataaagagcacttcttcctgaacatcgcgctggatacgcgcggtcagcgcgccttcctgacagattcaaagcaggcgcaggtgctggtggttgatctgcgtaatcagcaggtgattcagcggattgatgtcccggaatcgctggcggtgctgtttaatggtgatcgcgatgagctttatgtcacccatcgcaaagcgggtgaagtcagcatcatcgacgccagcagctataaggtgaagcgcacggtgaaaaccccggcgctgcctaacagtctggcactctcggcagacggcaaggtgctttatgtcagcgtgaagcagcctggctcgcgtaaggcgccgccaaaaaatcctgacagcgtgatgcgtattgcactgtaaggcgtgacgtccctgacactgctgtgttgaagctgttttacatccggtctttgtaaacgagaaagccactctgacgagtggcttttttatttaaacagaatcgctttcgccgttttgagggttcagatgcgaaaggccactctttttccggtcggaagttccacatcaagactgagttttccgcccattgcttcgacatagcgtttcagcgtggcaaccttaatctcatttccgcgttgctcaatctgagcaacggcaggctgacgcacgcccatggcctcggcgagcgtcttttgtgataactgaagctcttcgcgaatcatctgaagcccgacttccagaatcatttcatcagacatttttttgattcgcgcctgactctcaggggagaagtcggcgataacatcatccagggttctcattaattatttcccttctcctgttcagccagccaggctgaaaattcatcgtcagcgatgcgtatcattcggatataaaaacgtttgtcatgactcttatctccggcacataacacaatagcctggcggacagggtcaaatgcataaaatgcccgaattggctttcctgaaaactgtacgcggagttctttcatattcctgtactgcgagcccttgagagtatcagcataagggcgaggcaaatcagggccgtatacttttaactttcccagatccgctaacattttttcctgcagggcttcttcctgctcacttagccagctttcaaagcgcgggctcaggagtacggtccacatgacatacttccttgtatatattccgtcatacagggtacagattataagctacagcttataaattcaagccagagaacacgcatgacggctgatttaagcattaaaaaagcccgctttcgcgggccaggagcagcacatctctgctgttacaggagtcctgcaggttctttgcgggatgatccgtggctgaggagagtggggtggaaatcgacctgtgccgccatacttaagtagttacacctcttccgacgcttcgcgcatcatctcatcgtgcggaacatcatccagaatctgctcaaagctgcgcagacgcttatagatcgacattagttcaatcagcgtcgaccaggaggcgatcagatactggaacgagccgcgcacctgatcaaacacgttggtgatctggttgagtaagcccagcgtgatggtgcccgccacaatggatggaaaaagcagaaacagaccaaacacgttatcaacctgcagatagagaatgcgggtgatgttgaagtagagatagtgaaagtagagacggaagtagttaacccgcacccgactgaacaactcctgaaccgtctgcggtgtggcacgatcggcattgtcttcgccgtagaccagttctttacggtaggcggcttcaacccgctgattgcggaactccagccccggcagcttaatccctaccagcgccagcaaaccggtaccaaacactgaccagagcacagcggcaatcaccagtgcgtaaggaatattgccgaggatgggaatatctttcacgtgatgggagagcgcgaccagcaccggtaaaaaagccaccagcgtcataattgcctgaataaaactgacaccccagttttccagcgtggtcgcaaaccgcatggtgtcttcctgcacgcgctgtgcggcaccttcgacatgacgcagacgctgccagttgtgcatgtagtagttattcatggcgctacgccagcggaaaacccagtggctgataaagaaggagttgagtacgccaatcaccaccgcgattaatgcgatgccgagaaaagagaaaacctcatggtaaaactccgcaatctgcaccgatcccgctttggttaacgctttctgaatcagatcataaaacggtccataccaggcgttaatggccactccgacctgcacgccaaaccaggtcacaaagatgatcagcgcggagccccagactgaccagcgttgccatggatgcgcatcaatcaaccgccagaccccggcaaaaatggctaccatgatccagtaatagaggtagaaccagagctgactcacggcgataaaacgcgctgccgtcgtcggcaggggctgtttcattgctgtttcaaaggtgggccagatgccgggcagatgcgcggcaaagccgaaccaggcaaaaatcgctactaagctccagacagccgcagagctgaaaaacagcgctggccgcggaaaaaaagacttaaacataggcactccgctgttgtgtgttgcctgttataacgtttttgacgggtcgctgtctgtagtctgttgtttctgctaatgacaggagggggatagatgttaatgaaattgtgcggttttgtttcctggaactaaatctttgtgaatggcagtgttacaataggttgtttgttaccggtaacaaacaggctcctggcctgtatctgctgataaaaaccattacaacgcaaccacctatttttttcataccgccggtcagcgcgggaatgaggcaatgtcatgtcagaacaaaaaaagggtcattcacgcagggattttttgctgaagacaatcaccctggcgcctgcaatggcggtaggttccacagcgatgggtgcactctccctgccgctggccacacaggcggctgaaaccccggccacgccacagcaggcgcgcgactaccagccgaactggttcaccgccgaagagtttgcttttattaccgccgccgtggcacggcttatccccagtgatgaacgcgggcctggtgcgctggaagcgggcgtgcctgagtttatcgatcgtcagatgaatacgccgtatgccacggggtcgaactggtatatgcaggggccgtttaaccccgacctgccgaaagagctgggctatcagctgccgctggtgccacagcagatctaccgcctcggtctggccgatgccgataattacagcaaaaagcagcacggcaaggtgttcgcccagctcagtggcgagcagcaggatgccttactgcaggcgatggaaaatggcagtgctgaattcagccagctgccagcaaaagtcttctttagcttcctgttacagaatacccgcgaaggcttcttcagcgatcctatacacggcgggaatcagggcatggtcggctggaagctgattaacttccctggcgcacgcgccgactttatggactgggtagagcgcggcgaacgttatccgttcccgtcagtgtcgattcgcggggagagaagctaagcatggcaaacgaaatgaaaaaagtggatgcggtgattgtcggcttcggctgggcgggtgccattatggcgaaagagctgaccgaagcgggcctgaacgtgctggcgctggagcgcggaccgcatcgtgatacctatcctgatggctcctatccgcagtccattgatgagctgacctataacgtccgcaaaaagcttttccaggatctctccaaaagcaccgtgaccattcgtcatgatgcgtcgcagaccgcagtgccctatcgtcagctggcggcatttctgcccggaaccggtaccggtggcgcgggtcttcactggtccggcgtccatttccgtgtcgatccggttgagttgcggatgcgcagccattacgaagagcgctacggcaagaacttcattccggaaggcatgacgattcaggattttggcgtcagctacgatgagctggagccgttcttcgacaaagcggaaaaagtttttggcacctcaggcagcgcctggagtatcaaaggcaaagtggtcggcaaagatacaggcggcaacccgtttgcacccgatcgctcagataacttcccgctgcccgcgcagaagcgcacttactcggcgcagctgtttgctcaggcggcagagtcggtcggctatcacccttacgatctgccgtctgccaatacctcgggtccgtataccaacacctacggcgcacagatggggccgtgcaacttctgcggttactgcagcggctacgcctgctacatgtattccaaggcgtcgcctaacgtcaatatcctgcctgcgctgcgtcaggagccgaagtttgagctgcgcaataactcttatgtgctgcgggtgaatctcagcgatgacaaaacgcgtgcgaccggcgtgacctatgtggatgggcagggccgcgagcagattcagcccgctgacctggtgatcctctccgccttccagttccacaatgttcacctgatgctgctgtcgggcatcggcaaaccctacaacccgattaccaccgaagggaccgtaggccgcaacttcgcctatcagaacctctctacgctgaaggcgctgtttgataagaacaccaccactaatccgtttatcggtgcgggtggcgcaggcgttgcggttgatgatttcaacgcggataacttcgaccatgggccgctgggctttgttggtggttcgccattctgggttaaccaggcgggcaccaaaccgatctccggcctgccggtgccggcgggtacgcccaactggggcagcaaatggaaagcggcggtggcggatacctacacccatcatctgtcgatggatgcgcacggcgcccaccagtcttatcgcgccaactaccttgatctcgatcccaactacaaagatgcttatggacagccgctgctgcgcatgacctttgactggcaggataacgacatcaaaatggcgcagttcatggtcggtaagatgcgcaatatcgcggaagcgatgaatccgaagatgatcatcggcggcgcgaaaaagccgggcacccatttcgactccacggtttatcagactacccacatcagtggcggggcgatcatgggcgacgatccaaaaaccagtgcggttaaccgttatctgcaaagctgggacgtaccgaatgtgtttgtaccgggcgcatcggctttcccgcagggactgggctacaacccgaccggcatggtggcggcgctgacctactggtcagctaaagcgattcgcgaacactacctgaaaaacccaggcccactggtgcaggcataaggacatggcgatgaaaaatggcattctggctctgattcttggctccctgacgtttcgccgccctggcggagagcagccaggacgatctggttaaacggggtgagtatctggcgcgagccggtgactgtgtggcctgccacaccagcaaaggcggcgcggcctttgccggtgggctgccgatggcaacaccgattggcaccatctactccaccaacattacgcccgatcccgcgactggcattggcgaatacagctacgacgacttccagaaagcggtgcgtcagggcgtggcgaaaaatggcgatacgctctatccggcgatgccatatccctcttacgccgtggtcagcgatgaagacatgaaggcgctttacgcctacttcatgcatggcgtcacgccggtcgggcagccaaaccgggagagcgacattccctggccgctgtcgatgcgctggccgctggcgatctggcgcgggatttttgcgcccgacgtgaaagcgttccagcctgcagcccaggaagatccggtgctggcacgtggtcgttatctggttgaaggactgggtcactgcggggcctgtcacacgccgcgcagcatcacgatgcaggagaaggcgctgaccaacaatgagggcagcgactatctggcgggcagcagcgcaccgattgatggctggaccgccagcaatctgcgtggtgacaaccgcgatggactgggtcgctggagcgaagaggacctgcgtcagttcctgcgttatggccgcaacgatcagaccgccgcttttggtggcatgaccgacgtggtggaacacagcctgcagcacctgagcgagtccgatatcacggcgattgcgcgctatctgaagtcgctgggcgcgaaagatccccatcaggcagccttcagcgtcgatgacgccaccgccaaagcgttgtggaaaggtgacgacagtgcgacgggtgcagccacctacgtcgacagctgtgcggcgtgccataaaaccgatggcagcggctataaacgtttctatccggcgctgcgcggtaatccggtggtgctggcggacgatccgacctcactgattcatatcgtgctggtgggcggacagttgcctggcgttaatggcgcgccgtcgacgattaccatgccagcatttggctggcgtcttgacgatcagcaggtggcggacgtggtgaacttcgtgcgtaacagctggggcaacaaggcgtcggagccggtcagcgcgaaacaggtcgctgagctgcgtaaagatgagaaagatcggctgggcagtgcagatatccgggtactggaaggcaaataatcagcagtaaaaaaggccgtcatcatcaggatgacggccttttcttttagatattctccagatcgataccgcgcgttttcggcccataaatccctaccgacagcatcaccatcaccatgctcagcacgataaaggtaatcacgcctggcgtaccggcgtactgcaggatcaccccaatcaaaatactgctgaataccgtagagaggcgactgaaggagtagcagaagccgaccgctcgcgcccgaatatgggtcgggaaaatctcggtctgataggcgtggaagctgaaggtcagccaggcgttggaccaggtgatcaggaagccgcagagaatcagcaacaccggctgcgtctggaaggcgaacaacgtgccgaacaccaccgtcatcagcgacgacaggacaatctgccacttattctccagcttatcggcgtagcggctacagatcagcgatcccagcggataggccagcgtgatgaagaaggcataaagcaaactgtgcgtcaccgtggcaccgcggcctgacagcagcgcaggcagccagttaccaaagccgaaaaagccgatcgcctggaaaaaattcatcaccaccagcatcagggtgcgcttgcggtaagcgggtgaccagatctcgctgaagcgcccccgttttggcagctgcgccgcggcgtcgtcggctgaaaaagcgggtcctgccgggatgccgcagcgttgctccatcgtggacagcacctgatgcgcctcgtgatgacgaccctgctgcgccagccagcgcgccgactccggcaggttcctgcgcaccagccagatcaccagcgaacagaccgcgcccgcaatgaccacccagcgccagccttcaaggctgaacagcgtttgcggaatcagccaccacgacatcagcgccacggccggcactgataaaaactgcacgaaaaaggagaaggcaaaggcgcggctgcgcagatgggtcggcacccattccgacagataggtgtcgatggtcaccagctcgacgcccagcccgatccctaccagaaagcggaacagaataatcatctccgcgctctgctggaacgccatcagcagcgaaaacagcccgtaccacagcagcgcacacataaaggtgagacggcgaccaaagcggtcagcgtagggtgccagcaggctggcaccgaaaaacagaccgagaaaagtggccgaggcgaaggccgcctgatcggagaagcccagcacgcctgccgcacccgtgtgaaatacgcccgccgacagcaggccggtactgatgtagccggtttcaaacaggtcataaagctcaaaaaagccgcccagcgccagcaacgtaataaagcgccacaatccggcggatgagggcagcgcatcaacacgagcggctaagctgttacgggccgccgatgaagcgtgcatcggtggcaggctggtggaggaggtggtcatgtcagcgtgaacctcaggcagtgtagagacgactcgcagccggtcggaggcttattaaaatagttaaccgttagcaagcgaagaaatagcagaatagtcaattcatccgccgttgccgagagggtcgttgctgactatttagcaacgtacgttgcaggttttgccatccgtggcaggcgcactccggcagcggcgaccaggccagaatctgattgcagcgaactccggactgtctctcagcccggtaacgcgggggcaggagcgcatggatgcaaatggcgtccttgcgttatcatagccttgctttatgacaccttttcacggacgcggaaaaagctgagctgaagaagctgacacaattactgaaagatgaggtgtaacgtgagtttttttgacgagctgaaagcatcgctggaagaggctgtggagatcaaaaacggtatcagggagcccggtcgtgttacccgttacgcggttgccgacgtgaaggctatccgggcacagcttaacgtctcacagagtgagatggcgacggcattgggaaccagcctcgataccataaagagctgggaagccggacggcgtaatccgaccgggctggcagctaaagtactggtaactatccagaaaaacccggaattttttaaggagctggcggcgcaatgagccgttgttccctgcacgccgtttaacaaaaaataaaacgtgccaccgatgaaacattcatcggtggcactgtgctttaaggcagtttcggccagacgcctggcccgatcggcagacccagcagataccacaccagcagcagcgctatccagctgataaagaacaccagcggataggggaagatcagcacgtaataggtgccgagctgcgcatctttctggtaacgctgcaaaaaggcgagaaacagcggcagaaacggcgacatcggtgccagtggcagcacggcggagtcggcgatgcggaaaatcatctgggcaaaggcgggatggaagccgagcagcataaacatcggcacaaagaccggcgccagaatcgaccagatggctgagccgctggcgataaacatgcagagaaacgccgacaggaacatcaggccaagaaaagcgggcgcgccgctgacgcctgcgctctccagcacatcagtcagcccgatcgccatgaatttgcccatgttgctccagttgaagaacgccacgaactgcgacagcggaaataccatcacgataaaacccgccatgcccttcatcggatcgaccagcaactgcgggatatcatccggacggcggatctgtcgggtgaccacgccataagcaatcgccaccacaaagaagaacagaatgatgatcggcacaatgccctgaataaaaggcgagggaataatggcgccggtggcgggattgcgcagcggtgcattttccggcaccaccagcagcgccatcagggcgataaacagcagcgcggcgatcccggcagcccgcagaccgcggttttcaagcggcgtcagcgccgccagcttctcgccgttgccctgccactttggcagtcgcggctcgacaaatttatcggtcagcagcgcgcccacaatcgtcagcacaatcaccgacgtggccataaagaaccagttatcgatgacgctgacatgcaccgtgtcgctgaccgctttagccgcttcagtgctgatgcccgagagcagcacatcggtggtgacaatcagcaggttggcggtaaagccggaggccacaccggcaatggcggccagcaggcccgccaccggatgacggcccaccgccagaaagatcagtgcgcccagcggcggcatcactaccagcgcggcatccgaggagatatggctgaaaaaggcgataaacagcaccatgtagctggcataacggcggctgacgcgtgacgccatcttcaccatcagcgactgcagcaggccgaccttttccgccagtccggcaccaatcaccagcgccagaatcgatcccagcggggtaaagctgctgaagtttttgatgatatttggcaggatccactgaatgcctgcgacgctcagcaggttattcacccgcacgatttcgccgttgctcgggttcttcaccgccagatccagcgcgctgataatggcggtcgccaccatcagcaccacgatcagatagacaaacagtaaaaacgggttggggactttattccccacgcgctcgatccagctgaagagccggccaggactgcggtttctcggatgttgcttccatggtattggttctcgtcttgtgtcccttttatcggcggtagcaaggcctgacgccggtcgcgttgtgcgacaggcggtgagttcagttccggcaccgctgaatcggggaagtgtttgcaatattttttatagtggtccgtgtcagagacacggccgttggctcattcggccagttttgttggtgtgatccccgccgggatcgggcagtgatagggctgcgcggcgcgtacccgatcaaactcggcccggcagccagccagcgcctgccgatccgttaacagcgttaacaccgtggccgccatcactttgcccgccagaaacatccccttatgcccgatactggtgcgtccctgcgccaccagttgccaggtgtgcagcggcgtgccgaaggtaaagcagggcgcaaaacactgtgcagtcggcgtcacccagctgacatcgccgacgtcggtggagccataaagcagttcacgtgtgaccgcatagggcgcgacctcatccataaacagcttgtcgcccagtttttcagcccaggcgtgaccggcttcaccaccggttcgggcggcattgagccgggcattgcgcagatcgtcatcagtgagcgtggcacgcagttcagccgcaaacgcgcgttcttcgtcgctgtagtcgggcaaaccaaactgatgcaaataacgctccatgaccgcttccagcgcgcgattcgggacgtaatccgagcaggctttgtcaaaacgtacggtcagcgtggtgtcggtcatcagcgctgcccccctggcgatattgatcacccgttcataaatcgcctgcgcctgtggcagttccggggcgcggatcaggtagagcacctccgcatcggcctgcaccacgtttggcgaaacaccgccgctgttggtgatggcgtagtgcagacgcgcctcctggacgatatgctcgcgcagaaagttggccccggtattcatcagcgtgacggcatccagggcgcttcggcccagatggggagaattggccgcgtgcgccgcaacccctttgaagctgaacgccgcctgaatattggcgagggtgcgcagattgaacatgccgctgaacccctccggatgccaggtcacggcggcatcaacgtcgtcaaacagcccttcgcgtaccataaaagtcttgcctgaaccgccttcttcgccagggcagccgtaaaagcgaactgtgccgcccgtgtgatgctgttccatccaggctttcacggcgcaggccgccgcaacacctgccgtgccgagcaggttgtgaccgcagccgtgtccgttgccgttggcttccagcggttgtggccgggcgcagcccgcctgttgactcaggcccgccagcgcatcgaactcgccaaggatggcaatcaccggcttgccgctgcccgcactagcgataaacgccgtatcgatgccacccacgccgcgttccactctgaatccctcttctgccagcgcatcagaaagcagggctgacgagcgggtttcggcaaagcgggtctccggtgtgtcccagatggcgtcactgagcgtgctgaaacgaagctgatgacgagcgatatagtcggcaataaagtcttccatcatcgtgagcccccatactgcgcctggttcagcgccagcgtcgccagcagcgtgatggcgtccggcatcacccgctcatcaaagtcgaatttcgcattgtggtgacccgccgccagctcacagccaaaaatgacgtaagaggcctgaccgccgcgctgctttacccgttccatcatgtaggtcgcatcttccgaacccgccgcctgcgctttacgatcgaccacggagtcgaagataccgagcgagtccgcctgctgatggatgaaatcaacccatggctgcgtcggggtacagctgcgcgcggcccccatcagcgagacccgctgctcaacgccatacatcgccgccgcaccggcaatcacccgcagcgcctgctgatagatgtcgtcgttgacctgattggtcacgccacgggtttcgactttcagcagggcgcagtcggctaccacgttgcggccggtttcccgcctgcagcacacccacgttgacccgtgccacgccgccgctgtgctgggttaaaccatgcagcgccagcgttgcctgtgcggcggccagcagggcattgcgcccctcttcaggacgaccgcccgcatgggcaccgacgccggtaaagtgaacatccagcttggtagtggcgaggaagctgtcgctgccgcacactacttcgcctgccggcacgccggtgccgatatgaatggcggtgaagcgatcaacgtcatcgaccacgcccgccgccaccatcgcttttgcgccgcgcacaccctcttcggcgggctggaagatcagtttaatcgtgccgctgagctgatctttcatcgccatcagcaccgaggcgagacccagcccgatggtggtgtggccgtcatgcccgcaggcgtgcatcatgcctgcgttgcaggaggcgaacccttctcgctgcggcagatgatcgtcagcctgactctcgttgagatccagggcatccatatcgacgcggaagcccatcaccgggccaggacggccggtctcgagcgttgccacgatgccgcagaatccgccggagaagtggctgatccactgcggcagcgcgccctgttgcagcgcgcgcgcttcctgctgcttcagcaccgcctcgtcgggcaagcccatccgcgcgtcagcgtcgatgacctcacggcccagcttcagttgataaccgagcttatgcagctcttcagcgactaaggtggcggtgcggaactccagccagcccgattcggcatagtgatggaagtcgcgacgccactgttgcagctgtggcagccgggcgctgacgtggtctgaaagggggttcatcggctctatcctcgttgttgattttttatgcactgttccgaatctacacaatggtattgaccggcataagatgcgaatatcttgtgactgataaacaacggttatcgcaaaattatgtctgccaatctcaagctccatcagctgcgcgccttcgttgacgtggcgcgacagggcagtatccgggcggcaagccgtctttccgggctgtcacaaccggcgttaaccaaagcgattcaggaactggagcgcgagctgggggcaaagctgtttatccgccgtcagcagggcgtggtgttaaccgatatcggtgataacttttttcggcatgccagcctggtgctggcagagctgcgggtcgccgaggaggatattcagcagcggctgggactgggtggcggtcaggtgaatatcggcgtcggtggcagcgtggcgcgcaccattatgccgcaggtgattaaccagtttcatcgcgaatacccgctggtgaaggtgcgcatcgtcgaaggccagctggtgtcgatggtgcatgaaactgcgccagggcgcgctcgatttcaccattaatacctacgatcagagccatctcgatcaggagctgatgtatgagcggatgatggagcgcgagtacaaggtggtggtgcgcaaaggccatccgctggaaaaggcgcgttctctggcggagttacagcaggcggactggacgatgccaacgcctaaaggcagttactaccgcttgttgcacgatctgtttggcgagcgcggcatggccccgaaaattgtggtgacctgtgaaacctttatggcctgcaccagccttgtggcgcaaagcgatttcatcagtattctgtcggtcgacgtcattgacgacccgattctgggccggtcgctggtggcgctggcgctcgacgaacccctgccgaaagcgatcttctatctgatccagcgcaaagacaccacgctgaccccaatgagcagttatatggcacaactctttcgccgttattgccagtaaaatcagtgagtaaagtcgatcgtctacactgttaaggtactgaaaaaaatccacccgacaaatatagaggttacgatgcaagtcagtccttatctgtttctctatggccgttgcgaagaggctatcgacttttacctgcaggcgaccgggggagagttactctctaaaatgaaattcggtgatatgccggaccagggtgagcaggtcggcgatcagtctgccgcgccgcagccgccagaaaagatcatgcatgcccagctgcgtattggtgacggtgagctgatgctgagcgatggcaacaccgatcagccgccagcgtctgagcatgccggttacgcggtcagtctctcaactaacgatgtcgaaaagggtaaagcctggtttgagaaactgtcggcaggcggcaaggtgacaactgagtggcaggagacgttctggtcgaacggattcgcgatgttcattgataagttcaacattccatggcgcatcaacgtcgagaagccgcaggaataatcgggccagccggcgtcgcaatttgcggcgccgtattaattaatggcaactgcccggattaaagcgcggcggcgctattcaggccgccgcacgtaatcagaagttataacccgccaccaggtagtaaccccagccagtcgatttcacttcaaacggcccgttgccgaaattcagctcctgaccatccgcccactgtccgccgttgtggaagtaacgcgccaccgcagagaagtgccagtgatcgtaacccagtgacagaatatggctggaggcgatggagttgctggtgcgtgatgaaccgcctttatcgcggagatcggaaccccagtcgaagttggtgaagcccacatagcccagattaccgccccacagtgtggtgattggcacgaagtatttcaccttgaagcgatagccatcccagctgttttcattcgccgcaccgtagttttcccactgatatttggcgtagacgttcagcgacagaccgacatcactgtgcgtatcgatatcggtgcccagacccatataccaggtgttctggcggctatcgctgttgcggcccatgtcgtagatgtagttgttagcgaaataccactctttgaacggaccaaacgccaggctggtgccggtcagtttgtcgatagagaagcgcggctcaatctccataaacatcggtgaaccgtgatcaaaaatgccgttggcgttgctgttgcctgcgccgaagaagttggtcagatcgaggtagccataaaaatcgaaccagtccttcttcgcaaacgcttcatattccagataaacgtcgttgttaaactgcggtccgaaacgggtgtggtagctgcctaccacgttaacgctctgatgccaccagtcggagacatactgcggatcgctttcagcggcctgcgcagcgccactcaatgaacatgccagcacggcacctgctatcaacgttttaaatttcattattatcagccacatgcttttgaccgccgcacagcagacgcagtcagagagaaatcggtcccttgatgggaatgagggtttcacagcaaataacagccagttcttcagcccgcgtagcgtgcctgtaacagatcgatagaaaatagattttgctcacgtttgtcaaaaagtgttgcattacaattcagctaaaatgtgatgcgcttcacaataatgaccaggatagaacggaaccaggcaaccgtttacgttgtctggttcgtgatcaaacgggcgggatcagggaagggtgacgcgaacctgcaaaccacaaatggcaccctgtggcgtcaggcaattggaaagggcgacgtgaatctgatgcttctgtgcgacgttgcgcacaatggataatcccagtccgctgccctgggctttaacgtcaggcgaacgggtaaaacggtcaaacgcgcgttcgataaaggattccggcatgcctggcccgttatcgacaatatcgaccactgttttacctgcgacccgatgcagcagcacatcgaccaggctgccctccggcgtgtgcaacatggcgttaccaatcagattgtcgaacaggctgcgcagctcggaacggctggcctgcaaacgatactgcgtggagccattaaagccgatatcgatgccgcgtttatctgccaccaccatcagctgctcaatgctctctttcagcagatcgtccagttcgatatgctcgacgctggcgaccacgctctggtcatcctgacgcgagacattgagtaactgcgtgaccagatgacgggtgcgtgtgacgcccgcttccagctggctgaactgtcggctcgcttcgcctggctggatgtgctgacgcagattttccagctgcaaggtcaccgccgttactggcgtgcgcagctcatgcgccgcatcttccaggaaactgacgctgcgacgaccaggcctcacgcagcttactcagcagcgagttgtaggcggccaccagcggcaggatctcatccggcaagccttcgggtgagacattgtgcggatggtgcgtctcctgcgcggcaatctgacgcgaagcgacctgaagatcccgggtgatcttgcgcaccaccagccagatcaccagcagtgacagcggcatcatcaggatcaacggaatgatcgctgacagcgcccgcttgaccatcaatgccttcatgtagctgaggttgtgcatcacctggatggttttgatctcgctgccaggtaagccgggccgggtatagatgcgccattcgcagtcgtcgcactgacccacatgcacgtcgcgatagccgcgttgattttgcagcggagcctgcagctccggccatgagctggctcgtaactgaccccgatcgtcccacagttgcaccacaaaggcgctcttcgccttgtcaggcgcaataagcatcggcatcagggcgggcatctgtttattagtggaccaggcatcagcgatttttgccagctgatcgtccttcatggtgccaaccatatcgccatagcagctgaagaaataccaggtgacgccaccgatcatcagcagatgaataatcagcagcgtagagagtaatttgtttcgtaatgaacgcataaaggtgaagggtttcatattgccggtacccgccagcccagcccgcgcacattgcggatcacgtcgttatccagcttgcggcgcatcccgtggatcaggacatccaccgcgttgctgctgacttcatcgccccagccatagatgcgattttccagctgctcgcgcgacagaatagcgcctggccgctccagcagggcgtagagcagggcatattcgcgcgccgtaagctgctcgcgctgtcctttgtagagcacttcgcgggtcatcatatccagctgcacatcgccgctgcccagcaccgagtctgctgcgccgtgactacgtcgggtaatcgcgcgcatccgggccataacttcctgtaaatcgaacggtttaagcaggtagtcgtcagcgccgctgtcgagtccctgaatccgctgcgccaccgtgtcgcgtgcggtaagaatcagcaccggcgtggcgtcgccgcgcccgcgcgcccggcgcagtacctgcaggccatcatcgcgcggtaagccgagatcgagcagcacgcagctgtagccgccttcgctccaggcattctgggcatagatgccatcacgcacccaatccaccgaccagcccgcgccctccagtgcctgctgcaggtttcgcgccgatcatttcatcatcttcaaccagtaacacgcgcatggctgatctccttcagaaagatgaggggagtttactcaccaattgttaggccagaattatccgccgtcatacttcgcactgtggcggcgttggctgcttttgctcaccccagtcactgacttatgtcagctcctggggactcgcgcagttgccgccttgccacagcacggattattttggcggactactgccgtcatacttcgcgctgtggcggcgttggctgcttttgctcaccccagtcactgacttatgtcagctcctggggactcacgcagttgccgccttgccacacatgaattatttcgcggaccgccgtcaccggtattttatggaggagtcaggtggcctgatgtccccatccatatccattgagatgccagcgattgcaagcgtaaatggggtgacgtatatttgagcaacagattaatgccagacatttcagcggtgaatagtatgtcagcccaggaagcaaaaatcagacatcagcgcgagtatcaggagcgtgttgaagccgtccgaaatggtcaggctccaggccgcgtgcttgaaaaacgtcctcagggtattgtgcctgcaaaaagtggacgcagcctcgcatttttctgatgtcacgccgtgcttaaatcagccaggtagtaaaataagctcatcatacaggtgggctttttttatgacattgcacgctattcctccagaagaacagatccttaaacttaaccgttatcttattgataacgccgaacaacttccgtcaccggttattactgtaggcggtcaggctgttatgtactggtatctgacctacctgcatctttatcctgatcagcctgatgtaacatccataacctcaattgatgttgattatgtcacccgaaaggaaggcgttgatgtgattgcgaaaatattcaatgtggcagcacaggttcaggaaatttttaatccgccctccattgcagtattaagtctgattgataaagatacgggcagggtcaaagaggatgctcagggacagtttctcaatgagcagctcaatgaggcaaatattgtagatattattgatcggcccacaggctttaatgtcggggattttctcaatgataaattgacactcaatacagaaccctttctggttatgcccgatcgacacggcgctgccatgagtcatgaatttgttcgggttctgaaccctgttgcctgtatccgctctcgcctgtcgaatgccactgtgcctatgggtaagaacagactgactgaagctgagcgaattcgggtactggctctgccagcctttaactttttgctggagaagttacagacattacctttccggcagggaaggcgttacgttgattactttgtctcgtttatctgggatagagcattcagacgttttcaggcacaacatagaatccccttgtaccgtattgttgaacaattggtggctgagctggaactggagcccggtgacgatatgcccccagaattctattaggaggagttatctcggaaggttgattttctggctcaggaatatcagcgatatctcaaacatgttgacgcctgacagggctgaatgcccccgtcacttatgatgcagaaataaatttgtctgactcagcgtttttatcttctgccttttttcagcagcaatctcttcacgaactttcacactaaagccccgctggccgcgcgattccgcctccgtttccgccgttgctaattctgcgctaattttctgctaattaagggataaattttagcaggtagagtggctccactgcacatcagcatcaacaggaggaaccatgaatcagcgcgagtttattcggagtttgctggactggattgagaacaacttaggacacgatctgcatctggatgaggtggcgcgccgctcgggctattcgcgctggcatctgcaacggctgtttcgccagcataccggcttttcactggcagaatatatccgtcagcgccgtttaaccgagtctgcgctcacgttgctgagcagcaacgaagcgatactgcaggtggcgatgaactatggctttgatacccagcaggcctatacccgcacgtttaaaaactactttatggtgacgcctggccagttgcgccgtcagcgtcgcgtcgagccggatcggctgctattccctctggcgatggccagctgatgcctgataagaccttcccgtcacagcctgcggacgggaaggtcggcccgcgctttgcgcttctctccacttgttcttcgcctcgcctttttttgcacatcagccacagtgaccccgcccggacgtgttagtttgttgccagcattcctttactgtcggagtcgggaaacatggaaaacggcgcgaatttaaccgccatgttggtatttgcacgggttgtggaattacagagtttcagtgaggcggcacgcgcactcggcttgtccaaatcccatgtcagccgggagatcgcccgtctggagctgcggctcggtatccggctgctgcaacgtaccacccggcggctggcgctgaccgagctgggccaggcgtactatccctactgtgtgcggatgctggccgaagtgcagcgcgccgaagcctttgtgcagcaggtgcatcagcagcccgtcggccatgtcaggctgcaggcacccgttacgttcggctgccagtgcgtagtccctgtccttaaccgctttctgcgtcggcatctgcatatcaatgtcgatcttgatctgaccgatcgcagtcacgatcggctggatgatcaggcggatctggcgattgtgatccgatcccgatcgccacagcagggcaattttcgggtactgagcgaaatcgagtgggggctctatgccgcgcctgcctacctggcgcagcgacccgctatcacacatcctgagatgctgccacggcacgacctgctgctgtttcatggtccggcgcagaccgccgcactgccgttccgccgtgataaacagcggctggcactggatgtacgcagccgttttcgcgccaataacagtatggcgctgctcaatgcggcactggcggggagcggcatcgcctatctgccctcctacatggcccaggaggcgatggcgcgcggtgatattcagcaactgctgccggagtggcagatggatcgtctgcaaagttatctgctgctgcacgacacgcctgaaccggcgtcgcccgtgacgctgctgtgcgatgccctggttgcggcgctgaatacaggctgattgttgcctactgacaacaatcagcgccacagagtaactatcccgccgcgactgttgttactccgctacgccggttagcctgtatccctgattactcaccggatatcatcatgcaacagtcacccgaaactgcagagtttcagcactggcgacgtaacttaggggtctgcgtcgtcggctcttttaccactatcgtggcgatgacgctgctgctgccgtttcctgccgctctatgttcagcaactcggcgttgagcagcctgccgctatcgcccgctggtccggccttgcctacggcgcgacctttttcagcgccgcactgacggcgccgttgtggggcaggctggctgaccgctatggtcgtaaggtgatgctgattcgggccagtctcgggatggcgattgcgatgtcgctgattggcatggcgaccgcgccgtggcaactggtggcgctgcgcctgctggcggggctgctgggcggctacgcatcgggatcgaccattctggtggcggcacaaacgccgaaagcgcagaccggctgggcgctgggggtgttgtcttccggcattatggccggcaacgtggtcggaccgctgctgggcggtgtgctaccgccactgatcgggattcgtcagactttctggctgaccggcgccgtgatttttctcgccttcctcgccaccacctttttactcaaagagcagccacgtgctcccgctacatcgcgcgccagccagcaaccgcatcctgaagccgggccggttaatcacagcctgatacggctgatgtggctctctggcatgttgctgatcttcgccagcatgtcgattgagccgattattacgctttacgtgggcgagtttgtgcagggcgaccaccagattaccctgatagccggactggtgatgtccgcggcggcgctgggcacggtcctggcggcaccacgactgggtcggctggccgatcgggtagggcactggcgggtgctgaccggcggtttagtcgttagcgggctgctgctgataccccaggcatttatcacggcggcctggcaactggtgctgctgcgttttcttatggggatggcgctgggcgggttgatgccgtgcatcacggcgatcattcgtcataacgtgccgggttcacaggttgggcggatgctgggatattcgacatcggcacaatatatcggccaggtcagcggcccgctgttcggtggactggtgggcggtgcattcgggatgcggccggtgtttctggcaacctgcgtggtgatgctgttttgcgcctggctcaactgtcgtggcatgaaaaagtagtgcgatcaaaaaaggcggaccggagtccgccttagtttattcacagctgcgtgaattacttctggtctggcagcgcgtaggcaatcacataatcgcccagcttggtaccaaacgagccgtgaccccctgccgcgatgacaacgtactgcttgccatccacttcataggtcattggtgtcgcctggccgcctgctggcagacgtgcctgccataacagttcgccggtatcagtgctgaaagcacgcaggtagttatctgcggtcgcaccaatgaagaacaccttacctgcggtggtgataggaccacccagcatcggcatacccattttgaacggcagcggaaccggtgcgctatcgcgaacggtaccgatacgctgtttccacaccacgttgttggtcttcagatccaccgcggagatgtaaccccaggcaggctgtttgcatggcagaccaaatggtgacaggaacgggttcagctcgacgccatacggcacgccatactgaggctgaataccggtttcggtacctgaaccaccttcagcgcctttcggcggctcaatcgggttgcctgggccacgtggaatcagcttagagacaaacggcagcgccattgggttagcaatcgcgatctgacgatgaggatcgactgcgatgccgccccattcgaacataccgaggttacccgggaacaccagcgtaccctgctcagatggcggggtgaacggaccttcatagcgcaggcgcttgaagatcacgcggcacaccagttggtcaaacatcgttgcgccccacatatccttgtccgtgagattctgtttcggacggaaggtcagctcagagtagggctgagtggcggcaacgtgatcgcctttagcagcaccctgtggcactggcgtttctggcgcaggcacgactggcttgccggtacggcgatccagtacaaagatgttgccggttttcgctggcgcgtagacaaccggtacggtgttgccatctttgtcggtgatgtcagccagcgtaggctgcgacggcagatccatatcccacagatcgtgatgcacagtctgataagaccagaccagcttaccggtggtggcgttcagggccagcacgctgctcgcataacgctcctgctctggtgtgcggttaccgccccagatatccggtgtgctcacgcccatcggcaggtaaacggtatccagtttcggatcgtaaactgccggtgcccatgagttcggagagttcatggtgaaggtgtgttcatcagccggaatggcattaggatcttttgcgccaggatcaaacacccacagcagtttgccggtattcacatcaaagccacgaatcacgcctgacggctcgcgggttgagtagttatcggtaaccgcacccgccatcacgatggtggtgttagtaatcaccggcggtgaggtcggctcatactgacccgcagtggtgacaggctgtttgtgttgcagatccagctcgccgttgacgccaaatgccgggcagcgttcgccggtctctgcgtccagtgcaaacagacgaccatcgttgaccggcagatagatacgacgtgaacacagcgcaggctgagtgttcgctgcatcggcggctgccggcacttcgtggtaagaaacaccgcgacaggtcacgtgctggaaggtcgggttgaccttcatgcccggatcaaatttccacttctgcttaccggtggccgcatccagtgcaaacaggatctggtgtggcgaacagagataaagcgtgtcgcggattttaatcggcgtgacttcgtcggtaatttcacccggatcgttaggggttttcatgtcgccagtctggaactgccaggcaacctgcaactctttcacgttctggtgattaatctgcttcagcggagagaaacgggttccctgctgatcacgcgcataagcgggccagtcagcgtccgggatgttgctcagcggcgcagcctgcggtgcgttgtcagcggtttctggtactgacccgttgatgacctgcggatcgttgaataccgcataggccagcacaatggcactggcaatcagcgccacagccatggtacccagcgcggctttgctgcccgcattgaagctgcgatagacaaacggcaggatcagccagacaccgaagatcaccagcacatcggtgcgtggtgccagtgcccagaagtcggtgcccacttcccatacaccccagataagggtgccgatcagcagcagcgcatagagaaccagcgcagtgcttttacgacgggaaagcagataagcggtgataagcatcaccacaccgccaaaaacgtaataccaggaaccaccaatggcggctaaccagccaccgccaatcagcataaacgcgcccgtcagcactgcgaaacagcaccgtcaggaaacgaattacgccaaaagatgaggagtttttccccataatatcgacctcgtttcgttgccataaaacacacgaaaacaaccagataggctgtttccagttatcaagtacaaatgattagggtgttctgaagtatctcttccgttaagacagacgatccctttgtgttaaatgttatagcaaaatcagatcgaggtttgatttttttggcttaaaccgcttaacaactggaataaaacgacattttatgggggattaaaggacgttaagcgcaccgccgtgtgcccttaacgccggaaggcaggatttgtgaatcagcagctaataagatcgccgtccgagcgttgctgttgccagccgctgatatttatctcagcaaactgctcagcggttaagggcggcgtatgacttcgtacgattacctctgcccctttttcacgaaacgtcgccataaaaaagggaaaggtaaatttctcataattatcattaaagaaagattcggttaaaacaattcctgaaaaaggaaaagattccagtagtcgccagtctgcacccggtggcgcaaaatcataaagccagaaatcaaatttctttgttaattcaagcagtgacgtactgtgtgctgccagactggaataattaattccaatccggatacgcgcattttgtaaatgcgtataggcatccggaaccgcgatcattccccgtaatcgaatatcttccaccggcacaaccattaatgctgcttcagtagcaatttgattgtgtaatgaaataatgttgtttgtattaagtatattgccgctatcctggttttgctgaagataaggcacgctatagcaaatgccagtgacattaagcttaacgtgatggattggttcagtaacataggggttatataaactgtttttcattatctctatgaaattcaatagaaaggatttgttgttaattaagcatataaaaagtcgcatttttctaaacgcgtgaataaatatagatcacatgcttaatccaaatcatccttttgttgcctgagaaagtaaataaacctgttagcaaagaaacgataattcctttggcgtctgatgatgtgctggaatatattcaatagtcgggaccaataggctggtaataatcatgaggggtctgacgcgcctcggccggacagggacgctgcttatcgcgcagggaggctgcgctggagccgcaggccttctgctcgcatccggtctgctatcgtgaagccgacaatcaccacaccaataacaccgcgcaacgacgcgggtttcctcacctgatttgggataagacatgggatttatggcatcggcagcggaagagtcgctgtggcgacatcggacatttgtcgccttctgggtggcgcgtacctgctcatcatttggttttcagatgttctcggtcgcaatcagctggcagatctatgcgctgaccaacagcgcaatggcgttagggatgattggcttaatgcagtttctgccgtcggtgttgctggcgctgccagcgggccatctggcggatcaatatgaccggcggcggatcgtgctgttgggtcagctggtggaatttgccgcactgctggcattagtggtgcttaccttattccatacccccgataagaccgcgttgtgggggctggtgtttatgattgcggtggcgaaagcgctggagtggcctgcgatgtcttcgatgctgccgtcgctggtgccaccttcgattctggcgcgtgcgatggcgatgaactccgtgggcggtcaggcagcggttatcgtcgggccgacgattggcgggctgctttatgtcgccgggccgcatgtggtgtatggcgtttccgggctattttatctggtttcgctgacgctggtgagtctgctgcgttatgagcgtccggtgcaggctcgtctgcctatgaatatgaagaatctgtttgccgggattcactttatccgtgagcgcaaagatgtacttggggtaatttcgctcgatctgtttgcggtgcttttgggcggtgcaacggcgctgctgccgatttttgccaaagatattctgcataccgggccgtgggggttggggatgttgcgcggggcgccgtcggtgggagcattgctggtgggcatctggctgagccgtcacaagctggagaagcatgtcgggatgattatgtttggctcggtggcgggctttggcgttgccacgctggtgttcgcgctttccacgcagttatggctgtcgctggtggcgctctgtgcgctgggtggctttgatatggtgagtatggtgatccggggtgcgctggtgcagctggatacgccggataccatgcgcggtcgggtgaatgcggttaacgcgattttcattaatacgtcgaatcagctgggcgagtttgagtctgggttgctggcagcctggatgggtgcggcaccggcggcggcgattggcggcatcggtacgctggtggtggtggcgctgtggatgaagttgtttccgcatctgcggcgtcgtcagaagctggagaatgaggtggatccggtttgaacaaccgaggttggtgaggcagatgcggttgtagaattgagtgcagtctcagggagcctatgccttgcgcaaagacgcaaaagcgccatccattcgctgtgagtatgtaagttgcctctgactgaaacgcaaaccggacgaacgcaaagctccgtgacgcctttcaaaacgttcctgatttacacgaaaacgcgttccttgctataacttatctctcatcggcaggcctgtggcctcctcagtcagcttaagcgcttatagagggtaccgttatgaatcagactcactccattccggaaatttataatcctgatgtgccgtattcagtaaagtgcgagatcgtggcgcagctgtgccgggcgctggcttcccataaaaacatcccggttagcgccctgagaaaatatcttctggaaaaaacgcacgttgatttcgaaaatctggaggataacccggtaggaatgctgctgctgtatgaataccttcactgccagcgcccctcggtctgcgcccggaatgaaaaaaaccttcattaagcgctgccttcagcttaatcaaatacgccttcggagaagagggctggagaaggggcggttgagttgtcgctggcaacggtttcccgagccagctcaacctcaatattgtcactggcccgaaggccagtacaggaagttaccagtcatactgccattaaaatcctggggtcagagggggaggccgacccgcaggctggggccatcaggccccggtttttcccaggttggcgtcaaatgttagccagctttcacgcatgtccactacgctgcgggttttacgagcctcatcgattttaattgccgtgaggcccgcttccagcgcgtccactactgaaactttcagcggtgttccctgtttaatatgtttaacgatctcttcagccatcagcgcatctgcgccgtaatggccatcatacgcattgccgctgtaggcggtatcgacctctttctcgccgctgcgcgcgttgtgtacgcggaagtagtttcgtacgaagtcgccttccgccatgccgtcggtgcccatgacacagaaacggcggaactcatccggcacattcagattggcgtggaaggccagcgtcgcgccgccttcgtactcaatcagggcagtctggtagtcgacaatatcggcatcgctgtcgaacaccgcatcggtgctcgaccagccgctgggcttcacgtgataaagttctgagtcagcggtgatagctccctgcggcgcatgagcgggagtaaaggatttccggccaccaaagctggcgacgcggatcgggcgctcctgcaacaggccctgatagagatcgatgtcgtgacagcatttttccagaatgtacgggccggcatatttctccagacgtcgccagtcgcgctgaaagaatgcgccgtgataaggcttgatatgttctgtcgcctcaatcgaggtgatctcacccaactgacccgcatcgcgtgccgccagcagatcgtgatagagcggggaatagcgcagtaccaggccgaccagaatgcgcgcttcgccatactgacgtaccagcttcgccatctccatggtctgctcttcattgatcaccaccggcttttcggtaaacaccgtgtaacccgctgccagcgcctgacccacatgctccagatgcagaaagttgggagagccaaccagcacgacatccattccgccatgttccagcagagcatcgattgacgcaaaggcctggccgggcgcgataccaaagctgtgcagattaggcagtccggcgggtgccggatcgtaataacccactaccgaaaaggcgtcgtcggctttgctgaactctttgatcacgtgggacagtcgaaagccgagaccgataatgcctactttcatgttaaacccctgctcctgaaatcgcatgatgcatagcccgcctgtgatcgggcgcgcctgttgataatctgaccaccaacttattacgacagaaaaactaatgtcaataacgcactgcgcgttttgcgaggggttttttgttatgatgatgtaaaataagaagaaaattcagatatgattttgctatatttatttgttattgcgatttaagtttttttatcctatcgttcgctcattatggctataacccttaatcagggaaggaagcgcgtgcaaccacactatcttctgggcattgatggcggcggtacacagtgtcgcgcgcggttaaccgacctgcagggtcgcattctggctgaagccaccggcgggcctgccaacgtctggtcagactatgacgcggcgctgacctgcgtcgggcagctgatcgaacgggtattgtcacaggcgggattagccccggaggcgctgacgcaaaccgcgctggtggccggattagccggtgcgaatgtcacctcggtacaggcgcggctcgccagctggcaacctgcctgcgcggcgttacaggtggtcagcgatgtggagatcgcctgtgcgggcgcccatggcggcgcacctggcgccgtctttattatcggcaccggcagtcagggagccgcgtgggatggcgatcagtttacgctgcttggcggctggggctttgccttgtctgaccagggatcgggcgctgagctgggccgtcgtgcgctgcggctggcgctgctggcccatgaagcgattattacccagagcgctcttacccggcagctgatggcgcagtttcgaccacagcccggaaaccatgctgctctggacgcgctcagcgacgcctgcagactgggcccgcgtggtgccacagatttttgcggccgccgacgcgggcgatggttatgcacaggatctgctgcatcagaccgcagccgatatcggcctgatggtccgccgtctgactgccctgagcagcggacccgtggcgctgatggggggactggccacgccgattcagcgctggctggatgacgatattcaggcccggctggtgacgccgcagggcgatgccctgagcggggcgctgatactagcgcagcagctgacgcctgcccgattaccgatctgaagctggctgagcatcctcagccagataacccgaggaatttatgaccgctcccaacgtaaccgcgcgcattctgcggttgattgttgaaaatgcgccgatcagccagtcagacctgaaaattcgtagcggactgagcatgtcgaccgtgtcgcaggcgactaatcgcctgctggcgcaggaaatcgtgcaggagctggggctgcgtcgcgtgtcgatgggacggccaaaaacgctgcttggactcaatcccgatcgcgccagcgtgattggcattcagctcaatgcagaacgcaacctgatcgtcatgaccgatctcagcggcaatctgctgggcgaacagcagatgccgaaaggcacgctgacaccgcgccagctcggcgatgcactggcgaaattcctgcgcggcgttgaggagaagcgggtgggcgccattggcctggccttgtcgggactggtcgatgccgaaaacggctactgtatccgctccaaagtgctcgactgggacaacgtcccgattgcgcgcctgctggaagagcgtttctcgctgccggtgtttatcgagaatgacgccaacgccatggcaatggcggcgctggtatttggtcagctcggcaacgcgcagtcggcggtgatcgccacctacggcaaagggatcggggcgggcatcattctgaatcgtcagctctaccgcggtcgtcacggcaaggcgggagagattggcaacgggctggtaggcgacggatcactgcgtctgctggaagatgtcgcctcatcgcgcgccattctgcaacggcttgctgaccaggagccggtggaaggcctcacgttgcaggcgctggatcagcggccaacgcccgaggtgctggcggtgctggaagaggcaggacgcgagctgggaatttcactggcgaacctgtcggtggcttacgatccggatgtagtttatctggcgatggagccgcacatggcgtcacgcattctgctcgatcacatcacccagagcttccaggcctatcggcttaaactgacgccgcacatgacgccgctgcagttcctgactgaatcgaaccgcatgtgggcgctgggcgcggcgggttttgccgtcaaccggctgcttgatctgctggcggcgcaggccgatgaagagccggtcacctgatttatccctcgaataaaaacgggcgccgcggcgcccgtttttgtttccgcgcttcccttagcgcaggcgcatcccctgttcatcaaacagcaggcagtgcgcagcagaaaagcccagttcaacctgggttcccagatcgcgcgtggttgcttcgcgctcttccaccaccagcatctcttcacgcccgatgtccaggtagaggtagttggtgtggcccagcatctcgccataggccagctcgccgtgaaagcgcaatgcctccggcgtctgcgcggcaggctgaaaatgctcgggacgaattcccagcgtcacggtttgcccctcgcggcagtcggcggcgattttcagcaccagcccctcaatcttcagttccggcacccgcagctgcacttcaccctcgcccgtggcgctgatttccgcccgcaggaagttcatttttggcgagccgataaaaccggcgacaaacaggttatccggatcgtgatagagcgtcagcggtgcgccgacctgctcaatgcggccctgacgcagcacgacgatgcggtcagccagcgtcatcgcttccagctgatcgtgggtgacataaatcattgtattgccgagcgaggcgtgcagccgcgcaatctcaatccgcatctgcaaacgcagctcggcatcgaggttagagagcggctcatcgaacaggaagatacgcggatgacggataattgcccggccaatcgccacgcgctgccgttgtccgccagagagcgcgcgcggcaggcggtcgagcagtttcggtgagatgcaggcgggcggccgtccgggcaatcgcctcgttgatctccgctttggactttttcattacctcaagcggataggccaggttaccgcgcaccgtcatgttggggtagagcgcataagactgaaacaccatagcaatgccgcgctcggtggcgggctgctgcgtcatgtcctgctcctcaatcagcaactgaccgctgctgatctcctccagcccggcgatcatccgcagcagtgtcgatttgccgcagccggatggcccgacaaacaccacaaattcgccgctgttgatcgtcagatcgatgccatgaatgacattaacgtgttcataagacttcttcacattctgcaagcgcaggctggtcatcggctacctcactcagagtaactggcccatgtagatggcattgctgcgcaggattggggtgaaccccatgcgctgataaaaggcacagacctgctcattctgcaggctgacgccaagatggacaccagtgacaccggcagcgcgcagcgccgccagctcatgctcaatcatccggcgaccccagccgcctttctgtgccgggggtagcaggttgatatgcagatgagcgggccactgcgtcaccagcgtgtcagcggcctggtcaggatggcgtattgcgtcgagcactttgctgtcgagcggcgcgctggcgctgcgatcacgatatttctcctgcagctgcggccaccattcggtctgtagctgcgcttcaaacgcgcgggtatcgggcgcggcgaccacataaccctgcacctcaccgtcccgctccagcacaaaagcaaagtcaggcgcgaaacgcgcataaggcacagcaaaacgctggccgggatagtcaggatcggaatagagcgcgcgggcatcgccacctgcatcggctgtttccaggcagatgcggtagagcgccgggtagtccgccggggtggccggacgaatgacaccttgattcgccatggtgaattctcgtgagtgagtgaatcggtcagggattgaacagatccgcagataaaagttacgttaatgaaagtggacttagttttcaagatagaataattaccttatctcactaacacgggcgcttcggcaatgtttaccggcatcgggatgcacaactgtgatcgccaacacgcccggatcgtggcggctggcagcagattcacggccagtgaaaggggaaagtgtgagcgtgataggattttcgtatgttttatcaggacgttattttgcaatgattgctctggcatctcctgctgcagaaaaagtagctggcgacgcaccgccacggttaatcgcgtaaatgccagcgcagtgtgctgaatttcacgccatgccgctgtttatttgcgcgtgctcacagcgttgtaattccccgcgcaggctgtttgactttatttttttattaaagtaagtatgagtgagtgcgtttgtgtgcggctgcagcctgcaggatgtcaggcggtgagatgaaaggatgccgatcctggtctgaagaaggtgagcataatgtctgtttcctccgttcgttcgttccgaattcgcaatgtgggtcggctgctggcagcgggcctgctggcgggcagcgtctcgcatgccgcccacgccgccgttaccctgaatgagtgggatatctacaactacccggagcagactgccgcggtggatgaagggattaaagagttttcccagcagaatcccggcattgtgattaaccgctcggttcactcctttgaagatacccgtattcccctgaagctggcgctgaccgccggtgatggcccgcagatcgctcaggtcaaccagggcggcggcgatatgggctcgctggttaaagataagctgctgctgccgctcgacagctacgccgccagcaacggctggaccacacgcttcccggactcgattctgaaacgtaaccgctggtcagacagcggcgagtttggcagcggcaaactctatggcgtcgccagcctgggcgagatggtcgggctctattacaacaaagcgctgctggataaagcaggtattgccgtgccgaaaacgctggctgagctggaaagcgcgatggcgaaactgaagcagcagggcaccgcgccgatgatgctcggtctgctggatggcaacatgggccagcagctgctcagcaccctgtggcaggcgcagattgagagccacgaccgcaagacgctggataatctgatttacgatgtgggcggcaccttcaaagacagcaagctggtcaatgccgcctctatgatgaagagctggaccgacaaagggtacttcttccctggcttccagggcatcggtcacgacgatgcggcgacgctgttccagaacggccaggctgcgttcctggtcagcggcacctggtatctcggccagtttaaagacaacaaagatattcactttgccgcgatgcctgccggtgaaggcgtgaagcaaccgctgatggtgggcggtaccgatctggcgttctccatcaccagcactgccaaaggcaaagaccagcaggaaggtgcggcgaagttcatcaactatatggtctctgatgccatggcgaaccgctggctgaaggtgggcttcctgcctgccagcaccaacaaagcggcgaaaatgccagcggacaatccgctgctggccgaggcgtatcaggtctggctgacgctcaatgattacgacggtttaggtcactacgtggactgggcgacacccaccatgaacgccgagctgaatcagaacgttcagctgctgctggcgggccgtcagacacccgatcagatggtagttaattttgataacaactatcagcgttacctgaaaacgctgaagcattaagccggaggcccggcgaacagccgggcctgagcctcgttctgaaccacgagtagagttatgttgaatttaagtggctggcgtaattttctctatgttctgcctgcggtgctggtctatgcggtgtttctgctgttcccgctactggcctcgctgggcatcagttttaccgaatgggacggcacctcgctgccggtgtttagcggcgtcagcaactatctgcggatgttcagcgatccggtgttctggattgcgctgggcaataacgccatcctgatgctgttctataccctgttgccgattggcgtcggcctgctgctctgcagctttctgtatgacacgcgcaacaacagcgaacgcagcgtgctgcgcattctctttttcctgccctacatcatgccgatggcggtgctgggcgtggtgtggcgctggctctataacccggcgtttggtccgatcgaccagatattacgcgcaataggattgccccagctggcactctcctggctgggtgattttacctgggcgctgcccgccgtgggtctggtcgccacctggtacttcttcggcttctgtctggttctgtttatggcgggcctgcagcgcatggatccctcactgctggaagcggccgatctcgatggctcgtcgcgtcgccagaagtttatgcgcattacgctgccaggcctgcgacccgagctgcggattgccctgctgctgacggtgatcgccagcctgaaagcctttgacctggtctatgtgatgacgcagggcggcccgggcacctccaccatggtgaccaacatctttatgtataagcagggctttgatctgcactactttggctacgcctcgtcggtagcggtgttcagcatggtcattgttttagggattaactatctgatccatctggccttaaaggagcgttactgatgcgaagcacgccggtgatttcacgcgcgctgatctggatcgtggcgcttatgacgattctgccgtttcctgatggcgctgatgacgtcgttcaaaacccagatggagctgtttcagggggtcttcacgctgcccgcctcgctgaatttcaaaaactacctgaccgcgtggcaacagggacacttcaacgtctacttcctcaactcagtgctggtggtgattccggtggtgctgttcagcgtgctgctgggcattctggccgggttcggtttcgcgtggctgaaaatccctggtaaaaaagtcatcggagcgatgctggcgctggggatggtgttgccgagtgaagcctttatcattccgctctatcacgagctgcgctggatggggctgaccaacacctatctggcgctgatcctgccgcaaatcgccctgtcgctgccctttaccacgctgatgatcgccagtgctttccagcaggtgccgaaagaactggtggaagcggcggtaatggatggggcatcgcgggtcaaaattctgtggggcattctggtgcccgctatctggccgaccctctcaacgctggggctgctgctgtttatctggacctggaatgagttcctgatcccgctgattctggtcaacaaggatgagttacgcacactgccaattggcatgatgtttttccagaacaaaaacaccatcgacattccggtgctgatggcgggcgcgatgattgtgattatgccgctgatcgtggtgttcctgattttccagcgcaagttcatcagcggcgtcaccgaaggggccgtgaagtaatctgtgatagcccgcacgaaacggcgcactggcggccagacaaaggtttgccgcgccgtatcgtgctgcaattcctcctcctcaatcctgcgggagacgcatgatgcacctttcccttgctgattttcaccctgtcgccgatggcgaaaccccggacacggccgtgctgcaacgcgctatggatcagattgcggcggcgggcggtggccgtctgaccctgcctgccgggcgttatcgcagcggctgcctgaatctgccctctgattttgaactccatcttgaagcgggcgcggtgctgatcgccagtcagcggctggctgattaccaggcggtacaggcgctgagctgtgctgagaagtcccacaatgtgctgctctatgcgctgggccagcgcaatatcaccatcagcggcaccggccgtatagacggtgacggtgaagcctggtttgccgctgagcgtgacgagcagggctatcgcctgccgcgtgcggaccggccgcggatcattgtgtttgaagattgtgagcaggtaacgctgaccgcttttaccatcgtgcaggcgccgatgtggacggtgcatctggtgagctgtcgccatgtgcatatcgaccacctcaccatcgacaatgccatgaccatgccgaataccgatgcgctcgatatcgacagctgcgaagcggtgtttgtcagcaatagctatctcagtgccgccgatgatgccatctgcatcaaaaccacccataaaccggccgcgctgcggcgtccggcgcggcagattatgatcaccaactgcctgctgcgtagctacagctgcgcctttaaaatcggcactgaaacctgggatgatgtggaagatgtcacggtgaccggctgcaccatttttgattccaaccgtggcattggcattctgtcgcgtgacggcggcgcgatgcggcgtctgctgttcagtaatctgacttttgcctgtcaccatgcgccgccctgtcactggggaaaagccgatccgctgcatatttcggtgcgcaggcgcgatcccgccattacgcccggcatcgtagagcaggtgcagttcagtaacgttacgggcgtggcggaaggggcgattaacctgcatgccgcagaaccgggctggatacgcgatgtggtcatcagccagctgcaaatgcggcagatcgtggcaccggttgcacagggacactatgacgtgcggccgccctgtaatccggactccccgaccggcatggggctggataacgcctacaaacttgacccgaaaaccggcgaagcttttggcgtagagcgctatcccggcgggctgccgggcctgtttgcacgcggggtggagaacctgcaactgcacagcctggcgatagtacggccggaaccgttaccgccaggctggcaccccgagtgtgtggtgcagttgccggactaaatcacagcgcggcggcgatggccataccaagctgttcggtgctggcgctgccgccgagatcgcgcgtcaggtgctcacccgctgccagcgtgcgttcaatcgcgtctaacaccgcatcacctgccgctttgtagccgaggtgctccagcatcatcgcgccacaccagatctgtccgatgggattggcgacgcctttaccggcgatatcgggcgcagaaccgtgaaccggttcaaacaggctggggaacaggccttccggattgatattggccgaaggggcgatgccgatggtgccggtacaggccgggccaagatcggagaggatatcgccaaacagattgctggcgaccaccacatcaaaccagtccggatgcagcacgaagttagcggtgagaatatcgatgtgatacttatcgacgcgaacctcggggaaactgaccggccatggcttcaacgcggctatcccagtagggcatggtgatggcaatgccgttcgatttggtggcggaggtcaggtgtttcttcggccgactctgtgccagctgataggcaaacttcaggatgcgatcgacgccggtgcgcgtcatcaccgtctcctgaatcaccacttcacgttcggtgccggggaacatggtgccgccgacgctggagtattcaccctcagtgttttcgcgtaccacatagaagtcgatatcgccgggctgacgattcgccagcggcgctttgacgcctggcatcagtcgcaccggacgcagattcacatattgatcgaactcccggcggaactgcagcagcgagccccacagtgaaacgtggtcgggcaccacatcgggccagccgactgcgccaaaatagattgcatcaaaggctttcagctgtggaaaccagtcgtcaggcaacattttgccatgctgctgccagtagtcggcactggcgtaatcgaaccactcccagcgcagcggaatgttaaatttctctgcggccgcattcattacacggacgccttccggcatcacttctttgccgatgccgtcgccagggatcacggcaacagagtgaattttgtcagtcacagggtacctttccggttgatgttcgaattgtgtacgcagtataactgtcgcttccggggaaataatgagcctgaaaggcaatccagtgttgaataaaagtagagaatcccgcacctccaccgatgatttagccttctttgttcgcctggctgcgctggatagcctgactgcggcggcgcgcgaactgggactgtcgctggcggcggtcagcaaacgtctgagccagcttgaacagcggcttggtgtgcaactcctgcgccgcaccacgcgacgactggagctgacgccggaagggcgccgatatctggcgggtgcgcgtccgttgctggatcagctggcggcgctggaagaggcggtcagcggcgaaaccgctcagctgcgcggcacacttaacatcaacgcctcatttggctttggccgtcggcatattgcgccctgcgtttcggcttttgccgcgctgcacccggaactctcgctatcgctgcagctcagcagccagccacttaattttcttgatgcccacatggatattgatatccgcgtcggagaaccgcccgactcacggctggtggcgcgcaaactgcgtaccaatccgcgcattctctgctgctcacctgcctatgccgcccggcacggtctgccagagacagtgcgcgatctggcacaacacaactgcattttactgcgccagcacgacagcgattttaccctgtggcgactgaccagcggcgaacagagcatcaatcagaaagtgcgcggcagtcttatcaccaacgatggcgaagtggcgatgcgactggcgatggatgggcatggcatcttgctgcgttcctggtgggacgcgcagcacagtctggcgacgggcgaaactgctgccggtgttacccgactggcaggcaccggatggcgatatttttgcggtctggcaggcgcagcgtcagcttccggcgcgtattaccgcatttgtggcgtttctgcagagcaatctgcaatcggttgattagccaggcttttaaaggcagtttctggtgcggccagacgcctgcggacaatatacataccgcattaagctgattcggttgcgtcagcgtgccgctgcgtttacagcgttttagcggctgcgtatgattcttattctttttatttccagcctgtcctctgcgttgtggccagccgggagcagcaagcagataggggagttaagtatgaaagcgttgttcagtccgcgtacagcggcacttacactggcgatggtgaccaccttcagcctgacggcgtgccagatgccggcgaaaaaagtggatgccagcgcgccggtggtgatgcagccctccagcccggataacctgattcagcgcgagctgggtgaaggtttgtatgagatggcctatctgccagcaaaaaacgccctctatgtcgccagcgcgcagggatttaaagatatcagcggcggcatgatctaccgtcttgatgcttccacgctgcagagcaccggcgcgggacacttcgacctgaaaaactttggtctgatcagtgcgcctgacggcagcgcactctacgccaccaacacgctggatggcggtatctctaaaatcgatcctgataacggtaaggtgctgaagcgcctgatgtttgacgagaaaaatgagaaaggcatgccctatggcacgcgtgaaatctttctgcatgacgggctgctctatgtcggcggcgtgggcgatccgggcgtgatctgggtggttgatgccaaaaccctgacgctgaaaacccggataaaaaatgccgggaagtgggtcacaggcatcatcttctcgccggtcagcgaccggatttatgcggctaacggcagcggggaaatcctggtgatcaatccgcgcaataacaaaatcgagcagcgcctgacggcgggtgacgggcaggagtatctgttcctgaatatggccgaggatccggcaaccggtcgcctgtttgttacggataattcaaaagcgaaaaatacgctggtgtttgatgagcgcagcggcaaggtcattaagcgtctgaatccgggcgactcactggggattaagtttaatggcaagcgcaatgagatttatatcagccagcgcgaatcgaagaaggtgctgcagctggatggcaccacctatgaggtgaaaaacagctggtcatttgatagccaccccaacagtctgctggtctcaccggacgggcagaccctgttcgtcaccctgaagcagggcttcaatgacgatcacagcagtcaggggctggatggcgtggcgcgtatcacactgcaataagaaaaggcggcatcgctgccgcctgcatctttacttagccacaccttctaccagcaccacgcgatagttcgcgcctttcagacggtgcgctttggcagcctgatattccgggctgtcataccaggcatgtgcggcttcgcggctcgcgaattccagaatcaccacgccttccgcttcctgcccttccagcgtttccagttcgccataaaaggcgagaggattgatctgatgatcgccgcgagcctcgcccgctttctcggcatagatcgccatttcgtcctggttcagggtgttatcacgaataaatacaacatatgcactcacaggtctctccttaagcttttttatcctgggttttggtatcgaagtcagcggcatcatgacgctcgtgcagctgatcggccgggtcgcccatgacacggttgaccttgcggccacgaatcacagcaggtcgcagcgcgatctctttcgcccagcgcactacatttttataggagtgcacatccaggaattcggcaccgccatactggtcattcagcaccatgttgccgtaccacggccaggtggcgatatcagcgatggtgtagtcatcaccggccagatagcggttatctgccagctgacgatccagcacgtcgagctgacgcttcgcttccagcgtgaagcggttaatggcgtactcaattttttctggcgcgtagtgatagaaatgaccgaaaccaccgccgaggtaaggcgctgagccctgtaaccagaagagccagttcagggtttcggtgcggccagcgatatctttcggcaggaagtagccatacttctccgcaagatagagcaggatgttgcccgattcaaatacccgaatcggcggcgttgctgagtggtcgctcagcgccgggattttcgagttcgggtttacgtcgacaaaaccgctggagaactgatcgccttcgccgatacggatcagccaggcatcatattccgcatcgttgacgttaagcgccagcagtttcttccagcaggatggtcactttctggccgttaggcgtgccaagcgaatagagctgtaaaggatgcttgccgaccggcaacgctttttcatgggtgggaccagcgaacggacgattagttttagcgccgttacctttggcttcagggtcccaggtccagacttttgcgggctgatatgcattttccgacataatgaaagttcgccttatggtgtggtattggtctggagtgtagcaggtgctgcgaagggggtttaactctgctggctgcgcaaggccgtgctgcagggggctgatgtcaggcgggcagcggcacaggagaaaagtgaataaaagtgtgtcaggcgggtggttcgttatcctgagcggaggtggccgtgcagtcagaagcgactgcacggcaggcagggttacagcagttcacgctcaatcagttcgcgggtttctaccgcctgaaccttcatcttttccgggtagccaaacagagacgccgcgatgatcggttcaccgccgactttataactgcgggtggcaaagccggtgtcgcgcagcgttttaaacagggtgtcgaagtccacttcgccttcgcccacgccgacatgctggtgaatggtggcatccacccctggcgggttaacgatgtagcgacagtgttttgtatggttcatggtgtcggcgatcagcatgtgtgacagatcgtcaccggcatactccagcatcggtttcacatcacctttgcctttgtcataaaagaaagtgtgtggtgcgctataaatatacttcacgttatcgctgcgaaacgacttcacgatatccacggtttcgttgttctcttcgcagaaatcccatggatgcgcctggatttcgacgcggatgccttcacgttcgatgattggcagcagctcttccatggagcgatagaacatctcttcacagatttccggctcgttaggcgtgccggagagctcggtgttgatcacctgcacacccatctcaaccgcgatctcgatcatccgcttccagttcttcaccgccgcctgacgacgcagctcatccgggccggaccagcgatagaccacgataaacgaggagatctccagcccggtggcgtttaacgcattcttatactcggtgatgatttcacggctggctttaggatgtttataaaacgggttgatctgcggatgcggcgactgttcgatatatttgtatccccagtcggccacctgatgaaccatacgggtgatgcctaaatctttaatcacatccacatcaaaagcgattttcatctttctgctccgggcacattaaggttgctgttcttcattgaaggtcacgccaatctgctgcctgacgttgtccatcgtggccagggtggtaatcgcctggtcaagcgaatggatgggtgaatcgatccggttctgaccgatacaccaggcgaaatggttaatttcatgacagagctgttcatagcggctggcaggctcctgccactgcaggcgatgacgccgatcgctggaggtcagggtgaagttaccaggcgcatagaaaactggcctgaaagttccagcgtggcctcgcgtccggcgatcaccgcgccgcctggcgtgttgctgaacagggtggtattcagcaacgaatgcatgccgtgctgatgggtaaacagcatcgacgtctgaccgtttacacgcccagccgggacgggctggccccgggcgacgatcgtgtcaggcgcaccgccgccaacaaacacgctaagcgccaccagatagctgcccagatccagcatcgggccgcccgccagatcggcgttgaagatgcgatggtctggtgtgaaaaactcgccatgatcggcaatcagggtgtgaacatcgccgagcacgccatcctccagcagctgacggataacgtcatatttcggtgtgaagttgcaccacatcgcctccatacagagcaggttcgcggcagcggcggccagtttaagctgtgtcgcctgctgagcattcagcgccagcggcttttcaatcagcagatgctttccggcggcaatcgcgcgcagaccatcgggaaaatggtggttgtggggcgtagcgatatagaccgcatcaacatcctcccgcgccagcagcacgtcgatactgcccgtggcatggctgattgaccatttgtcggcaaaggcctgtgcttttgccgggtcacgcgcagccaccgccgtgatctgctggtgggtatgcttgcgcagtgcatgggcaaaatggtcggcgatccagcccggcccgataatgccccagcgcaactgtggtacctggctggcagcggtcaggcgtggaaccggaagcgttgaagggaacataacttttccttttatacgtgcaggcaggtgctgctcagggctccactatagaaagcccgccgtcgtcgctctaaccttttaatgatgtgatcccatcaacccgatcggcgcaggatttttatccgttttagcaaatgggcgttttaaagagaatgcagaaagaaatgaatgtttcattttgcgaggacgatcaagattaacgctgactttctatcaaataaatgagaggaaatggctgtgccgcgatagagtgttaatgtctcagacaacagaatatataggcgtagccgtcagccagcgctacaaagagcagaagcagggagaaggatgatgtcaaaagtgacgatgaccgctattgcgcaggcggcgggcgtgggcgtggccaccgtggatcgggtgctgaatggacgcgcgccggtgcgcagcgtgaccgagcagaaagtgctggctgcggcccgcgagctgggctatcacctgacgcaggcacacatccggacaacatcgccgctcgctgcggcaacagtttcgcgtgagctttatcctgctgcctgcccgttattcgttttatcagcagctaggcgaggtgctgaaacagcagctgaaggcgcagcagccacagggcagcgaacctgaattctgctggcatgatattcatgaagtggaggcggtggcgcactcgctgcgtctgctggcacagcgcagtgatgtgattgcgctggtggcgctggatcatccgctgattcgtcacgcgattcaggatgtgtcacgactgggcgtacgggtttacgcgctcttttctgatttctcgccctgtgagcatgcggggtttatcggcattgataatcagaaagcgggacgtacggcggcctggatggcacagcatctgctgcgtcagccgggatgcgttggggtgctgctgggcgatcaccgctttacctgccaggagagcagcgagatcagtttccgctcttacctgcgcgagtcaggcatcagccagcgggtactggaaccgttaaaaacgcatgagtcgggtgaaggaggctatcaggcgacccggcagttgctggacacccatgatgatctggtgatgatttatgcgccctgcggcggcatagagggcgtggtgcaggcgctgcgtgacagcggacgcaggcagatcgatctgctgtgccacggtccgctgcccggcgatgagctggcgctgattgatggcaccattacgctgatgttgcgccatcgtattgatgccatggctgcggcggtgatcgccacctgcctcaacagccggatggaacagcgcgaccattttgctcagatgaccgtaccctttgaaatcgtgacgcgtgaaaacctgtagaaagagcaggttagcgggtatttgatagaaaactatcatataaagaaatatttaaacgcgatctctatcaaaaaatgaaactttcattgttgtctgagatgaaattttcatttgatactgccagcagttctcactgcacaggcagatatcatgacctttcacattgctaatgcgccctgtagctggggcgtcgacgatcccgctaatccctggctgccgccatggcagaaagtcctgactgaagccgctctggctggctatcccagtatcgaacttggcccctggggctatctgccagcggatgcagccgaactgacccggcagcttaatgcgcatcagctttcgctggtggcgggtacgatttttgatgatttggtcagtgaagcgcatttccctgaactggtgacgctgacccacaacctgtgccgtaccctggccagtgtgccaaccgccgccagaacgcccggcgccagcgcgccttatctggtgatcatcgacttcgggaatccggagcgggcgaaatatgccggtcagtcagaaaaagcgccacggctctccgctgacgactggcagcgcatgatgcgacacatcaccattctcagtgagattgcctggcaggagtatggcgtgcgaccggtgatccatccgcatgcgggcggctgcattgagtttgccgatgagcttgcgcggctggtcagtgatattccgcatcaggtggctggtttatgcctggataccggccatctctattacgccgggatggatccggtcgcttcgctgcaacagtactggacccgcatcgattacctccacttcaaagacgttaaccagcgggtctggcgagacgccctctctcacggactcgactttttcactgcctgcgcgcagggggtgatgtgtccgctggggcagggcgcaattgactatccggcggtgcgcacgctgctgactgagcgtaactatcagggctggatcaccatcgaacaggagcgtgatccgcgccatgccgacaccagtctgcgggatgttaaagccagcctggactatctccgatcaacaggattctgaggacaacagcatgattaacggtaaaaaagcggctaatcgctcgctgcgctggggcatgatcggcggcggcggcaccagccagattgggtatatccatcgctctgcggcacagcgtgacggaaactttgtgctgctggcgggggcgtttgatattgatgccgcacgcgggcgtgagtttggtcaggcgctgggtgtggcaccggaccgctgttatcccgattatgccagcctgttcgccggggaagccgcgcgtgaagatggcattgaggcggtgtctgtcgccacgcctaataatactcatttcgccatttgccgcgcggcgcttaatgccgggctgcatgtggtgtgcgagaagcccctctgttttacggtcgaagaggcggatgagctggagcagctgagccgggagaagcagaaggttgttggcgtcacctacggttacgccgggcatcagctggttcatcaagccagggaaatgatcgccgaaggggctttgggtgagatccgcatcgttaacatgcagtttgcccacggcttccataatgaggcagtggagttgcagagtgaaagcacccgctggcgggttgatccgcgctttgtcggcccgagttacgtgttaggcgacctggcgacgcatccgttatttatcgcagaaacgatgttgccacagctgaaagtgacgcgtctgctctgttcgcgtcagagctttgtcgcgtcgcgtgcgccgctggaggacaacgcctttgtgatgatggagtatgacaacggcgcagtcggcacgttatgggcgtcggcggtgaatgccggatcgatgcacgggcagaagattcgggtcgtcggatcgaaagccagtctggaatggtgggatgagcagccgaaccagttgcgctatgaagtgcagggcgagccagtgcgcattctggagcgcggcatgggctatcttaatccgcgcgcgctggaagaggaccgcattggcggagggcataccgaggggttatttgaagcctggtccaatctttatcgtcgcttcgcgctggcgatggatgccaccgatcgccgtgacaccgacttcctgcaggatttctggtatcccgacgtgcatgccggattaatgggcgtgcgctgggtcgcgcagtgcgtgaaatcggcggatgccggtgcagtgtgggtggcgtgctgaagcagagggcgagccacaggatgtggcgagtgtatcgaaccttcgataacgggtttgctccacaaaagcaaaaaacccgccagaggcgggttctttaaatatggtgcccgaacccggacaaaaatgccgggagcatttttgcatcgcgcggcttcgcgcgacccggagggtgagccacaggatgtggcgagtgtatcgaaccttcgataacgggttcgctccacaaaagcaaaaacccgccagaggcgggttctttaaatatggtgcccgaacccggacaaaaatgccgggagcatttttgcatcgcgcggcttcgcgcgacccggagggtgagccacaggatgtggcgagtgtatcgaaccttcgataacgggttcgttccacaaaagcaaaaacccgccagaggcgggttctttaaatatggtgcccgaacccggaatcgaaccagggacacggggattttcaatcccctgctctaccgactgagctattcgggcaacggggcgcattaaaccgtaaaggccgcgggtcgtcaacggctttcaccaaaaaacccctggaaacgtgactgattgcctgattttcagtcaaagcgggtaaaacctcaggccagcgcgccatttttacggcatagcgcgatgctgtaaacatcctccgccagccgctgtgcggtggcgacatcctgcacattgcgcttcaccagcagcttgctgaggcagccttcaagaatcagctccatctgatcggccaccatgctggggttgtccagcgcctgctccaccagaatgtcgtaggtgaactgccatgagccgcgtttctgctgtttcggccagttgatggatgggctgatcgggctgcgggtagaagctacaggcggcaataaacaggcagcctggaaagcgtcctttgctgacctgctcactcaggacctcatagcgtgccatcagcttctggtcgggcgacagcgattcatccagcaggatctggcgtcgccaggtatcaatctgctgcccgtgatagcgcagcgcatcgtagagcagggcgtcacgatcgggccagaactgctgaagctggtcacgggttaattcggatcccgccagggtttccaatgagagggtggcggcgaggccgttctgttcaagcacattcaatgcatgctcgagtatctgttcacgctgcaagtgactctcctctggtatgcaggcccggtaaggcaccgggcaatgacctgactccagtgttgtttacggggtaagtttctgcaaatgcgcccggaagtcggcggcattgagaaacccggtgatgcgcgatccggcgatttcgcggccctgcgcatcaaagaacaaaatcgtcggtaagcccagcacctgaaggtgctgcaacagcgcgttatcactggcgttgttggcggtgacgttggcctggagcagctgtacctgactcaggctatcgcgcacggcgctgtcactaaaggtatatttttcaaactctttgcaggcgacgcaccagtcagcgtagagatcgaccatggtgatgcggccgcgggcctgctgcagcgcgctatcaagctgctgcggcgtctggatagtatggaacggcagcggtgccacagcctgctgctgcgccggtccgccaaaggcccagtcctgcaacgggcgtgcgctgatcagcgcagcggccagcatgataatctgcactacgcgccacttaccgctgctggcgcgcaggctgacgctgaacgcccagccaaagaacgccaggccgagcaggctccagagccgcaatccccacgcatcgcccagcacccgctccagcaggaagaccggcagcgccaggatgacaaaaccaaagccctctttaacggtttgcatccacgggccgcttttcggcagcaaccggttaccaaacagggtcacggcgatcagcggtaatcccattccgaccgcatagagccacagcgtcccggcaccggcccacagatttccgctctgcgcgatgtaaagcagaatagcgctgagcggggcggtggtgcagggcgagcagatcaaacccgccagcgcgcccatcaggaagacgccgggcagcgagccaccctgctgacgattactccacagagtcaggcgggtttgcatgctggcgggcagttgcagcgtaaacaggccgaacatcgacagcgccagcacgataaacagcagtgagagcgtgaacagcacataaggatgctgcaacgcggcctggaagcgcaggcccgctgccgcgacgacgactcccagcagcgtgtaggtcagcgccatcccctgcacatagaccatcgccagcgcgaacagccggcccagcgaatagtggcgctgaccgccaaggataatgccggagatcagcggatacatcggcagtacgcagggcgtaaacgcgacaccgataccaatcagtagcgcccagagcggcgagaaaggcagcgggctggcgggcgcgggctgagcgctgaccggcggcggtgcgctgctggcggttaccgcacttaccggaacgctgcgcgtctctggcggataacagaatccggcggcggcacagccctgataagtcacactgagcgtggcgccgctggccgcctgttgcagcgtcaccggcagcgtcagatcctgcggatagatttcacttttgccgaagaattcatcttcatgcggctgaccagccggcagcgttaacggcgcgatggtcgcgtttctgcggtgtgatgtggatctgctggcgatagaggtagtaacccgatttcactttccagtgcaggttgagctgcgcgccctgctggtcgaagtcaaaagtaaaggcctgatcgaccggcacaaagcgactggtcgccggatttgaaaagagtgaagcgtgcgcctgcaggccgataaacagcgtcagcagaagcgtaattaagcgagagatgcgtgcagccatgacaagtattcactgtctccatattgaaccggcagcgccagcagttcgggcacatcgtaagggtgagcgtctttgagcagatcacacagcgcctgctgatgatcgctgtcgcatttcagcagcatctggacttcgctgctctgctccatttttccctgccagagataccaggaggtggcgcccggcagcagtgtgacacaggccgccagcctggcttccagcgctaagccagcaaggtgctccgccgtggcctgatcgggcgtggtgcagaggatcacgacagcattcatcctgtgactcctgttttaaagagcgccgatgatagcacgctccatccgtaacacgaggagtgtgcttatagcagcaatccgccaaaaacgaagccagagagcaccgacagcgcaatggcgatcacgccgggaatgataaaggcatggttaaacacatacttgccaatccgggttgaacccgtgtcatccatctcgacggcggccagcagggtcgggtaggtcggcagcacaaacagcgccgaaaccgccgcgaaggaagcgatggcagtaagcggcgtaacgcccagcagcagcgcggcgggcatcagcgctttggtagtcgcagcctgcgagtagagcagcatcgaggcgaagaacagcaccagcgccagcatccacggataggttttcagcgtgtcgcccgccagcatctgaatctccgccagatgtgccttcacaaaggtatcgcccagccaggcgacgcccattacgcagatacaggcgctcatgccggacttgaaggtgctggcgctgaggatttcgctggtgtcgagtttgcaggtcaggctgatcagcgtggcgatggtcagcataaacaccacaatcgcttcattgcgtggcagtggcggattgacgatcagcccgacgctggcgctggtcgcggtggcataaagcaccacggccacgatgcccgtcagaaacagcagcaccgattttttcgcgcccggttttgcctggtagaggctggcgccgcgcagcgtgacttcgcctttggcgagacgcgcctgataaacctcatcatcctttagctcacggcctaagaagttagtcaccagagccgccaggaagaggcccaccatggttgaggggatggcaatcgccagcagcgtgatatagctgacgccgcgcggctcaagcaaagtggcgaagaaaaccactgcggctgaaatgggtgatgcggtaatcgcgatctgcgaagccactaccgcaatcgacagcggccgggaagggcgaacgccttgctctttcgccacttctgcaatcaccggtaatgttgagaacgcggtatgtccggtaccggccagtagcgtcatcaggtaggtcactagtggggccagcagcgtaacgtggcgtggatggcggcgcagcaggcgttccgccagactcaccagataatccatcccgcctgccacctgcatggcggctatcgcggcgatcaccgccatgatgatttcaatcacatcgaacggaatagcgccgggtgccatgccaaatcccagcgtcaggatcagcacgcccattccgcctgcgaaacccgataccaatgccgccaagacgtgcgcccaaccagatcgccatcaagacgataagcagctcaaccacaaacatgaatgactcctgaaagataaaccggtaatagccgggtgtgctgtttaacaaaaaaaaaggcacaccgtgttgatcgcggtgtgcctttggttaaccagcgtcggttaaaccttactgttcgttttcatcagtataacgtttggctttataaaccgggtacatcaggttctgcaccgagaagatatcgtccagctcactttccgtcagcaggccgcgctccagcacgacttcacgtacgcttttaccggtttccgcacagattttgccgacgatgtcgccgttgtggtggccgatgtaagggttaaggtaagtcacgataccaatcgagttgaagacataggcttcgcacaccgcgcggttggcggtaatgccgttgatgcacttctccagcaggttgtagcaggcgttagtcagaatgctgatcgactcaaacagcgcctggccaatcaccggctccatcacgttgagctgcagctggcccgcttcagaggccatcgtcacggtgatgtcgttgccaatcactttgaagcaaacctggtttaccacctccggtacaaccggattgaccttggcgggcatgatagaggaacccgcctgcagctctggcaggttgatttcattcagaccagcacgcgggcctgaggagagcaggcgcagatcgttacagattttagagagcttcaccgccagacgtttcagcgatgaatggaccatcacataggcgccacagtcggaggttgcttcaatcagatcttccgctggcaccaccggcaggttgctgacttccgccagacgctgtaccgccaggtgctgatacccttccggcgtattgaggcgggtgccgatggcggtcgcgcccaggttcacttccagcagcagttccgcggtgcgcagaatgcttttggtctcttcgttcagcagtacgctgaaggcgtgaaattcctgcccgagggtcatcggcacggcatcctgcaactgggtacggcccattttcaggatggtctggaactcatcggctttgtgctggaagccttcggccagctggctgatgccatcaagcagtttcagtagcgagctgtagaccgcgatgcggaaaccggttgggtaagcgtcgttggtggactggcatttgttcacatgatcgttggggttgaggtactgatattcccctttctggtggcccatcagctcaaggccgatattcgccagtacttcattggtgttcatgttgaccgaggttccggcaccgccctgataaacatccacggggaactggtccatacagcggccgttgttaagcacttcgtcgcaggccttaatgatggtatcggcaatgttgcgcgggatggtctgcagctctttgttggccatcgccgccgctttttttaccatcaccatgccgcggacaaattcaggtatgtcgctgattttgctgttgctgatataaaaattctcaatcgcacgcagagtatgaacgccataataggcatccgccggaacttcgcgcatacctaacaggtcttcttcgatacgaatgttgttcgccatgataaccttcttgttgttgccgctaaccatcacaaaggatgtgtttattttgtcgtggtgtacccgtgccgacatattatccgtcttcataggggcgtgtgcgatcatattctgatgcatatgaaaagcacgcatgcagatcacttaatgctgcagcctggttaacgatatgtgaagttggttacaaaattaaccccgcaggataaatttgacaggatcggttgaaaatggcggcgcgggtgcccatctcttttcttatcatcctcaggatgaacgctttctgctgaccggcacgctgccgttcagcccctacttacaggagagtacggtgcgctggataccgttattagtctttttcgttctggcctggattgagatttccctcttcattcaggttgcacacgtcatgggcgtgctgcttaccatgctgctggtggtcttcacctcgtgcatcggcgtctcgctggtcaaaaatcagggcatgaaaaactttatgctgatgcaggagaagctggcacgtaatgaaagcccggccaatgagatgatcaaaagcgtgtcgctgatcatcgccggtttcctgctgctgctgcctggtttctttaccgacctgctgggcctgctgctgctgctgccaccggtgcagaaacatctgacgctgaagctgatgcctcatctgcgcgtctggcggggaccgggagccggtccagacagcggctacaccatggatggcgagttcgagcgtaaagacagcgatcgccttgagcatcatgacgatcacaaggatcgttaaccgcagctgtcacctttgaaagcgcaaccctcgggttgcgtgagattgttgaaaaacctgacccggccagctgtgagaccggagccgcacagggaacagggtcagatcggaaagtcgcaaaatcgtcatccatgactgctcggcccgcgccatccgtggcgcgggacgctttcctcttctgaccctgtttcctgcgccctgagcttagccgttgctgccagggtcatcctgttctgagtttgtcagcacgctggcgcaaccttcgggttgcgttttttatttgccccatcatctgttcaaaaagccatcacttatcactcacacgtaaaaaatttgttgtccgcccccttgaaagtgggtggtagcggccctatctctctggtcacgaggccggaagccatgcagcccggtgttcaaccccaaaactgaatgattggacttctcaaaggagagctatcaaatgaaaattcgtccattgcacgatcgcgttatcgtcaagcgtaaagaagttgaagctaaatcagctggcggcatcgtgctgaccggttccgcagccggtaaatccacccgtggtgaagtactggctgtcggcaatggccgcatccttgagagtggcgacgttaagccgctggacgtgaaggttggcgacatcgtgatcttcagcgaaggttacggcgcgaaaaccgagaaaatcgacaacgaagaggtgcttatcatctctgagagcgacattctggccgttgttgaagcgtaatttttacgcgtaattcactgaacgaaacgaatttaagggatatttaaagatggcagctaaagacgtaaaattcggtaatgacgcacgcgtaaaaatgctgcgtggcgtgaacgtactggcagatgcagtaaaagttaccctgggtcctaaaggccgtaacgtagtcctggataaatcttttggtgcaccgaccatcactaaagatggtgtttctgttgcacgtgaaatcgagctggaagacaagttcgagaacatgggcgcgcagatggtgaaagaagttgcctctaaagcgaaacgacgctgcgggcgacggtaccaccactgcaaccgtactggcacagtctatcatcaccgaaggcctgaaagcggtcgcagcgggtatgaacccgatggacctgaagcgcggtattgaccaggctgttatcgctgcggttgagaaactgaaagcgctgtctgttccttgctctgactctaaagcgattgcgcaggtaggtactatctctgctaactccgatgaaaccgtgggccagctgattgctcaggcgatggagaaagtgggtaaagaaggcgtgatcaccgttgaagaaggcaccggcctgcaggatgagctggatgtggttgaaggtatgcagtttgatcgcggctacctgtcaccttacttcatcaacaagccagaaaccggtgcgattgaactggaatctccgttcatcctgctggctgacaagaaaatctctaacatccgtgaaatgctgccagtgctggaagccgttgcgaaagccggcaaaccactgctgatcatcgcggaagatgttgaaggcgaagcgctggcaacactggtggttaacaccatgcgcggcatcgtgaaagtggctgcggttaaagcaccaggcttcggcgaccgtcgtaaagctatgctgcaggatatcgctatcctgaccggtggtaccgtaatctctgaagagatcggtatggaactggagaaagcggctctggaagatctgggccaggcaaaacgcgttgtgatcaacaaagacaccaccaccatcatcgacggtgtgggtgaagaagcgacaattcagggccgtgtaacccagattcgtcagcagatcgaagaagcaacgtctgactacgacaaagaaaaactgcaggaacgcgtagcgaaactggcaggcggcgtagccgttctgaaagtaggcgcagcaactgaagttgaaatgaaagagaagaaagcccgcgttgaagatgcgctgcacgcaacccgtgctgctgtagaagaaggtgtggttgctggtggtggtgtggcgctggttcgcgtggcagcacagctggttgatctgcgtggtcagaacgaagatcagaacgtcggtatcaaagttgcgctgcgcgcgatggaatctccactgcgtcagatcgtttctaacgccggtgaagagccatctgttgtcgctaacaacgtgaaagcgggcgacggtaactacggttacaacgcgcagactgaagagtacggcaacatgatcgacttcggtatcctggacccaaccaaagtgacccgttctgctctgcagtacgcggcctctgttgcgggtctgatgatcacgaccgaatgtatggtcactgacctgccaaaaggcgacgcacctgatttaggcggcggcgctggcggtatgggtggcatgggcggtatgggcggcatgatgtaattgccgttgactgcttaagtcatcaaagaacccccgatcggaaacggtcgggggtttttcttttttagcgtctgaatgctggcagtagcaggaaaaacccattaactttttttatgttctgcatcatggtttagtcagggcgggatgctctaacgtggatcccggcgcaaaatagcgcgctctgaaagggataaacaacagattaaggaaaattaaaatgcacgataaatgggaattttataaggacgaagcacacaagtggcgctggagaagaacggcgcccaacggaaatattaccggcgccgccagtcagggctacgttaacaaagccgattgcatcgaaaatgcacgacgtaatggctacaccggttaagggcatcacgctctgacatcacccccgatcggaaacggtcgggggtttttcttttgggtgggaaaatagtataagtaagtcgcaatcgttcgtctttcctcttgatatgtcacgctgtctgcggctgcgccgactgatcgactggcttcattttattcaccagcatcggcacgcttgccagcctgcaagcggcgtgaaatattgagacgatataacgggataagggcaatgaatgtgcagaaagaaaaatcctttttctgctacgctgccacccgactctgatgataataaatggggattacaatgcggattaacctcttgctcggactgacggctggcgcgttattgctggcgggctgcagcagctctacgcaactctcttcagcaggacagcgcgtgacgttcaccgatcagcagcctggcaatacctgtcagcttctgggcaatattaccggctctcagagcaactggctgagcggtgcaggcggggaaaccagcgcactgcgtggcgcagcaaacgacctgcgcaatcgcgcagcggatatgggcggtaacgtgatttatggagcaaccagtccaacgcagaacctgttgtccgcgtttcgcgccactcgacagcaaaatgaccggccaggtctacaagtgcccataatgtgaatcaggcagtctgccaaattgaaccggccagccttttactggccgtttttattcctgacgtaactgtaaatctaacggtgttttacttggctctccgccaatttcacgcgccagctttggcaccagatagccggagacctgtgacagtaatgcacgcaccagctggcgggcctcgtcatctgacacaaagaaatgcgccgcaccctgtaccttatccagcacgtgcagatagtagggcagaatgccggcatcaaatagcgcattgctcagggtggccagcgtctgcgcattatcgttgatgccacgcaacaggacgctctgattcagcagggtcactccagcacgcttcaggctgctcatcgcctcacgcagctcatcatcaatctcctgcgcatggttgatgtgcgtcaccatcaccacctgcagatgcgtctcgctgagcatctgacagagctgatcggtaatgcgcgccggtatcaccaccggtaaacggctgtggatgcgcagacgtttcagatgcgggatctgttccagcgcggcgataagccaggcgagctcatgatctttcgccatcagcggatcgccgccggagaaaatgatctcatccagctcgggatgatcggcgatatagtccagtgcagcctgccagctacgcttgttgccgggattatcctgataggggaaatgacggcggaagcagtagcgacagttgacggcgcagccgccttttaccaacaataaagcccggtttcggtatttatgcagcaatccaggtacaacgttgctttgttcatcgagcggatcggtgctataacctggcgcatcagtgaattcctggcggcgggtcagtacctgaagcagcagcgggtcgtgcgcatcgccttttttcatccggcggatgaacgcatgcggtacacgtaaggcgaaaagacgccgcgcatccgcaccttcagccagctcagtgtgctgatcaagggctaaaatccgcagtaattcatcaggttcggtgacaacatccgcaagttgctgcaaccaatcttctctggaaggtgtttttagggttacaatgtgtgccatttttttggcttagtaccagtgtcaattttcgtagagggccttcatggcgacttattctagcaacgatttccgtcccggtcttaaaatcatgttcgaaggcgagccgtatgccatcgaatccagtgagttcgttaaaccgggtaaaggtcaggcattcgcgcgcgttaaaatgcgtcgcctgctgacgggttctcgcgttgagaaaacttttaaatctaccgactccgccgaaggcgctgacgtagtagataccaacctgaactacctgtacaacgacggtgagttctaccacttcatgcatccggaaagctttgagcagttccaggttgaagagaagacggtaagcgatgcagcgaaatggctgcaggataacgctgaatgtatcgttacgctgtggaacggtcgtccgatcgccgttcagccgccgaactttatcgaagctgaagttatcgaaaccgatccaggcctgaaaggtgataccgcagggactggcggcaagccagctaaactctctaccggtgccgtggtgaaagtgccactgttcgtgcaagagggcgaagtggtgaaagttgacacccgctctggcgaatacgtgtcacgcgtgaaataagattcgcaggcgcatcttctgatgcgcctttttcttgtctgagagaaaaaaatgatcaagctggcaaaattaatcgcgttcgcgttgctggtctcctctgcgttaagcgcctgcaacacattccacggttttggcgaagatgtctctcacttaggtggtgccatttcgcgtgcagcaaaatgaccttaactgattgtcctttttaaagtctcgccagcagcaactgccggaaatccggctatgcttaaagcgctgtactttacatccatcaaaaaggacattgttatgttaaagaaaagtattgctgcaatcttctctgtactggtgctctcttccctgctcacagcttgtaatacaacgcgtggcgtaggtgaagatgtcgaagcgggcggccaggcgattcagaacagcacgaagtaacctgttattccaaccggtacgaaatgcttttcgtaccggcttgtcagattctgcactatttctgttttacccagattaactcttcaaccgggaaaccatcccgacgcgcctgatcaaccagtttctcttttacgcccggttccagttgtggtgtgcgtgacagtatccagagatagtggcgattcggtccacataccagcgcatagcggtagtcaggatcgagagcaatcacgttatagccgccatagaaggggccgaagaaagagactttcagagaagcccgcgtgggttcaccggtaaagtaggctttgccaacgctctcctgccagcgctgctttttgacgttatagccacggttgattaccttcaggccgccatcttcacgcgggctgtagtttgccgttacctgttcaaggccgcgctcaaaagggtggttaaggcgggcaatctcataccactgaccgagatagcgctggctgtcaaagttatctacgaccgtgacgtttctttggcggcgtagtgctgcaggcgacagagagaaaagcactcaggctggcaacaactgttttccatggagacatagtgggattcctttgtgatttaaccgcttaagtatagaagccgaaacgctgtttttggcagtacgggcacgagattgtttgccgcaggcattgcaggtagacttcccccctaatttgtatcaggagtcatcaccatgagcgaaacggcaagctggcaaccaagcgcatccatcgccaatttgttaaaacgcgccgctattttagcagaagtgcgtcgtttctttgccgatcgcggcgtgctggaagtggatacgccggcgatgagccaggccaccattaccgatatccatctggtgccattccagacgcgttttgtcgggcctggcgctgcgcaggggcgcgatctctggctgatgaccagcccggaatatcatatgaaacgcctgctggcggcgggcagtggcccgatctatcagatggcgcgcagcttccgcaacgaagaggcgggacgtcaccacaacccggaattcaccatgctggagtggtaccggccgcattacgatatgtaccgtctgatgaacgaagtcgacgatctgatgcagcaggtgctggagtgtgacagcgctgagtcgctctcctatcagcaggcgtttatccgtcatcttgagctggatccgctgtcagcggataaagcgcagttgcgtgaagcggcagagaaactgggtgaaggcgagctggcgcgtgcagaagaggatcgcgataccttactgatgctgctgtttatgctgggtgtggaaccaaagattggtcaggataaaccctgcttcgtttatcatttcccggccagccaggcagccctggcggagatcagcaccgaagatcaccgcgtggccgaacgctttgaggtctattacaaaggcattgagctggcgaacggtttccgtgaactgaccgacagccgtgagcagcgtcagcgttttgagcaggataaccgtcgccgtgcggcgcgcggcctgcctgtgcatcctattgatacatatctgctggatgcgctggcgcatggcatgccagcctgttccggggtcgcactgggaattgatcgcctgatcatgctggcgttgaaagcggagtcattgagtgatgtcatcgcgtttccggtggatcgctgctaatcggttaatcacaaacgatggcggattagaggggaagggttggcccggatgaagagcaaagcgtccgagccaggatggcgaggccgaccgccatggatggcggccttctttgcgatcagccgggccatccctgacctggcacaggtttcagctaactactgctgtcaggaaactcctgaatggtgaccggcagcgtcagtttctgatcgtttcgcagtacctgcacatcaatcactgaacccgggcgaatttctgccacctgatccatggtctcctgcgcggagatggccggcttgccattaacgctgagcagcacatcgttggcctgaatcccggctttatccgctggcccatctggtgtgaccacgctgacaataatgccctgaacccgatccagattgctcccctgtccatgcagcggcggcagctcacgcccggtaatgccgatatagccgcggatcacccgaccatcacgaatcagcttatccatgatcttcgaggctaaaacggttggaatggcgaaaccaatcccttccggggtttcaccatcactacttttatcgaaggtcagggtgttaatgcccatcagctcgcctagcgagttaatcagcgcgccgccggagttaccctgattgattgacgcatcggtctgcaggaagttctgtcggcctgatgagcttaagccaacccggcccgtggcgctgataatgccctgcgtgaccgtctgaccgaggttataggggttgccgatagccatcaccacatccccgatatgcgcctggcgatttggattgatggggataacgggcaggccggaggccgtgatcttcagtaccgccagatcggtcataccatcggaacccaccagcgtcgcttcaaagaagcggccatcctgcagcgccacgataatttgatcggcattattgatcacatgcttattggtaaggatgtagccttttgcattcatgatcacccctgaaacccagggtcgtgatgccacgattgttgttgccgtgggcgctacgattgtaaacgttcacaacggcaggcacggcgcggcgcaccccttgattgaagctaaagggcgtttcgtctgtaatattttcgtggttatagagggcgtcgctgcccatacgcagtgcaggcagtgctgcgagcaaaatacccgccacaatcaggcccagcaccacggcacgcaaaagtttaagaaacatggtgttaaattacgccaggggagatcgcaggggagaatagcatgagagcggcggacacacacgtgcttgtgtccgccgtaatgcgaggtttatctcaacaacagatagatactttcatcgccgcgcaccacattcagtgccagtaccggcggtttcccttccagtattttacgcatttcagcaatggtctgaacccggttgcggttaacgccgataatcacatcatctttctgcagaccaacctgttcagccggtgtgcctttttcgatggtatcgaccttcacgcctttatcaccggttttagtctgtccatcactcagggttgcgccctgaagcgcgggtgacatcagctgtgcgctggcggtgctctgtgcgctctgctccagcgtaacggtaaccgttaatggcttaccttcacgcagcaggccaagtttaacctgttcacctggcggcgtggttcccactttgacgcgcaactcagcgaagctggtaatcggcttgtcgttgatcgacgtaatgatatcgcctgacttcacgcccgctttctgcgcggcagattgcggtaagacttcagagacaaaggcgccgcgctgcgcatcgacattgaatgctttagccatatcggctgtcatttcagtgcctttgatgccgagctgaccgcgcttcacttcaccaaatttaatcagctgctgcgcgaggttcatcgccatatcactcgggatagcaaagccgataccgatgttaccgccgctggaggcgagaatcgcagtgttgataccgatcagttcgccgttaaggttgaccagcgcaccgcctgagttgccacggttgatcgcggcatcggtctgaataaagttttccagtccttccaggttcaggccgctgcggcccagtgcggagataataccggaggtggccgtctgtcccagcccgaacgggttaccgatcgccaccgcgaaatcacccactttcagctggtcagagtccgcgacttttacctgcgtgaggttttttgcgccctgaatctgaatcagcgcgatatcggtctgctcatcatggccaatcagtttggcttcatattcactgccgtcgccaagctgtacgttgattttatccgcaccgttgactacgtgattgttggtgagcacgtagcctttcgcggcatcgatgatcacgccagaaacctaaaccttcaaacggctgtggctgactatttccgccaggcatctgaccaaaaaaacgcttcagcggttcaggaatatcctgagcctgtgcacccgaatcagtgccttccacgtgcacactgaccacggcaggtaacactttctccagcatcggtgccagactcggcagcggctggcccgcaatttgtgctggcagcgttgccatcgcgtctggcgcggcggcaaggctcatcccaatactcagggctaatgcgctaaacaggcgtgcttgttttttcattgctacaacgctctcgctgcaaaaggtgggaggaattaataagtgtgacagtcgtttgcggtcagggttcgcaaaaacagcgggcgcagacaggctgcgccccaaaaagattagtcgcgggcagggcgctcgccacgcagtaaaccggatgcgccttcagaatagtcgcgcggcatctgcaccggcacctgatcgttgtccgcttcggcttcagtcagctgataggcaaacggatttttctggccaggcagattcggcagcaggtcatttgagccttttgccatgtgctgatagagctgacgataatcacgcgccatgttgtccagcagctccgcgctctgcgcgaagtggttggtcagctcttcgcgataatccgccagctccgctttcgatttttccagctcgtactgcatgctgcgctgctcacgcagctttttgttgccaaaacgcatggcgactgcgccgacaataataccaaccactaaaccaattagcccgtattcccaggtcataatgactcccgtgttatttccattgttccgtagggcattgcaccatttcaataatagtcactatacccgttaatcttatggatgtggaactctggagcagcatggcttagtgtagaacggcctttttttcagcaaccgtggtatgaatcagacaccattcagggactttgaaacaacaatgcaaacctcaactccgcttgcacgctatgaacaggcgctgtcgcagggcgaattcaggcccgatgacgtacaacgtgaagcgattacccgtttagacgcgctgcagcaggcgctggttgcccggcaacaatccgccgcgcctgccacatccggcctgctgggccgcctgtcaaaattgatcggtaaagagaaaaacgagacgccacaaccggtacgtggactctatatgtggggcggtgtcggtcgcggtaagacctgggtcatggatctcttttttcagtctattcctggcgatcgcaaactgcgtctgcacttccaccgctttatgctgcgggtgcatgaagagctgacgcagcttcaggggcagagcgatccgttactgattattgcggacagattcaaagcggaaacggacatcctctgttttgatgaattttttgtctccgatatcacagatgcgatgctgctgggcacgctgatggaagcgctgtttgaacgcggtattgcgctggtggccacctcgaacattccgcctgatgatctctatcgtaatggtctgcagcgcgcgcgcttcctgcctgccatcgagcagatcaaacgtcattgtgatgtgatgaatgtggatgccggtatcgactaccggttacgcacgctgacctccgcgcacctgtggaactctccgctgaacaaagagacgcacgctgaaatggcgcggatgtttaaagcgctgtcgggcagccagcctgaagatgcgccggtttctggaaattaatcaccgccagatgccgacgctgggcgtcagcgagggcgtgctggcgattaatttcaccaccctgtgtggcgaagggcgcagccagcatgactatattgcgctgtcgcgccgttttcacagtgtgctgctgtatgacgtgccggtaatgatctacaaaaccgaagatcaggcacggcgtttcctggcactggtcgatgagttctatgaacggcatgtgaagctggtggtcgcggcagaaacgtcactgaccgagatttatcagggcacgcggctgaagtttgaataccagcgctgtttatcccgacttcaggagatgcagagcgaagagtatctgcgtttaccgcacctgccgtgagaataatcgggataaataccgaaatagggttcgatttttgtaaccgacttctctataatcttgcgaccccacgttacagcaaaggatttttttcccaaatcctctgtgttccagtaactctatccgaaggggtggcttgctggtcaaaatggtcgtgtgagcctcattcgtttacttaagcgtttgggatttcaccaacgtgtaacttaatttgggtaagcttttcgatgaaaacttttacagctaaaccagaaaccgtccaacgtgactggtttgtagttgacgcaacgggcaaaactttgggtcgcctggcgactgaactggcgcgccgtctgcgtggtaagcataaagcggaatacactccgcacgttgatacgggtgattacatcatcgttctgaacgcagaaaaagttgctgtaaccggcaacaagcgtactgacaagatctactatcaccacactggccacatcggtggtatcaaacaggcgacctttgaagagatgattgctcgccgtcctgagcgtgtgattgagatcgcggttaaaggcatgctgccgaagggcccgctgggtcgtgctatgtaccgtaaactgaaagtttacgcaggcaacgagcacacccatgcggcacagcaaccgcaagttcttgacatttaatcgggattaaaggcaatggctgaaactcaaaactacggcactggtcgccgcaaaagctctaccgctcgcgtattcattaagccgggtagcggtaacatcgtaattaaccaacgttctctggaacagtacttcggtcgcgaaactgcccgcatggtagttcgtcagccgcttgagctgctggacctggttggtaaattcgatctctatgtcactgttaaaggtggcggtatttctggtcaggctggtgcgatccgtcacggtatcacccgcgctctgatggaatacgacgaatcactgcgtggcgagctgcgtaaagctggcttcgtaacgcgtgatgcgcgtcaggttgaacgtaagaaagtcggcctgcgtaaagcacgtcgtcgtcctcagtttctccaagcgttaattgtttgcagctccggctgcggcaattggctcaaaaaacccgcttcggcgggttttttattttctgccttcccataaactgtccgcgaaaaccgtaacgccgcgctcaatttacctgcaaagattcattccacgcccacaagcagcctaaaatctggtaaactctgtgtcactttgcgcccgcaggccggtgcgttatgcgcctccccactgtcggggcgtcagtatctgtgacgcagctaaccaggttgcgtgcgagttcgataagcaagtgagtcgccgtgtggttggctattcgcagtatctttttgtgaacaaacttggaggttttcatggctgtcgctgccaacaaacgttcggtaatgacgctgttttctggtcctactgacattttcagccatcaggtacgtatcgtcctggcggagaagggtgtcagcgtagagatcgagcaggtcgaaatggataacctgccgcaggatctgattgacctcaatccgtatcgcacggtaccgacgctggtagatcgtgagctgacgctgtatgaatcacgcatcatcatggaatatttagatgagcgcttcccgcatccgccactgatgccggtttatccggttgcccgtggtgatagccgcctgatgatgcaccgcatcgagcaggactggtatagcctgatgaggaaagtagagaacagcagcggtcaggaagcggaagcggcacgcaagcaactgcgtgaagagctgctggctatcgcgccactgtttggccgtacgccttatttcatgagcgaagagttcagcctggttgattgctatctggctccgctgttatggcgtctgccgtcaatgggtattgatttgatcggctcaggttcaaaagagctgaaaggttacatgaatcgcgtatttgagcgtgactccttcctcgcttcattaactgaagctgaacgtgaaatgcggctgcaagcccgggcttaacgtatggaaatgtcgcaacttactgcacgtcgtccctatctgctgcgcgccttttatgactggttgctcgacaaccagctgacgccgcatctggtggtcgacataaatctgccgggtgtgcaggtgccgctggagtatgcgcgcgatggtcagattgtcctgaacattgcgccacgtgctgtcggtaacctcgatctggcgaatgatcaggtgtcgttcaacgcccgctttggtggcgttcctcgccaggttaacgtgccgatggcggcgattctggcaatctatgcgcgtgaaaacggtgccgggacgatgtttgaaccggaaccggcttacgagctgggcacgcatgaggcgtcagagggtcaggaagagactatgatgtcggtgattgatggtgatcgtcctgacgatgccagcgatgacgatacaccgcctgatgacgatccaccgccacgtggtggacgaccttcactgcgcgtagtgaaatagcagtgacataacagcgaatacccgtccatccgacgggtatttttttgcctgtcagccataaaaaaaatccggctgcctgcgcaagccggattttttcagcagaccatcgcgatcaatagacgtcgcgcaggtagcgcttctctttcttcagctgatcgacatagtcagcagcgcgctcggtggagaggccaccaaactggcgaaccacttcatacagcgcattatccacatccttcgccatacgcgatgcatcgccacagacatagaagtaagccccttcctgcagccaggcatacaactcagcgccctgttcaagcatccggctctgcacgtagatcttcttctcctgatcgcgtgagaacgccagatccagacgcgtcagcaagccattatcgcgccaggcaagtaattcatcctgatagataaagtcatgttcctgatgctgatcgccgaagaacagccagtttttcccctgcgcaccggttgcctggcgctcctgcaggaaggcacggaatggcgcgataccggtacctggccccaccatgatcagcggtgcgctgttgttggcaggcacgcggaacgatttattgggtgagataaagatggcgggcttctcaccgcgacgcacacgctcggccagataggtcgagcagacgccaccgcgattacggccgccactgtgataacgcaccgaggcaacggtcagatgcacctggtcaggatgggctttagagctggatgaaatggagtaagcgcgatgctgcagcggacgcagtagcgcgacaaactcgggtaccgccagcgtgcgcgtcagctcaagctgcagcaggtcaagggtatctttaccccacagccacacgcccagcgcatctttatcatcatgctgtaacacatgacgcagctcctggttggtggtgttctgcccgacccattcgattaacttgcgtgacggctctgagatctcaaactgataggtcagcaggtcgccaaggctgcgatcaaagccgggcaccggcgtctcgtagtccgcgttaagctgggtcagcagcaggctgaccagcgacggctcgttgaccggaattacgcccagcgcatcgcccgcttcatacttcaggccgctgtcagacaggtcgaactcgaaatgacgaatatctttagctgagtgctcgcctgacaaacgcttgttggtgatcagcgcggcggcgtatggattggatttgttgctgcctggaatgactggcgcttcaggcgcgctttccagcacggtgccgctgctgcccgcgctggcggcaaactgtggcattgagctgtttagccactcgctggaaggctcctcaaaatcaatatcacaatcgatacgatcaaccacgcgtttcgcgcccaactgctcaaggcgcatatcaataaacttgcccgcctgacagaagccatcgtagccggtatcgccaatcgccagcacggcgaaatgcatctgctccagacgcggtgcggtactggcagagatcgcatcccagaacagctgcgcgttgtccggcatttcaccttcgccataggtcgaggtgacgatcagtacatggcgcatggtggcaaatacgtcgagatcgacatcgcccagcgcctgaaccactggcaccagacctttagcgcgggcagatttcgctgcggtctgcgccagtgcttcagcattgccggtctgtgagccataaagaatgtgcagttgcgtcgtcgcggctgcgcttgtgcccgcggcgggttgctgcttgtcttctaataccagcagacgggagtgcagacccgcaagaaagccagccagccagtacttctgatcgccattaaaaggtgcatcttctggaatataaggaattttcatgggtacttttactcaatcccgttctcgcccgtcatcagtggcattgtccggtgtgaaagcggttccgctttcccgcgccgcagcgtgtgcgacaggggagagcggtgctgcatctgtccggtacaacgattaatccgggcaatgatcaattaataatattcagttcagcctgatcagtatcactgtcaggagagtttacccaccgcagcggcgatttccggcaatgccgcacgtgcaaacagctcttcaaagtcaggcaggtggcccagcacttcccggttacaggcatcctgatacatgatccagccgtaggttgccagactgtccatggagcggatgttacgttgcgtcagcgccgctttgtaatctgacatgcgtttggtaccaatcagactcgccagttcatcatcgctgtagctctcgatggcggaacgggcatgacgctgcagcttgcttatcagcgaaaagtcttccgtcatcaacagattacggaccgctttttcaactgccgcatcttcaaccggggtgcctttcggtaatttgcccagcgccagctgctgggcaaagctcagcacggtgtagttgttgagcaggacaaacatctccagcgtatcggtcgcgccataagccggtacggcaccgttggcgatggttttaccctgacgccatgcggctttaaacttcgccacctgatggcctgccagcgccgtcgacagctcttcgagcagatctttgcggctcttggctttcagaatctcgccgccatcctgatagagcagcagcgagcgcggcatcacgtaaacaaagtggtgacactccgtttcccagttctccagcagccaggcggcacgcggtgatttggtcgcctccagatgccagttcagcatggtcagcaccgcctgcttgtgcacctgggccatctcatcctgatcggcaatcgagccgaactgtaccgaatcaccggcagcatggctggccagcgatccataggggtcgtactggtaggcgaagccgccgctcatgccgttgccaaatcctttaccgaaggtgcccaggttgaggatggcgccattggtcatatattcgcagcagaagtcaccgacgccttcaaccacggcggtggcaccggagttacgcaccgcgaaacggtcaccggcctggccctgcacgaacagacgtccgcctgtcgcgccaaacagcgcaaagttaccaatcagcacgttgccatcggcatcctgcgcgccgccaccaggcgacatcacgatcagttcgccgccacactgtcctttgccgacaccgtcgttacaggtgccgtaatgggtcagctgcatgccatcgttgcagaaggcgccaaacgactgaccggcagaaccggtggtggaaatttttacgctctcaggggccagatagcgacgaccgcgatcgtcagtcattacggcaggcatcgcctgcagctgctcagaactcagctgatggttcagcatccgctcaatatcgatggccagctggccgccgacacttttgtttcggttattcagcacgatgttgttgcccagagtgacgtcaggatttccctgatccaccagcgacagcttcagttgctcaatccagacatcatccagctcaaaatctttttccagataaaccggcttgtcgattttcagctcaggcaccacggtaagcatggcgcgtaagtcgagcttgcccacttccagcgggtgatccatcaggtgcaacaggtcagagcgaccgcgtgcctcacgcagggaacgcaggcccatacgcgccaggatttcacgcacttcatgcgccacgttgaggaaatactgcgccagctgacgtggatcgccatcaaacgcttcggcattcgtggttaagccagccgggcacttaacgttacagttcttcgccatcacgcatttcagcatcatcagcgccgtcgtaccgaactcaaagctgtcgccgcccagcagcgcagatttcaccacgtcgctgccggtctgctgtgcgccagagcagcgcagcagcactttctcacgcaggccgttggcgcacagcgcctggtggacttcagcgatgccgatttcagccacgcgtccggtatatttcaggctggtcaccgacgcagcgccggtaccgccggtgttacccgcaacgttaatcacgtctgcacccgctttggccacgccgaccgcgatggtgccgatcccttcagacgagaccagcttgacgataacccgcacccgcgcggctttgcagtcgtggatcaactgcgccagatcttcgatggaataggtgtcgtgatgcggcggcggtgagaccagctcgacgccaggcgtaccgccacgcgcggcagcaatctcgacggtaactttggccgccggtagctggccgccttcgccaggtttcgcaccctgaccaattttgatctccagctcttccagcatcggatctgccagataggcagcccagacgccaaaacgacccgaagccagctgtttgatgcgtgaggcacgaatggtgccgtgacgggagtaatgctcgccgccttcaccgcagttactcatgccgccgaccatattggtgccgtgcgcgaccgcttcatgagcgggagccaccagcgcaccgtggctcatcgccccggaggcaaaggtacgggtaatttcacaggctggctgcacttcgctcagcggcagtgagggcagggtggtgaagatacgtgacagataatcggccgctttaccgtaagcggtcactttcagaccgccagtcaccacttcgctgctttcgatatcgtcaccgaagcgggatttcagggcgcgagacaggttctgcaggcgttcgctctcaggcttcagtccttcaatcgcatcggtcagacgcagcataaagtgattcaggctgccatctaccgcttcacactccatgccacgaatggcaaagccattgttggtcagcgagtagcgtcccagcttgcggcggaactccgcttcgctgtcgatgtgggtcaggtcagccgggaatgtcaggatgtcgcgcagggccgccgggcgacgtttacgctcttcatacatcaggcttgagaactgacggtaatcagcagtaatcgcgaaattattaatcacctcatccgggatgcgctcaaagctgctgtctttaaaggtctctggcttgatgccaaacgcattatccagtttagccagcgtcatcaggcggatgaagttgtcctcttcgcgcgctttgtcggcaaagcgaatcggctcttcggtcatatcgataaaggtccgcacggcgatggtgccgtaggagtgacctgcgccttctgcacgctctttgaacaggcccagcaacggaacttcagattcgccctgaatcttcagtgcactctggtgccagtcaacggccatctgcgcgatcgtcgcgaagcctgcgccgcccaccggcgttttgatattcgggaaatactttttcagcaccggatcatcggtgttgaggaagttaggctcaaagaactcgccgctgctgtagctctcaacggtacagaggcccactttgcccatggttttcatcagtgctttttcagccgctttggcatagcgcttaaaggctttgttaccttcttcaccttcaccaaatttctcctctgcgcgcatctgtacgcccagcggatagatagctgacgccccaaagccaagtgtggcggcaatgtggtgcgacgagatgctctggccgctttcaaccaccagagaaacatccagacgcaacccttcctttatcaggcgctggttgatggcggaaaccaccagcagcatcgggatcgcggcgtgctttgaagagatatggcgatcggtaagtacggcgatgccaccctgggtacgggcaaaatcaaccacctgttgcgccaggtcatcaatcgccttttccagggcattcgcgttcgcggtggtgctcagcagatctttgccgatcaccggctcatagagcatctcaaagcgggcataaggtgcgatggtctgctcgcgtaaacgcagcatatcgaggtggctgagaatcggggtcggcaccacaatctgacggcctttgctgcggcccagatggggttttgcccccagcgcgacacgcaacgtcatgccatccacttcgcggattgagtccagcggcgggttggtgacctgcgcaaagcgctgagagaagtagtgcgccataccgccttcatgatcggataagccgttgatggcgttgccgtaacccatcgcggagatcttctctgcgccggtattcagcatcggatccatcatgaacttgaagctttcctggttgtagtagtaggcaacaaagcgctgatacgttttcagatcgccacgataacgcagcggtgaaccctgttgttctgccgggatctcgggcagatcgtcaagaccgacgcgcgcttcacgcagcaacgccgaataatctttctctgcggccagtttttccagcgcctgcagcgtggtatagctgcgtttttcacggtgatcgaaatagagcataccgcccgcttcgatacggccacgacgcaacacgctttcaggtgggaaggcgatctggcccgcttccgacatcgcaccgatatagtcagcggtttctactgaacgcagtggacgcagacccagacgatcaagacgggcgccaatcacttcgccattaccaaagattaaggcagcagggccgtcgttcttctcttcatacagcgagaagtactccagcatgtcacgcacttctggcgacagcgcgctgtcgttttcccaggcgggcggcatcattgacaccacggcggtgatcagatcgaggtcatcttccatcagacggctgtggatgctctgatccaggcgcgaactgtcggactggcctttaggccgcacgatggtcttgccacgggccagtgccagcgcggactcagcgatgcggtttttacggtcagtgttcagctcgccgttgtgcgccatcaggcggaaacggctgcgccatcgtggtatggggatcggtgttagtggagaagcgggtgtggaaaaacaacccgcgcacctgatgatcgggatcggtcagatctttgaagtaagggatcacttcattggaattcagacgggctttgaacacctgcgtgcgtgaagacagcgacagcggatagagaccgccaaattcgctttcggtgaaagctcgggcttcaatggttaacagggcgcggtagatgcgtttttcgaagtcgttctgatccaccacatcctgtggcgcagtgaaaatccactgcagaatcggtaactggaactgcgcggctgccgggcgcgtcacgctgctgtcgagcggcatgtcacgcttcataagtaccggcagaccaaagctgctgagggtttcatccaccagacgttcggcattcgcgcgcagctcagcatctttcggcacaaagaagttaccgacaccaaagcgtcccgcttccagcggctggccggtaattttgcggaagaattgcagcgaaagatcaacgttgacccccgcgccgtcgccaacgccttccgctgacatgccgccgcggtgaggcaccgtacacagggcgctgtgcgccatctgcagaatctcgtgggtctgctcgccgtccttacgcgtaatgaaacctacaccacagctgtcactgcctgctgtcggatcatacaagccataggattgaggttttttagtggacattgagggtctccttaaactgctttgacattacctgcactgtttcagggtctgagcgcaacgggggcgctatcattttcatcgccatgctctgtcgagcgcgcgtcatagccctgagcatttctctccagacatcggtaaaacgtccttaattgagctgctctctgatttccggtctcttaaaggagatgacttaaaccacgcgggagtcttcttgttgcatagatatgccgagacaatggcccgtctggaaagctttcagcggatttccaacttatcgggaaagcgtaatcaggtcaaatagggcggtcagacgggattatcatgcgttttatctgcttaagtctatgaattaaatgctttttaaggtttaaaatgtatcactctggtgcctggcgacaggccgataaatgtgaactgactcactgtagtgcaggcgtcagatctctgcaccatgctggtgacagggtgttaagcagcattaaatgctgttcagcacccatgatgcatagcatgtatctgtttttcttatgtccggttatttgaatgaaaccgcggttggttataagaaaaattaatcagcatgggcatgcttaaaacagcattaaagatgaatggctatgcatataaaagggtgtgcctgtgcaacaggacgctgccaggatattgaaaaaaggccgtacagagaaatcggttattcgctggcggccttacagattattcatttggcacagtcagtcaagggttttaaccgctttgtccttaacgtcgccgatcggcgaggctgctgcaccataaaagcgcatttgatcccttatctccacgcgacgtgctgcgacggcagcgggttaactgcgctattatgaggctgtttctcttccagggagttgttatgaaacaaattcgtctgttggcgcagtactacgttgatttaatggtgaagcttggactggtgaggttctcgctgctgctggcgtctgcgctggtggtgctggcgatgattgtccagatggcggtcacgatggtactgcggggccatgtcgagagcattgacgtggtgcgttcggtcttcttcgggctgctgatcacgccctgggcggtctattttctctcggtggtggtcgatcagctggaggagtcacggcaacgactggcacggctggtggataagctggaagagatgcgtacccgcgatctggaactcaatcagcagatgaaagagaccattacgcagctgaatcaggagatcagcgatcgtaaaaaggcggagctggcacgcgaacaggtgatggataagctgcgtgaagaggtaacgcgtcgtgagcaggcacagattgagctggaacagcaatcctccttcctgcgctccttcctggatgcctcgcctgacctggtgttctatcgcaacatcgataaacagttttctccggctgcaaccgtgcaatggagctgctgaccggcaaaagcgaaaagcagctgattggcctgacgccgcgcgatatctatgatgatgaagcggccactaaggtgctggaaacggacgagaaggtattccgccacaacgtctcgctgacctatgaacagtggttgcaatatcccgacggacgcaaagcctgcttcgagatccgtaaagtgccttactacgaccgtgtgggtaagcgcagcggattgatgggctttggccgcgatataaccgaacgtaagcgctatcaggacgcgttagagaacgccagccgggagaagaccacctttatctctacgatcagccacgagcttcgtacgccgcttaatggcattgtcggcctgagccgcatcctgctggacaccgaccttaatcaggaacagctgaaatatctcaaaaccatccacgtctccgccatcacgctgggcaatatcttcaatgatgtgattgaggtggacaaaatcgagcgccgtaaagtacagctggataatcagccgctcgacttcaccggtttcctggccgatttagaaaacctctctggcctgctggcacagccgaaagggctgaagtttgtgctcgcgccgcaactgccgctgccgcatatgatctcgaccgatggaacgcgtctgcgccagattctgtggaacctgattggtaacgccgtgaagttcacccagcagggcgagatcgtggtgcgggtaacctatgagcaggacgagacgctgcgctttgaggtgcaggactccggcatgggtatccgtcaggaggagcaggacaagatcttcgctatgtattatcaggtcaaagatcagcatggcggtaaaccggctaccggtaccggcatcgggctggcggtatcacgccgcctggcgcaggcgatgggcggtgatatccgggtgcacagtgcgccgggacagggttcctgcttcaccgtagagattaaagcgccacgcattgctgaagaggtggaggatgaaggcgtggacgacagcctgccactgcctgcgctgcacgtgctgctggttgaagatattgagctcaatgtgattgtcgcgcgctcggtactggagaagctgggctgcagtgtagaggtcgccatgaccggcagcgaggcgctggcgatgtttgacccgctggagtttgacctggtgctgctggacattcaactgcccgatatgaccgggctggatgtctcacgtgcgattcgccagcagtaccagggaacgcatctgcccccgctggttgctcttaccgccaatgtcctcaaagacaaaaaagagtacttcgacgcgggaatggatgacgtgctcagcaaaccgctggcagtgccggcactcactgcgatgattaaaaagtactgggattatcaggcagaaccggaagaggagatcgctgatgtcagcgatgacaaaacccggatgctgctggatgtcgcgatgctcgaacagtatatcgagctggttggtcccagcctgattacccaaagcctgacgatgtttgaaaagatgatgccggactaccttgcggtgctggagtcgaatcttatggcgcgcgatcagaaaggcattgctgaagagggacacaaaatcaaaggggcggcgggtttcggtcgggctgcagcgtttgcagatgctggcgaaacagattcagagtccggagttaccggcgtggtgggacaatgtaggtgaatggattgatgagctgaagcatgaatggcgacacgatgtgcaggtattacgcgactgggtggcagagcaggataagtgataccccggaaaaaaatgaccccagccgaggccggggtgcgcgaaatactgcgccaacaccagggaaatcattgcggccgctatgatttgaataattaatgcagccgcagggtattggttaacactgtcatcaccttagcaaattcatcttctcatgcgacaagattcattaaaatttgtgatattgagcagcgtttaaatacagaaaacattaatttggcaacacagtcaagtaaggaattaatttctgtgctgtgttgctgctattttaatcagttttacgctttttcgtgtagttttaatgctgccgggcagggaaactgaggctgagcagcaccaaagtgagccgccgttaacatttgccttttgagtgaggctaacgcgctgatattgcaagcgcgctgcctgaaatgacacgaattatccaaaacgatttggaatgataaaaaagaatctaaaagtttgtccttctgtcgttctgctatcagggttattcctggaaggaaatagtgccattctggcaacccgtgacgctattaagcgctgcttatttatccgttataacgataattctgattaacctttaggcgcggcaggattaagaaaacaataacagttaagcatgataaatgattcatgcgggcgcttattactcatgattaagtgtttatctggaaagatgctaagcaatggcaatgaatggaaccgattccttttttgcggaagtacttgaactatttcgaactgttgcagcatgttgatgcaaaatgattgaataaagtctggaaacagcctgtcagttttcagcgataatcgtaaaaaggctgcttttttagcagtgattacatgagtgattgattaacgtctgaaacaagtgtgggaagattgcatgaacaagcataaaggaagcgtcggacagcgtatcagacgtattgttggtcgtatcgtactggtgtggctgggaatatggctggcgggcattttactcttttcgttcttacccgtgccgttctcagcggtgatggctgaacgacagatcggagcctggttacgcggtgattttagttatgtcgcccattcagactgggtcggccatgacgagatttcgccctggatggggctggccgttatcgcctcagaagatcaaaagtttcccacccattggggctttgatgtggcagcgattgagtccgtactggataacagcgatagccggatgcgtggggcgtccacgctgtctcaacagacggcgaagaatctgttcctctgggatggtcgcagctgggtgcgtaaaggtctggaagcgggtctgacggtaggaattgaaacggtctggacgaagcggcgtattttaaccgtctatctcaatattgcggagttcgggccgggcatctttggcgttgaggcggcttctcagcgttatttccataagcctgccagccggctgaccgcagcagatgctgccttactggcagcggtgctgcctaatccgatacgttatcgtgctgcagcaccctcaggctacgtcagagagcggcagcagtggatactgcgtcagatgcgccagcttggcggggaaggcttcctgcagcgtaatcagctcgactaagcattaatcttcatcgaaacccgcttcaaataactcaatgaccgctgccagcgccgggatctcctccgggccgctggcttcaatctcaatgtggccgccttttgccgagtcgagcatcagcagcgcaatcacgctgctggcttcggcttcagtgcccgcttcattacgcagtaatacttcggcatcaaagctctgcaccagctcaaataacttcatcgccggacgtgcatgcatgcccagcttatttttgatttctacagtttgtctgacggtcatgatttgcgcttttccagcgtacgatggcgtgactgcacattcttaccccgtgaacggaagtaatctgccagctgttctgcaatatagactgagcggtgtttaccgccggtgcagccaatcgccacggtaagatagctacggttattggtctccagcatcggcagccagagttcaaggtagctgcgcgtctggtagataaaattatgcacttcagtgtggcgatcaaggaaggccgccacaggacgatcgaggccggtcatcgggcgcagtttgggatcccagtgggggttgggcagaaagcgcacgtcaaatacatagtcagcgtcaatcggaatgccatgcttgaagccaaacgactcaaacaccatggtcagctcacgttcacgcttgcccagcaggcgggtacgcagcatctctgccagctcatgcaccgacatctctgaggtgtcgatgatcagatcggcacgtgaacgaagtggctccagcagatcgctctcttcatcaatcgcgctctccagcgagaggtttttgctggagaggggatgcagacggcgcgtatcgctgtaacgacgaatcagggtgttgcgatcggcgtcgagaaacagcagctgaggggaaaatgtatcaggcagattattcagtgcggtttcaaaaatttccggggattcgggcatattacgcacgtcgatgctgaccgccgccgaaatattgcgctcagccagcgagttagctaactcaggcagcagcacgaccggcaggttatcaacgcagtagaaccccatatcttccagcgcacggagcgccactgacttccccgagcctgaacgaccgctaacgatcatcagcaccatgaccttctctcccgttttaaaaccggcaccgggccggtaaagacgcgttactgctccgactggacttccgtaataatggcatagagctcttcatcactctgcgctgcgcgcagacgacggcaaaccgttttatctgccagacgctttgccaccagtgacagggtgtgcagatgtgttttgcactggtcagccgggaccagtaaggcaaacaacagatcgaccggctggttgtcgacggcatcaaacgcaatcggctgttcgaggctgataaacaccccaaccgcgcgcagcgtatcctcttccagcttgccgtgcgggatggctatcccgttaccaataccggtactgcccatgcgtttcgcgggtcaggatcgcttcgaaaagcgtctggtgcggcaggttgagctgcttagcggccagttcgctgatgatttccagcgcacgttttttgctctggcagtggacgccgctgcgggtgcagtctggcgaaagcactgtgctcaattccagtgtgagatcgttgttcattatcgtttcacttgcgtgttcaccaggccattcaccgccagcgcgtattgacgcgtgtgacaaacggcgcctgctcagatgacaaaacggggcggattatccgccccatcctgtcggctctgcgcgccaggcgcgcgtcgctagcgtgaaggttagtgttttttcagtttatctttgtgtttggtcagctgacgggtgagcttatcgatcagtccgtcaatggccgcatacatatcttccgcttcggatgtggcgtgcagctcgccaccattcacgtgtagtgttgcgtcagccacctgcgtgactttctcaaccttcaggacaatatagacctgattgatatgttcaaaatagtgttccagtttggcaaatttaccgttgacgaattcacgcagaggtggagtgatttcaacgtgttgcccggtcaggttcagctgcataggtcttccttctcatttctttcaaaccagttgtttacgctggttcgatggcgggatggataaagactcacgatatttggcgacggtacgccgtgccaccatgatcccctgatcagataacatggaggtcagtttactgtcgctcaagggtttggctggattttccgccgaaattaattttttcaccagggcacgaatcgcggtagaggaggcttcaccgccaccttccgtattaacgtgactggagaaaaagtacttcagttcaaaaatgccacgcgggctgtgcagatacttctgcgtggtaacgcgggagatggtcgattcgtgcatctcaacggcctgggcgatatccgccagcaccatcgggcgcataaattcttcaccctgctcgaaaaaggcctgctgttgctcaacaatacagcgcgtcactttcagcagggtatcattgcggctttccaggctcttaatcagccagcgggcttcctgcagattactgcgaatgaactggctgtcgctgtcgttccgcgtcgcgccgctcattgccgcatagtgctgattgatcttcagacgtggcacgctatcggcattgagttcaaccgtccagcggctgccgatcttacgcaccagcacatcgggaatgacatattctggttcgccggtgttgatcgactgacccggacgcgggtccagcgactgaatcagcagcatcgcctctttcagcacctcttctttgaggcgtgtgacccgcatcaggctgcggaagtcgtggtttgccagcagatcgagatgttcgctgacgatcagacgcgcctctgccagcatcggcgtttcgggcgcatattgtgaaagctgcaccagcaggcagtcacgcaggtcgcgcgcgccaacaccaatcgggtcaaagcgctggatgcgtttcagcaccgcttcaacttcatccgcttcgagctcatcatcgccgatgctgtcaaggatctcctcaagcgaaacggtgagatacccggtgtcatcaatagcatcgacaatagaggtggcaatggcgcgatcggtatcgctgaacggcgtcaggccgacctgccacatcagataatcctgcagcgactgggttgtttcgccctgataaaccggtaactcatcatcctggtaatcggtgccggtgccggaaggcgtacccgcggtgtagatctcatcccaggtcgcatccagcggcagttcatcaggcatctctttctgctcaagcgcttcgcgtgtatccagcgcctcggcctctgaagactcccgtgaatcgatctcttcatgcaggtcagtctgctcaagcagcggattactttccagcgcaagctgaagctcctgctggagttcaagcgtagagagttgcagcaggcgaatcgcctgttgcaattgcggagtcattgccagctgttggctgaacctgagttgtaaaccttgcttcatagacaggatgatcgttcccaggtaaacatcggtattaacgacaccttatcagagtctgaactcttcacccaaataaacccgcttaacctgctcatccgcaagaatttcattcggtgtgccgtgtgcgatcaggtgcccctggctgacgatataagcccgctcacagaccgctaacgtttcgcgtacgttatggtcggtaatcagcacaccgaggccgctgtcacgcagatgctcaatgatcttcttaatgtcgataacggagatggggtcaacaccggcaaaaggttcatccagcaggataaatttaggattagccgccagcgcccgcgcaatctcaacacgacgtcgctcaccacccgaaagtgcctggcccatgctgtcgcgcaggtgctcaatgtgaaactcttccatcagctcacgggcacgatcctggcgttgctcttcggtcagatcgtcacggatctgcaagaccgccatcaggttatcgtagacgctgaggcgacggaagatcgatgcctcctgcggcagatagccgatgccacgacgcgcacgggcatgcagcggcaggatgctgatatcttcatcatcaataataatgcggccagcgtcacgcggcacaatgcccactaccatgtaaaaggtggtggttttaccggcaccgttcgggcccagcaggccgacaatctcgccggattttacctgcaggctgacatcttctaccacgcgacggcctttatatgccttcgccaggttttctgcgattaatgtggccatagctatcagttactcttctttccgctgttggacgaacctttgtcctgaagttgcgacggcaccagtacagtcgtgacgcgcttgttctggccctgactgaaagcctgcattttctgctctttcaccaggtaggtaatacgatcgcctttgatgttgctgtcctgctgctcaatgaacgcattgccggtcagttcaacgaaatcgttagccagttcatagtgcagttttgcggcatggccctgcaccggcttaccgctgtcctgcatctgatagaaggtggcgggattaccgtaggcgtcaacgatggttttcttgctgtcgccgcccggacgggtcaccacgactttatctgccgtgattttaattgagccctgcgtcacgatgacattgccggtaaaggtcgcgacattgccttgcaaatccagcgcctgattctgcgagtcaatattgacgggcttgtccgagtcaccggtcagagccagcgccggaacgctggttgccagcagcatgctggccagtaaaagcttcaggctatttttgttcattttgaatttcataagaggttttgaccttctcgattaactcggcgttttttgtccgtaaattgccgcgcattttcatgccggtggagttaaaactgcggccatacaatgtcacctggtcatcagaggtaacgtcctgagtgacaagattaatctgggcgttatcggttttgatccgctcaagctgagaatcctgcgtcagcgtattcagctcaacatggccatacaggtaaagcatacgatctttggtgagctttgctttatccgcgcgtaacgtccaggtagggattttgttctcatcaaaggtggtcatgaccggattgtcgaaccagctcagttcatcatccgagaaataggtcactttgtcagagaccagtttatatgacagcgcgccctgcgggttataaaccacagtgtgtgaatcagcactggtgtaggtcggtgactgactgtccgtgccgactggcgtgccatcgtcatcctggttagtaagattccagccgatcaaaaccagtgcaatcaaggtcagaatcagcgttatccaacgcctgcttttactcatactgattgccctttggcatcctcaaatttgttctgcgccattaagatcaggtcacatacttcgcgaactgcaccgcgtccaccggcaatccgcgtgacataatgcgcgcgcggcaacaggatcggatgtgcatccgccaccgccacgcttaatcccacttttgccataaccggccagtcgatcagatcgtcaccgatgtaggcgacctggtcgtcggaaagagacagtttatccagaagttcacgataggccaaaagcttatccgattgtccctgataaagatgacggatgccgagcgttttgcagcgatcttccatcaggcgcgcattgcggccggtaataatagccacttccacatcggaggtcagcaaacagcgaacgccgtaaccgtcccgcacgttgaatgccttcagctcttcgccattattccccatgtagatcactccgtcggacatcacgccatcgacatcgcagatcagcagacgaatcctgctggcgcgcgccataacgtcagcgctgaccgggccgtagcaggtttcaatcgggtgggttgcctgttgcattttctcttcctgttcagactacgccagcgcgcagcatgtcatgcatatgtaccacaccgagcagatggtcgtcatcggccaccagaatcgaggtaatgtttttggtctgcatcaggttcagggcttccaccgccagcatattaggccggacgcggatgccacctggcgtcatcacttccccgatagtggcgcgctggaaatcgatgcccatatcaaagatgcggcgcaggtcaccatcggtaaagataccttcaattttcatcaggtcgtcgacgatcaccgtcagccccagatttttgcgggtaatctccagcagcgcatcgcgcagcgaggcgtcccgtgtgacgtgcggcagctcatcgccactgtgcatgatatcagccacatgcagcagcagtttacggcccagcgcaccgccaggatgggacaaagcaaagtcttcggcggtgaagccgcgcgcttccagcagcgaaaccgccagcgcgtcacccatcaccagcgtggccgtggtgctggtggtcggtgccagacccagcgggcaggcttcctgcggaacatggacacacagatgcacatcggcaacccggcccatcgcactgtcaggccgtccggtcatgcagatcagcgtaatgtgctgacgctttaaaaccggaatcagcgcgaggatttcgttcgactcaccgctgttggagatggcgatgaccacatcatttttgctcaccatgcccagatcgccatggctggcttcggccggatgaacaaaaaaagcgggcgtgccggtactggcaaaggtcgccgccatttttttgccgatatggccagacttgcccatgcccatcaccaccactttaccctgacaggcgtagatcagggcgcaggcgcgggcgaaatcgtcgttaatatattgatcgagttgttccagaccttcgcgctcaatgcgcagtacggttttccccgcctgctggaaatcaaatgctgttggttgctgatatgacatagtgagtctgtccttgttagccgtccatgaatgccggctgcatccacagcagcgtcacccagacgaagaaaccacagagtaaaaataagcctgccgttcggccaacgcggcggcgacgtagcaggcagagcagggcaaacagcacgctgactcccagcatcacccagtaatcacgggcgaaggcgtgataatcgacactgccagggtgaatcagcgccggcagacccagcacaatggcaatattataaatgttggcgccgatcagattaccgatcgcgatatcatcttcgcctttcagcgcaccggcaataaccgttgccagctcgggcaggctggtgcccacggcgatcagcgtcaggcccatcaccagctcgctgacgccaaaatagtcggcaaacgccgtggcattgtcgatcaccattcgtgtcgacatcggcaggataatcagcgcgacggccagccagagaaaggccaccgtatttccgctctcttcgcgtggcagctcggccagctgctcgcgggtcagggtgtcgttgttatcccgtttctgctttacgcgcaatgcgaattaccaccatcagataaatcgcggcaatggcgatcaggcctattccatccagtcgactaagctgattgtcaaacagcatgaaaccgctgagcagggtaaccagcaacattaacggcagttcacggcgtatcagattagaatggacgctgagcgggtgcataagcgcagcggcacccaggatgagtaaaatattggtaatattcgagccgagcgcggtgccaacagcaagatccatctggccatgctgcgcggcggaaaaggagaggatcatctctggcagcgaggtgccgatgctgacaacggtcatgccaataatcagtggcgggatgccaaatgatcgacacagtatagaggcgctaaacaccagacgatcggcaccatatgccagtaaaagcaaaccgataatcagcagtgcagaagctacgaacatgaaaaatccttgcgtaaaaacccaggccggcaatgcctttcccgaccggtttaaggttctgtttggcgagacaggcgctgattttgaccgtccggacggcaaaagtaaatttaatgaccattttcgccaaatcttagcggtaagtttctgtaaagctatcgtgaatcaggaccgaacaggctaccatcgtaccccatgtttacgcccgatccttacaagaggttataatgatccagcagcaatcgaatctggttgaggttcgtggcgtgagtttttcgcgcggagatcgcaccatcttcgatgacatttcgctgaccgtgccaaaaggcaaagtgacggcgataatggggccgtcggggataggaaaaaccacgctgctacgcttgattggggggcaacttcagccgaccagcggtgaaatctttttccgtggtgaaaacattccgtcactgtctcgcactaaattgtacgaagcgcgcaaaaaaatgagcatgctgttccagtctggcgcgctgtttactgacctgacggtctatgaaaatgttgcctggccgctgcgtgaacatacccgtctgcctcctccgctgctgcacagcacagtgctgatgaagctggaagcggtgggtctgcgtggcgcggcccagctgaagcccgcggagctgtcgggcggaatggcgcgtcgtgtggcactggcgcgcgctatcgcgctggagccggaactgatcatgtttgatgagcctttcgtcggtcaggatccgatcacgatgggtgtgctggtaaaactcattgatgaactgaaccatgctctgggcctgacctgtattgtggtctcgcacgacgtaccggaagtactgagtattgcggactatgcctatatcgtggccggacaaaaaattatcgcacacggcaccacgccggagttgcgagcgaacaatgacccgcgcgttcgtcagtttattgatggcgatgcggatggtccggtttcccttccgttttcctgccggcgactatctcgctgatttaaccggctcagggagtaactaaactgatggtgttgaaggcgctggcgacatttggacgtcagggaattgaaacgtgcgccagttttggacgcgcaggactcatgctctttcatgcgctggtgggcaagccagcgttccgcagacacacgccgctactgattaaacaactttatagcgtcggcgtgctgtcgctgctgatcatcgtggtttccggtctgtttatcggcatggtgcttggccttcagggttatctggtcttaaacacctatggcgcggaaaccagcctcggtatgctggtggcgctgtcattgctgcgcgaactggggccggttgtgaccgcgctgctgttcgccggacgggcagggtctgcgctgaccgccgaaatcggcctgatgaaggccaccgaacagctctccagtatggagatgatggcggttgacccgttgcgccgggtggtctcgccgcgcttctgggccggttttatcagtatgccgttactgacgctgatttttaccgcggtagggattgccggtggggcgctggtcggggtgagctggaaagggattgatcccggtttcttctggtcggcgatgcagaatgccgtcgattttcgtgccgatgtggttaactgcctgattaaaagtgcggtatttgccattaccgtgacgtggattgcgctgtttaacggctatgatgcgattccaacctctgaagggatcagtcgcgcgacgacgcgcactgtggtgcacgcgtcactggcggtgctcggattggattttgtgctgacagcactgatgtttgggaattgatgcaatgcaaagcaaaaaaagcgaaatctgggttggcatatttatgattatggcgttgctggcggcgctgtttctcgcgctgcgcgtcgccgatttaaagtcaatgggcaccgagccgacgtggaagctctacgccacctttgacaatattggtggtctcaaagccagttcgccggtcaagattggcggggtagtgattggccgggtgaccgacattgagttagagccgaaaacgctgctgccgcgtgtcaccatggacatcagcgatcagtatgcgaataaaatttcagacaccagctcgctggcggttcgcactcagggactgctgggtgagcaattcctggcactcaatttaggatttgacgatcctgaactgggttcggcgatgctgaaagatggcgatacgctgcgcgatacgaaatccgccatggtgctcgaagacctgatcggtcagttcctttataagagcggcgataataaacaaaacagtgaaaacaaggatgcgcaggaaggcgacagtgctgcgcctgcggcaccggctcaaccttaaagaagagggtataccatgtttaaacgtttactgatgattgccatgctggtggttgcggtaccgctgacggcaaccgcagccgatcagagcaacccctacaaactgatgaatgaagcggcgcaaaagacgttcacccgtctgaaaaacgagcagccgaaaatcaagcaggaccctaactacctgcgtcagattgtgcgtcaggagctgctgccttatgtgcagatcaaatatgcgggcgcgttagtgctgggccgctactatcgtgattcgacgcccgctcagcgtgaagcctacttcagcgcctttggtgactatctggcgcaggcttatggtcaggcactggcactgtacaacggacagagctaccagattcaacctgagcagccgttaggcgatgcccagattgtcgctattcgcgtttccattatcgacccaaatggtcgtccaccggttcgcctcgacttccagtggcgtaaaaacagccagagcggtaactggcaggcgtatgacatgatcgctgaaggcgtcagcatgatcaccaccaaacaaaatgagtggagcgatctgttacgtaccaaaggtatcgatggtctgacggcgcagctgaaatcttctgcggcacagccaatcacgctggataaacaacaataatgcacgaatcgttacgctgggaaacgggaagccagcacgctattactgaaaggcgaactggatcgcgacacgttgatgagcctgtggcagcaacgtgaaacgctgattaaagatgttgataccatcgacgtcgcggcgctggagcgtgtggactcttccgggcttgccctgctggtgcacctgcgggaaatcgcgcgagcacagggtattacccctcgctttacgggcatcagcgacaaactgcattcgctgattacgctttacaatctgcaacagattattgtttctgcggataaaagcgcctgatatccggttgttatgctaagcccctgttttcaacaggggcttttgcgtatttaagagtcagccgctttcctctactatgtcagccttattattattaagtgaagttaagcccaatggaaaacagtgaaattcaggccgtgctgatggcagcattgcctttagacgaagtgcatgtgatgagcaatgatggcagccattttcaggtgatcgccgtaggcgaactgtttggcgaactgagccgcgtgaaaaagcagcaggctgtctacgcgccgctgatggaatttatcgcggataaccgcattcatgctgtctctatcaaaacctatactcccgctgaatgggcgcgtgaccgtaaactcaacggtttctgatccccagcgtggtgaactcgtcgctggcgagtccaatctttagctagttaattgagagccgtgttaatggacaaatttcgtgtgcaaggccccacccgcttaagtggtgaagtaaccatttccggggcaaagaacgccgcgcttcctattctgtttgctgcgctgctggctgaagagccggtcgagatccagaatgtgccaaagctgcgcgacattgataccacaatgaagctgctgagccagctgggtgcgaaggtggaacgcaacggttctgtgcatgtcgatgccagcgcggtagatgtattttgtgcgccttacgatctggtcaaaaccatgcgtgcctcaatctgggcgctgggcccgctggtggcgcgttttggtcagggtcaggtttccctgccgggtggctgcgctatcggcgcgcgtccggttgatctgcacattaccggtcttgaacagctgggtgccgagatcaagctggaagagggctacgtgaaagcgtcagtcaatggccgcctgaagggcgcactgattgtcatggacaaaatcagcgtcggcgcgaccgtgaccatcatgagtgctgcgacgctggcgaccggtaccaccgtgattgagaatgcggcgcgtgagccggaaattgtcgataccgccaacttccttaacaccctgggcgccagaatcagtggtgcaggcagcgataaaatcaccatcgaaggcgtagagcgtctgggtggcggtgtttatcgtgtcctgccggatcgtatcgaaaccggtaccttcctggtggctgcggccatttcgggtggcaaagtgatgtgtcacaaaacccagccggatacgctggatgctgtgctggccaagctgcgtgatgcgggtgccgatatcgaaaccggtgaagactggatcagtctggatatgcacggcaagcggccaaaagcggtcaacgtgcgcactgcaccgcatccaggtttcccgaccgatatgcaggcgcagttcacactgttaaacatggtcgcggaaggcacgggcgtaattaccgaaaccatcttcgaaaaccgtttcatgcatatcccggaactgattcgtatgggcggacatgctgagattgagagcaacacggcgatctgtcatggggttgaaaccctgtcaggtgcgcaggtgatggcgaccgatttgcgtgcgtctgccagcctggtttctggccggttgtattgcggaaggaacgacgtttgttgatcgcatttatcacatcgatcgtggctatgagcacatcgaagataagctgaaagccatgggcgcaaacatcgagcgcgtcagcgaagaataatcccgcagatgctctgaaagagccagccccctttgggggctggttttttttcgcctgaggatcgcctgagttttcaggcggtatcggaatgatcgacaggcgcccggatacgttttctgcgatccagcaggcagtgggtctcgggatcgtaatagcggctgggccagatctcacaaggatgaaccttgatcgcgtcagcgatcaaccattcgcccttgggccatggacgcgtgagcgcattagccagcgttgatgaactgagacctgctgcgcgtgatagcgccgcgagtgtcattccacgcttatgcagcgccgcgataatgtcagccgggtgccagtcttccatccttttttgcatatcctgttctccttttccctgtcattgcgtcgtccagcaggacgtgagctttcctttttaccgttatctggaaagattgaggtttttatagcaaatagttcccattagtttccagtaatatttggattcagcatctgatctgtggggtggcatgcaaaaggagtgcaacagctaagagataacaaaaagaagtgagagcagggacgtaaaacggagcctgtcaggctccgtgagggatcagaaatcgcgctgaactgacatgtgcgccagcgactccagcgcactgcgccacggcgattcgggcagaatacgcaaggcgtcaatggctttatccgcttcctgttcggcgcggctgcgcgtccattcgagtgaaccacactgattcatcgcttccagtaccggttccagcagatggcggccatttccctgctcaatggcttcacggatcatcttcgcctgctcaggtgagccgtgctgcatagcatgcagcagtggcagcgtgggtttgccttcactcagatcatcgccggtatttttgcccagcgtctcgccgtcagcactgtaatccagtaagtcgtcaattaactggaaagcggtgcccagatagcgcccataatcctgtagcgctttttcctcttcaggtgtggcttcagccagtatcgccgaggcctgcgaggccgcttcaaacaggcgcgcggtcttgctgtaaatcacgcgcatgtagctctcttcggtgatgtcgggatcgttgacgttcatcagctgcaggacttcaccctcagcaatcacgtttaccgcttctgacatcagcgccaggatacgcagcgaacccatgctggtcatcatctggaaggcgcgggtgtaaataaaatcaccgaccagcacgcttgccgcattgccaaacgccgcgtttcgcggtcgctttgccacgacgcatatcggattcatccacgacatcgtcatgcagcagcgtggcggtgtggataaattcgatcagcgccgcattggtcacgtgcagatcgcccttgtagcccatggcacgtgcggatagcacggcaatcatgggacggatacgcttgcccccaccactgatgatgtagtagcccaactggttgatgagcgagacatctgaattcagctggtcgaggatggtctggttaacggcagccatatcctgtgcggttaattcattaatctgttctaagttcattcgtcttttcagctatgactcgttatctctgccatggtaagtgcttttacccagccagcgttcaggtaatctgttactgattgtacttgaattttctgcctgagaaacggttgcattcagcctgtgttttttttctgcaagagtgtgcaaagtgctcttgtcttcttctggagttttgcgtagaattcgcgccctattgtgaatatttagcgcgccgcctgatgaactaaaaggcaagcgcagaagcggagttttatatgtacgcggttttccaaagtggtggtaaacaacaccgagtaagcgaaggtcagaccgttcgcctggaaaagctggacatcgcaaccggtgaaacgattgagtttgaccaggttctgatgattgctaatggcgaagacgtgaaaatcggcgcgccactggtttcaggcggaatgatcaaggcagaagttgttgctcacggtcgtggcgagaaaattaagatcgttaagtttcgtcgtcgtaagcactaccgtaagcaagcaggccatcgccagtggttcactgatgtgaaaatcactggtatcacggcataagaggagatctgacaaatggcacataaaaaggctggtggttcgactcgaaatggtcgtgactccaatgcaaaacgtctgggtgtaaaacgtttcggtggcgaatctgttctggcaggtagcatcatcgttcgtcagcgtggcaccaaattccacgccggtaccaatgtaggttgtggtcgtgaccacaccctgtttgctaccgcagacggtaaagtacagttcgaagttaaaggtccgaacaaccgtaaatacatcagcatcgttgctgagtaaggttgtcgtgacgcagacgtttaacgtctgaacgcacgaattgaaggccccgcagctcctgcggggctttttacattctgcggtctgttgcggtaaaagcgacgcatcacaaaagtttgctgtacactttatgtacgcactggcgaaagccaatcctgatttatccgccgctggtcagcgcagaagaccctggcggacccgtctgcagagtgctgcaggcgattgtgtgacggagatagaaaatgaagtttgtagatgaagcgacaattttggtcgtcgccggtgatggcggtaatggttgcgtaagcttccgccgcgaaaaatatatcccgagaggcggccctgatgggggtgatggcggtgacggcggtgacgtttatctgatcgctgatgaaaacctcaacacccttatcgattatcgtttcgaaaaatctttccgcgccgagcgtgggcagaaacggccagagccgcgactgtactggcaaacgcggtaaagatatcgaagttaaagtgccggtcggcacccgggttatcgatcagggtaccggcgagacactgggcgacatgacgcgtcacggccagaaactgatggtcggcaaaggcggctggcatggcctgggtaacacccgctttaaatcatctgtaaaccgcagtccgcgccagaaaaccatgggtaccccaggtgaaaagcgcgatctgcagctggagctgatgctgctggcagatgtcgggatgctgggcttaccgaatgccggtaaatcgacctttatccgtgccgtatcggcagcgaagccaaaagtggcggactatccgtttaccacgctggtgccgagcctgggcgtggttcgtatggacagcgagcagagcttcgtcgtggccgatatccctggcctgattgaaggcgcagccgatggcgcaggcctcggcattcgcttcctgaagcaccttgagcgctgccgcgtgttgctgcacctgatcgacatcgaccctatcgatgaaagcgatccggttgaaaatgcccgcatcattctcggcgagctggaaaagtacagcgagaagctgttcaacaagccacgctggctggtcttcaacaaaattgatctgatcagtgaagaagaagcgcagtcacgggctaaagcggtggctgaagcactgggctgggaagataagtattacctgatttctgccgcaagccgtaccggtgtcaacgaactctgctgggacgtgatgagcttcatcaacgctaatccgaaagaagcggagcttgaagagaagcagccggagaaagtggagttcatgtgggacgattaccacaaagaaaccattgaaaacacggttgaagtggaagatgaagagtgggatgacgactgggatgatgaagacgacgaaggcgttgaaattatctatcagcgttaaccgatcgcctgctacagcgtgatatgcaatgccccctttcaggcctgaaagggggcattgttctttctgcagctagctcatcaccgccacactcagtcgcgcactgcagcacagctgatcccgaccgttccgaatctcaatctgccagctctgactgcgtttacccagatgcagtggacggcaaattccccgcaccagaccggcagaaaccgcacgatgatggctggcattcacttctacgccaaccacgctgctgccttcttcaaccgccagatatccggcaattgagcccatcgactccgccagcaccacggacgcaccgccatgcagcagcccgaacggctgttgcgtacgggcatcgaccggcatcgtcgcttccagataatcatcacctatcagggtaaaaacgatacccagatgggccaccagagagttctcacccagcgcattcagggcgggaagatcaatggatcgcttccagatcgctgtcatcatcaggctcccagggttgcgccaccatcaactacaatatcctgcagcgtcacatggctggcaagatccgacgcgagaaacagtacggtggctgcaatttcctgcggctgcgcgatcttgcccagcgggatacccagcttgaattgatccgggaagccggcaatcatctcctgctcacccgtcggtgtgtgccacaggctgcgctgcatatcggtgtcggtggaaccgggtgaaacgatgttgcagcggacgccatagggcgccatctccagacccacggtctgacagagactgcgcagcgccgcttttgaagcaccataagcggacatgccgatacgcggggcgtgagccgaattagacgcgacggtgacgatggcaccggcgcgctgttcacgaaagcgtggcaatgtctgctggaacagattaaacgcgccgcccgcattgacgttaagacacgcctgccagtcggcaaacgacagctcatcggtggcaccaatccgtaagataccggctgcgttgaccagcacatcaatgcgcggctgcgcagccaatacgcgctggcagatcgttttgacctgagccggatcggctacatccatcgtgtggcagggaaacggataatcatggcccttaaaacgttgatcaaaggcctcaacctgtgcgccagcctgatgaaaggctaacgcagtatgatagccgatgccctggccggcaccggttacccagacgattttaccgctgaagtcgaatgtgtggctcatttcgccggctcccgcgccagcagcgcccaccagccatcaatgctcggatttttcgccaggctgacgaaatcgatatcacgatgtacctgacgccagcgtgccgccagcgccatcacgcgtactgagtccagaccgtaatcaatcaggttttcatcatcttccggcacctcatcatcttccagcagcggcaggatcaacgcgcgcagatcatctttgctgagtggcacaggcatcagatcggcggtcatcaccacttttccgctacggcccgcagtgtaggtcagcgccatcatatgttcctctcggctgaaatcagccagcgcatcggccaccataaacggctggatattgcgcataaacgcatcggtggccgtagtcaggcagccaatatgagcatagacgccggtgataatcagctgatcgcggcccatctcctgcagtatcgactccagcggcgagcggtgaaatgcactgtagcgccatttggtcaggacctgatcgtcctcatccggtgccagcgcatccacgatcttctgctgatcgggatgtttattcaggcccggtccccacatgtcgttgagcagcgcacgatcttcatcgctctgcgcgtttggctgagcggtgtaatacaccggaataccctgcgctttgcagtagcgacgcaggcgggcaatattgtcgactacctgctcaaccagcgggctattttcgccccagaagttgagaaaatagcgctgcatatcgtggatcagcagggcggcacggtccggctccagcatccatttcactttgttgttgggcaactcggtggcggctggcagcggataagaggtcagttgtggaatagccattgaaaatctccggacagatcaggcttgcgcttgttgatcggcaagttgttggcgcagacgttttttgtccacctttccgaccgcggtcagcggcagggcatctacgcaggtaatacggtcgggcagcttaaattctgccacgccaagtttcacgcaggtgacgacgcagcgccaccggtttaaccggctgacgggtgacgataaaggcacaactcttttcacccatcagctcgtcgctcatggagaccagtgcagcgtggatcacatccgcatggcgctgcagcaggttttcgatctcttcggctgcgatcttttcgccgccccggttgatctgatctttctcccggccctgcacgatgatgttgccagagggcgtgatctcaatcagatcgccagagcagtaaaagccctggtcatcgaagctggcggcgttatgttccgggctgttgtagtagccgcggaaggtataaggaccacgcgtcatcaggcgaccgatggagcctgctggcaatgggttaccctgatcgtcggcaacccatacctcgtcatccggggagatcgggcgtccctgcgtggtgagaatggtctgctcatcgtcatccagccgggtgtagttcaccagaccttccgccataccaaatacctgctgcagggtgcagccgatctcgttctggatgcgcgcggccagtgtttcacccagctttgcgccaccgacctgaatgcgttgcagcgaggccagcgcagcattgctgccccattcctgaatcgcctgcagccagagactggcggcgggcggaaccaggccggtatcggtgacctgatgcttttcaatcaacgggaagcagagcgttgcgctgggatcggcggctaagatcacctgtccgcccgcgtaaaaaacgcccagcgcgcccggcgaactcatcgggaagttatgcgcggcgggcagggcgatcaggtagcgggtgtcggcggtaacatcgcagataacgtcactctcacggatgctgtagtagtaatcattatgggtacgtgggatcagtttcggtgtaccggtactgccacccgacagctggaaaaaggcgacttcatcgcctgcggtcggggttgcgatgaagttgcccgcgggttcagccagcagggcgtcgaggctgttttccgtctgagcgtcattacgcaggatcacctgttgtagtgaacgctgatcgcggcgaagttgcgcaataaacgcatcatcggcgaacagtgcgtggctgcgatcggcaattaacaggctcggcgagatctgactggcataggcggccagttcagtgcgctgatggctgaacagggcgttaaccggggcaacgccgattttgaacagggcaaacagcgtcaggtaaaactcagccacgttgccaagctgcaccagcgccgtatcgcctgacttcaggccgcgacgctgcaatgccgcggccaggttgtcactcagcgccgccagctggcgataggtaaattgtcgttcgccatcaatcaccgctacgctctcgctgtcgcgatgacgttccaggatgtcggtcatcggcagatcgagccagtagcctttttcacggtaacgtgcggccagatcgtccggccagcggctgtaggaaatcgtcatacaggttcctttattgcagtccaaaagcgcgaagcatggtgtcgagtttgacgccggtttcacgccattctgattcaggttgtgagtccgctacgatgcctgcgcccgcaaacagccgcacccgcgggccattcaccgtaccgcagcgaatggtgacgacccattcgccattgccctgatcgtcacaccagccgacgatgccgccaaacagctgacgttcaaatggctccagtcgctgaatcagcgcctgagcacgctgatgcgggaagccgctgagggccggtgttggatgcagcagacaggccagtgacagcgcattttcgcgatcgtccagcacgtcaccctgaatctgcgtagcgagatgccacaatgttgcggtggtcagcagtgaaggtgtctcggggaccgacagcaggcggctgcgcggttgcagcgtcgcgcgcatcgcatccgtgaccagcttatgctcatgacgatcttttgctgagtgcatcaggctgtcgccagaggcctggtcacgctgcggatcgcgatgacgcggcgctgaaccggccagcggacaggagctgaaactggcggccctgcttacgaatcatcagttccgggctggcgccaaccagcgcgccaccatcgggcagcggcagatgaaagtgatagctgttagggttctgcgccacgatgcgctgcatcagggcggccgtatcaaccggttgttccgccacgatatccatcagccgcgacaacaccactttatccagatcgccgcgctgcgtagccgccaccgcctgcgcaaccatgtcgatgaaaatgtcatggtccggcaccgccgtgcggcgacgcacctgcggcagttcagcctcagccagagaggcactggcgttgagatcgtcacggttaaaggtctgatacgactcagggataaacagcgcagtgggctgatccacgtcgaaggggattgcacccaccagaatgggatgggcaatgccctgttttctggctgaagcaaaatggtgctgtagttgctgctgaaactcccctgtcagctgctcaccctgccttaccggcgcggtaagggtagtaaaacagccctgtgtggtcaggctttgccagggagaggtaaacagaaagccacggcagagtgccgggaaatcctgcaacaagggatgttcaaacgccagcgattccaccataatttccacctataaatgataaggtaactaataatgattatcatttgtattgtgggccagtaacctacgttgattagccgaaagtgtcaataattacgcggcgattcagctggcatggccggttaaatcagcacaaatggtctctctctttttccgggtaaaagtggacgaaaatctatgagtaaacatggtgtcacatcggcgatagcgctgtttttcctgagcatcagcctgttcagcgttaccgctgctgcccagaccggctggccgcgaactgtcgccgggacaaaaggcaatatcacactgacccaggcaccgatgcgtatcgtttcgaccagcgttaccctgaccggctcgctgctggcgattgatgcgccggtcgtcgccagtggcgcaaccgcacccggcagtcggctggctgataagcagggattcttccgtcagtggggcgaagtggccaaacagcgcggcgtaaaacgtctctacattggtgagcccagtgcagaagcgattgctgctgaagcgccagacctgattgtggtcagcgccaccgggaatgattcggcaataaaactggtcgatcagcttgcggcgattgcgccggtgctggtggtgaattacgacgataaaagctggcagcaactggtgacgttgctgggtgaggcgaccgggcatgaagcggaagctgccgcccggaaagcagagtttgatgcgcgagaaaaggctctgaaagcgaagctgaccctgccgccgcagccggtatcagcgatggtgtggaacggtgatggccgggcagtcaatctgtggacggatgcgtcggcgcaggggaagttactgcagcaactgggcttcactctggcgacgccgccggccactcttcagtctggtcacagcatgggacagcgtaaagatatcctgcaactgtcaggagaaaatctggcggcaggccttaatggtcaatcatatctgctgtttgccgccgaagagcccaccgccgcacaggtgatgagcaatcctttcctggcgcagaccccagcggtgcgcgcaaaagcggtctatgcgctggggctggatagcttccggctcgactactacagcgccagcaatttgctgacgcggctggagacgctgttcgttaaatcatgatcccgtttccgccggtgcaggcggttgatagcgacgcagacgcgccatcagcagccacatgatgatgcccagcacggtggctgccagaccagccaggctggcagcctgctgcggcaacagcagtgaacccatcgcgccaatcatcgctgcacctatcgcatcgccggtgacattctgcgctgtccagaggctgttgatcctgccgagcagcgcatctggcgtcagcgtctggatcatcgcgtactgcaccaggctgttgatggcactgaaatagccaaagaccgcgaggcagaccagactcgcgctgaaccacggcatcaggctgaacagagccagcgcgacgaaagcagcaatagcactcgccagaatcaggcggcccggctgcggtgattgtgccagccgtccgctggtgagcgcacctgtggcagcacccagcggaacagcggcatacatcagccctaactccgtcacgccgacctgccagtgtggcgccagcgccggatagagcacgcgcaccgcactggctaacgtcaccagcgcgccgaccagcgccgccatgccaacaatcgggctggcaaacaggaattgcacgccgctggccagtgctttcagcggatgttcacgcggctgcggcggtggcgccagccgcggcaaccgcagcagggttaacaccgtcagcaacgtgccgaaacgccgccagtccgtagttccacgccacaccgccctgcgcgatgaccagtccggcaatggcgggtgagagaatcgcgccaaatcgcaccgtcagcatggtaatcgcacctgctttcatcaggttttcacgcccgaccagcgccggcgtcgccgccagcagcgcggtgacgcctatcgcgccgaaaaaaccatcccacagtcccagcacaaagacggcgatcaccgacggcgaagggagcagggcattgatgcataaggcgacaaagcccaggccacaggtggatcgggcaaacaggatcagacgtcggcgctcatagcgatccgccagcacgccgccggtcagcaggccgataaacatgccggcaccggccagcgtcaccgccagacccaccagcagcggcgactgcgttagctgctgaatctgaaccggtaccgccaccgccagcatgccgagggcaacgatggagataaagcgggcgataaaaatggcgcgaaaggcggggtgggttctcagcaggctgagatcgataaagtgggagggtttgttcataacgtcgcttttttgcacccattttcctcatcattgagtccgggagtcatggtaacatacaaaaaatcactaataacgataacaagtatcattatcataatgactcgtgctgcgatctcaatgaatcggtgaaggtttaaacgttatgcgtcaacttcgtgcaatagcaggttcagggatgctgctgttgttgcttctcgcgctcagcctgatgctgggtgccaaatctatcccctttcatgatgtcacgcaggccttattcagcgactgtaaccgcgtcgattgtgtcatcgtgcgcgatgcccgactgccgcgcaccctggcgggtctgctggccgggatcagtttaggtctggcgggcgcgctgatgcagagcctgacgcgcaatccgctggccgatcccggcattctcggtatcaacgccggtgcgggctttgcggtggtgctgggcatcgccctgtctggcgctgactcccccgcggactggcttggctttgcctttacgggcgcactgctggcctccctgctggtggcgctgaccggtgcgctgggcggtggccgcgttaatccggtgcgtctgacgctggcaggcgtggcgctgggcgcggtgctggaggggttaacctctggtttatcgctgctcaatcctgacatctacgatcatctgcgtttctggcacagtggctcgctggatatccgcaattttgccattctgcgcaccacctttccggcggtagtcgccggtagcctgctggcgctgctgctggcgcgttcgctcaacagcctgagtatgggcggtgatatggcgaccgcgctgggtacccgggtgatgcgtacccagctggtgggattactggctattgctctgctgagtggggcggcgacagcctctgtcggtcccatcgcttttgtcggcttaatgacgccacatctggcccgctggctgctgggtaacgatcatcgctggatgctgcccggaacccttcttatcaccccctgtttgctgctggccgccgatattctgggacggctgctggtaccgggcgaactgcgcgtgtcgattgtcacggccatactgggcgcgccgatgctgattgtgctggtgcgccgcaagtcgggaagagggcagatatgaaacgggtgatggttaatgcgctgatgctgctggtggcctgcggggtgctggcctttctgagcattacgcgcggcaccttaccgatctccgccagccagttgtgggcccttatcaacggcgaggcggcgcgtaacatacagttgattgtactggagtggcgactgccgcgcgtcatgatggcgctgctgattggtgcggcactgggcgtcagcggggcaatttttcagtcgctgctgcgcaacccgctgggcagccccgatattctgggtttcaataccggcgcttacagcggcgtcctggtggcactggtgctgttccagcaaaacatggagggcatgacgctggcggcactgcttggcggactgctcacggcgggcgtggtctggctgttcagctggcgcaacggcgtggagacctttcgtctgatcattgtgggcatcagcgtgcgggcgctgctgatggcgctgaacagctggctgattatcagcgcctcactggaggcggcactgagcgccgggctctggagcgccggttcactcaacggcattacctgggcgaaaacgacgccggtgattaccgtgcttctgctggcgctgctggcgacaagcatgctggcccggcgcatgcgtctgctggagatgggtgacgacactgcctgcgcgctgggcgtaccggttgaacgcagccgcgttttgctgatgctgacgggcgtgatcctcaccgccgcctctaccgcgctggtcggtcctatctcctttattgcgctgctggcaccgcagattgctcgtcggctatgtggcggtatcaaaggcgcgctgccgctggctgccttgtgcggcgcgctgctgttaaccgccgcggattacgccgcgcagcactttttcctgccttatcagctgccggttggcgtcatcacggttagcctgggcggactctatctgattgctttactggtacgggaggcgcgacgccaatgacagtgaaaacacgtttgcagggcgacgcgctgacgctggggtatgacaaaaaaatcgtggcggagaatctcaccgtcgcgatccccgacggtgaactgaccgttattattggccccaacgcctgcggaaagtcgacgctgctgcgtaccttaagccgcctggtctcgcccctgaaaggccaggtgctgctggatggcaatgcgattgctcactacgctaccaaagaggtggcgcgtcggctggggctgctaccgcaaagctcgaatgcaccagcgggcatcagcgtcagcgaactggtcgcgcgcgggcgttatccgcaccagtcgctgtttggtcgctggcgacaggacgatgagacggctgttcagcaggcaatgcaggctaccggcgtggcagatttggcgcagcagcaggttgatacgctctctggcggccagcggcagcgggtgtggattgcgatggtgctggctcagcagacgccactgttgctgctggatgaaccgaccacctggctcgacatcgcccatcagattgagttgctggaattaatgcaggatctcaatcagcagcatggccgtacgctggtggtggtgctgcacgatctcaatcaggcgtgccgctatgccagccacctgattgcgatgcgagacgggaaaatcattgccgaagggaaaccggcggagatcgtcacgccggaactgatagaagcgatctacggcctgcgctgcatcatcattaacgatccggtggccggtacgccgatgattgtgccgctgggaagaggctgacctgcgctttcttcaggtggagaaagcgcaaagtcataacggttcagggattcagcgacgccaggcactgctgcagtcgtggcccaatctgttcgaacatgcgcggtgagatgatctcgacgtgcgcacagtccagcggccagatggtcagctcgccgacatagggcgcccaggcgcggcgcgcatcctgaccgggctgctgcgtctgttccgccaggaacagggttgcgtgtccggtgaaacgggcactgcgcgctgttgccagcaggcgcaccgaactggcgtagttggcttcaatggtggtaaacagtgcctccattccttcaccggcctgctgccgttgcgcagcgataaactgctcgcgctcacgattaacctcttccagcaccgccggatccagcacgttttcaccgcgccgttcatcccagttctgcgtctccggcggccaggtatccagcagtccgaggaaggcaacggtttcaccttcggcctccagccgcgcggcgataccctgcgccagcgtgccacccagcgagtagcccaggaaatagtatggcccctgtggctgctgctgacgcaccgtcgccagatgcgcctcacacaccgcgtcaaggtgctgcgcctggttcagcgggctggtgatgtcgggtgactgaatgccgagtagcgaccagcgtgcatccagatagcgctgcaacacgctgaactgccaggcaaaaccggaggcgggatggaagcagaacagcgtcgggccagtgctgcgtcgcaagggtaataccgcttcaaatccggcacgagccacatccgctggctcgctgctgagcagtgtcgccagcttttctaccgtggatgccaccatgatctggcccactgacaccggctgattcagcgtccggcgcagctgtgctgccagccgcatcgccagcagcgagtggccgcccagcgagaagaaatcatcctgggcgctcaccggttcgcactccagcagcctggcaaacgcctgtgccagtgtcgtttcgagtccgggatgcggcgcgcgaccagccagcgctgcctgcgtttgcggcagcggcagcgctttgcgatccagtttaccgttgctgctgagcggtaacgccgccagctgaacaatcgccaccggcaccatatgcgccggtaactgtgtggccagagtctgacgcattgcgtcggtatcgatcgggccatcagccaccacatagccgaccagctggcgggcatcgccctgctgatcgctgctgctccccagcaccaccgcatgtgtgacggcctgctcaatgccaggtagcgcagccatggcgtggtcgatctcgttcagctcgatacgctgtccgcgaattttaagctgatcgtcgctgcggcccagatactccaccgcaccatccggcagccagcgcgccacatcaccggtgcggtacatccgggagccgtgaccccacggatcggcgacaaaccggctggcagtgaggtcgggacgatcaagatagccatgcgccagctgcacgccggtcagatagagatcgccagccacgcccggtggcaccggctgcagacgcgcatccagaatccgtaagccggtgttccagaccgggaagccaatcggcacgctggccccttcgacggccgccagctccgggccaaaggccggatagtagctgacatcaaccgccgcttcggtcgggccataaagattatgcaagggcacccgggtcagcgcctgccactggcgcgatagctctgcgggcagcgcttcgccgctacagaaaacccggcgcagggtggcgcagcgcgctatcgcgtcaccttcctgcagcgaagcgacaaaagcagccagcatcgacggaacaaaatgggtggtggtcacgcggtagcgggcaaacagctgctgcagcgcgtccgggtcgcgatgagcgtcgggcggagccatcaccagccgtgcgccgacgatgagcggccagaagaactcccataccgaaacatcaaagctgctcggggttttctgcaacaccacatcatcgctgccgagcggatagcgatcctgcatccataacagacggttgacgatcgcctcatgactgaccagcaccccttttggccgaccggtcgagccggaggtatagatgatgtatgcgccatcctgtggacgcggggcctgcatcagcacgctatcaacgggtgttaacagcgcgtcgtaaaacagcggcgcgacgggtgagagtgccgccagccgctcggccagttcacgacaggtgatcagcgttttcggcgcggcatcttccagcatcatctgtaaccgatcgtccgggtagccggtatcaagcggcagccaggttgcccccacgctgacgatcgcctgcagcgccagcgataaaaagaccgaacgcggcagcgctacggcgacgatatcacccggcgtcactccctgcgcaatcaactgttgccccagcgcggcgacctgctgctgcatctgttgatagtcaagctgatgcccctcatctgccagtgccggagcgcgcggcgaacgctgtgcctgacggagcagcaggctgctcagggtttctgcaggcagcattacggcagtctggttgatcgccgcgagctgctgatgctcttccggcatcagcatgtccagctcgccacaggcactggctggccggacggcaagctgctgaagcagcaggccaaagcggctggcgtgttgctttagcgttgtgtcgctgtagcgctgtgcattagccagtaactccagcgtcaggtcgccctgtttcgctgaggtagatagcaatctccagatcgcgtaccggtcctgacgccagctgatgggttatgcctttgatgccagcgaaatcgagctggtaatcaaacatcttcagattgattaccggcccatagagcggatcgctgtcgccggagcgacccagatcgcgctgcacctgttcagcgtcgtaacgctgatggcgacgcatttttttgacttcgtccgccagacgcccggccagtgccgtcagcggctgtgccggatcgtaatgcaccgccattggcagcacgttaatcaccggaccggtggcgcagagcgcggccgagccgatgcggcgcataaagatgaaaccggcggcgaacgcatgctggccggtgaggcgcgccagccataaggccaccagcgcaaaggcggtatccgcagcactgaggttgtactgcccggtgtgcgtcagcaaagcctgaaacgtgtcgcgatccacggcaaacgtatggcgcagcaggtcggtactggcgctctgaccggccagcggcagagcggacaacgaggcgggcgcaggtagctgcgcgcctttctccagccagaactggcgatcgcgctgccagcccgaagattgctgatagcgctgatattcatcaacgacgtcgctgaacggcacaaacgggcttggctccggcgtgtcgccgcgctgccaggcgctgtaaagattggcgatacggcgggtcagggcggtgaaactaaaaccatcgaccaccagatgatggtatcgctgataccagtaccagtgatcctcgcccagccgaagcaggctgtgatggtaaagcggcgcgccgctcagcacccgcagatcgccggtcatatcctgctgcatcagcgcacgtgcttcggcctccggatcggcggcatcgcgcagatcgatcacctcaggctcgcggaaatcctggggttcaggccactgtagcggttcaccctcctgctcgccaaaggccatattcagtgtgtccgcttcctgcatgccagcaattatggcccgtgacagcaacgcgctgttcagcgcaccgcgcagttccacaaaatgcgccacggcgtaagcattggaatagggcgatagctggtcagcgatccagattccgggctgagcggccaccagcggcagcgttttttgttctgtctgcgggttgagggtgatctcagacattttcgcctctgtcctgcgtcataaccggacggatatcgtgccagttttcattcagccagctcagacagtcagcctgtggcccggggccaaacaccggctgccatcctgccggaaccgcacaaaaggcgggccataagctgtactgctgctgatcgttcttcagcacctgacaatcctgttgcggatcgtcgaaagggttaagttgttgcatgtcggtctcctgtccgcagtcaccgggcgcgctaacgccgctgtcctgcatatccgatatctttcagtggcgcgcagaaggcggaatataagcgggttagggctattgccacatggctttaaggcctgccagcagtccaccgcgccagcacagcgcatcgtgaccgccttcgaccgggtgatagctgacctgatgtccggcagcggtcagatcgtgctgaaactgctggtttgctgccagaatcagccgttcgcgtcgtcccgcttccaggtagaagcggcgagggggggcctgcagtaagccctgttgtaactgctgtggcagccagccattgggatcgccgcgcgcgggccaccagaaacgacccggagaggctgatcgccccagcaaaggtttccggccaggtcagggtggcgtaagcggcagaaaggccgccaaaactctgtcccgctaccagcgtgctgtcggcacgaaacggcgcccagcgctgaacctgcggcaacagctcgtgctgaatcgccagccagaagtcagggttacaggtcagctcacgcgtgcggtgttcgcggtcgatgatgtcgatcatgacatagaccgcagggggcagttcgcccgcctctgtcagttgctgaagcgggccggcaaccggcatgttctgtgcccagaactgaccatccagcagcagtaccagcggacgatcgcctgcactggtgtctcccgtgacagagatccagatctgacgctggttccccagccgttcgctgcgccacaaatagtgttgcagcggaatatcggcggcacggccctcatcaaccgcacgccacacctgctgatccggcgcgtgtggcaggtgcagtggcgagaccctcattccgcgtccacccgcccagcttcgcaaaggattcagcgggtcgctttgcgcctgcgggaatttctgactccaccactggcgcactgcctgcatatcggcctgcccggtaaaagtctcttcctgactatcaggaatcaggcagtagctgccgcgccagtcagcgggcagggcggtttgccaccaccagacatcggtatcgggaacaggcgttaatgaggaggggaccgctgaatgatgatgatcggttacgccggtaatattgatccagacgcgccgggtatcggagtgctgcgtgtcaccctgaggatcgcgccagaaaaaggtgacctgacaggttcccttttcgccagcttcaaccagaggaatgccccgttgctgctgctgttgccaccagcgttcactgccggtttcttcatttaaccacgtcatacgcgccatctttcgatcacccttgattagggtcatgcatgttatgaataatagtattgataattatttgcatttgcaatagggtgtttccgcccgacagggagcgcgcgcatcctctctgccgcaccggctttcagactgatgcaaagcgcttctgacgctggcccggcgacaaggggaaaacgttgcaggcaaggttattacttttttaccggcacgccggcagtggcatcctcgccggcactccaggaacagaaaaatgaaaaagttatcccggctttcgttagccattatgattgaactgggtttcaccgcctctctcatttctgccggtgccgtggctgctgaagccacccgcgaaccggttatcgacagcagcccctccgataccctccacgacgacaccatgatggtgaccgccgccgagcagacgttgcaggcacctggcgtgtcgaccatcaccgccgacgaaataaaaaaacatccacccgcacgcgatgtcgccgaaattattcgcaccatgcctggcgtcaatctgaccggtaactccaccagcggccagcgcggaaacaatcgccagatcgatatccgcggcatggggccggaaaataccctgattctgatcgatggattgccggtgaccagccgcaacgcggttcggcttggctggcgtggcgagcgtgatacgcgcggcgacactaactgggtgccgccagagatcattgatcgcattgaggtgatccgcggtccggcagcagcccgttacggtaacggtgcagcgggcggcgtggtgaacatcatcactaaaaaagagatggataatcagtggcacggctcatggagcgcctattacaacgtgccggaacacaaggaggagggcgcgacccgtcgcaccaacttcagccttgaagggccgctgggcgatgatgtcagtttccggctctatggtggactggcaaaaacgcaggctgatgcttacgacattaatgaagggcacgccgcagaccgcaccggcagttacgccggatcgtacccggcgggccgggaaggctcgatcaacaaagatattcatggcctgctgcgctgggcatttgcgccgatgcagacgctggaagtgggggccggttacagtcgtcagggcaacctctatgccggggacacgcagaaacaccaataccaacgccctggtgaaaagcaaatatggtgacgagaccaaccggctctatcggcagaacttttctgttaagtggaccggtgcctgggacaatggcatcagcaccaatacctacgcgcaatatgagaatacccgcaacgcgcgtctgaatgaggggctggcgggcggtaccgaaggcatcttcgccaacagcaacttcaataccattcagctggatgatgtgttgctgcacagtgagatcagtgtgccgtttgaatggctggtgaaccagaccgcgactttcgggacggaatggaatcagcagcggatgaaggatccttcatcgacgactcaggccgccagctacgggtcgattcccggtatcgctacgaccggccgcacaccctattcgcaggcggagatcttctcgctgtttgccgaagacaatattgagctgaccgacagcaccatgctgacgccgggcctgcgcttcgatcaccattcgattgtcggcgataactggagcccgtcgctcaacctgtcacagggattaggcgatgagttcacactgaaaatgggcattgcgcgcgcctataaagccccgagcctctatcagaccaacccgaactatctgctctacagcaacggtcagggctgtgccgccagtgccggtgcctgttatctgatgggtaatgacgatctgaaagcggaaaacagcattaataaagagattggggtcgaatggaagcgcgacggctaccaggcgggcctgacctggttccgcaacgactatcgtaacaagatcgaggctggcacggcgccaaccggcaccgcatctaacggcaaaaccgacatctacaaatgggaaaatgtgccgaaagcggtcgtcgagggactggaaggcacggttaatgtcccgttctccgacagcgtaacgtggaacaataacttcacttacatgctgcagagtaagaataaagagaccggcgatcgtctgtcgattattccggaatatacgctcaattcgacgctgagctggcaggcgatgcaggacctctccctgcaaacgaccctgacctggtacggtaaacaggtaccgaagaaatatgactataaaggtaacgccgttaccggtagcgccaccgatcaggtgagcccctattcggttgtgggcatgagcggcacctatgacgttaataaatatgccagcgtcaccgtgggtatcgacaacctgttcgacaagcgccatttccgtcagggcaacgcgcagaccaccggcaatgccaccaccggagcgtggctctatggcgcaggggccaatacctttaacgagtcgggccgcacctggtatatgagcgtgaatacccgcttctgatggacgggcaataaaaagcgcagcggttgatctgaccgctgcgctttttttatgactgaataatcagttgttctgattgatatcgcggtagagacggctctcaaatcgcaccagcggaatacggcgggtacgctgatcttccggcgggaccgcataaccggaaaggaactgaacgaatgccacccgcgcaccactggaggtggtgataaagcccgccaggttatagacgccctgcagtgagccggttttcgccgagactttgccatccagccccgcctcatgcagcccgccgcgatactgcagcgtgccgtcgtaacctgccagcggcagcatcgaaatataatccagcgtgttgtcattcttcgcaatgaactgcaatacctgcatcatggtttgcggcgaaatcaggtcatggcgggagagacctgaaccatccacctgaatgctattacccatgtcgacattggctttggctttcaggatgcggcgaaacggcatcctgtccggcgcggaacgtgccgggcacattgaagtagtgatgaccaatggtgcgaaacaccgtgtcggcaatcatgttgtctgacttcttcagcatggtgtgcagcagcgtatgcagcggcgcggactgggtcgatgccagcacggtacccggttcggtgacctgcgtctgtcgcaccagatgcccgctgtaatcaatctcagacgaccgcagttccgccttgaggatttcgccagcccaggccgcgccatcctgcaccgcaaatgccagcggcagtggttccgcgcgctggcgcatacagcccgtgagggtgtagcggttcagctcgcccggcaccacatccagctcgcaatattgcccttcgccgctgttgcggccaatggtgcgcacctggctgtacatatgcgccggataataggaggcgatacgtacaaaggcattctcacccggcgtattagcactgtagagcgacaccgagaagcagtttttatcaacgattgccgcacccggcggagcactgaagcactgggtcatatcgttccacggccagcccggcgccatatcgtgactggcaaaaacggaggtgtcgataaccagattgcctttgatatggttaatgccctgcttctttatcgccgccaccatgttgcgcagatcctgacggcttaaggtgggatcaccgccgaaacgtgcgactaaatcgccgttcagggtgccatcgataatggcgccacgagtctcaaaagtggtctgaaaacggaagtcgccacccagctccagcaatgctgccagcgccgtcaccactttcatggtactggcgggcagagccatctgttttccgtgataatcaataatcggtgttgatgcgcctactttttgtaccatcagcgccagattggcgccgtctggcaggtactgcatgtattcatcaactggcgctgcgtgtgcctgcagcataaatgcgcagcttaatccggtaacaagtcgtgaaaatcgcataatctcgcggtaactggcaggtgagggcgtcaatactacgtcgctggacggtgcaaagtaaacgatgacccgcagggaactctggggtaaaatacgtatcaaattgcaaaactcttttctggcctggaagcatctccgggtcaggattcttttatttgcaaaaacgggctaatgcgccgcagaacgcttttttctgcagtcaccggtcaggatgacatcgttaaacaggaaagatggcgaggagcttaaatgaatcagattccgatgacgttaagaggcgctgaaagattgcgcgaagagctgaacgagctgaaaaccgtgaagcgcccgcgcattatcgcctctatcgctgatgcacgcgaacatggcgatttaaaagagaacgcggaatatcacgctgcgcgtgaagagcagggtttttgcgaaggccgtattcaggagattgaagccaaactctccaatgcgcaggttatcgacgtcactcagatgccgaaaaccggacgcgtgattttcggtgcaaccgtcaccgtgctgaacgtcgaaaccgacgaagaagccacgtatcgcattgtgggcgatgacgaagcggactttaagcaaaatctgatttcggtcaattcgccgatggcgcgtggcctggtgggtaaagaggccgatgacgtggctatcgtgaaaaccccaggcggcgacgttgagtatgaaatcctgaaggtggaatacctttaagatgttgctacgctttgaaaagcgttaaagcacaatgtaaagaaaggaaaaaggccgcattgcggccttttatctgaggtaagagcatgtcactttctttgcccacttagcgtggcagagaaattttgctctctttagaggggcgatacagcaccagcgttttgccgatcacctgtacgttgctggcaccggtctcacgcacgatagcctcaacgatcagctgtttcgtttcacgatcttccgaggcaatttttaccttgatcagttcgtgatgcgacagagcctgctcgatttcggccagcacgccttcagtcaggccattgccacccagcataaccactggcttgagcggatgggcgaggcccttgaggtgctgtttttgtttggtacttagattcatcgtagttttttacttactcagggattgaaaacggttcattctaccgccatctcgggtatatcaccaaatcgacgcaacccattgcgtgcaggtttatcgctacgatgacgatttagttggaaatattatgacgggtaaaaagcgttcggccagctccggccgctggcttcaggaacactttagcgataaatatgtgctccaggcgcataaaaaagggttgcgttcgcgcgcctggtttaaacttgatgaaatacaacagggtgacaagcttttcaaacccggcatgaccgtggtagatctgggtgctgcacccggaggctggtcgcaatatgtggtacagcaaattgggaacaaagggcgagtcattgcctgtgatatcctgccaatggatccgatagtcggtgtcgatttccttcagggcgattttcgtgaagaatcggtggtcaatgcgctgcttgaacgcgttggcgatcaaaaagttcaggttgtcatgtccgatatggcgccgaatatgagtggtacacctgccgtagatattccccggtcgatgtatttagtcgagctggcgctggagatgtgtcgggatatcctggcacctggcggcagttttgtagtgaaagtgtttcagggagatggcttcgatgaatacctgcgggaaattcgctccctgtttacgaaagtgaaaattcgtaagccggacgcttcacgttcacgttcacgtgaagtgtatattgtggcgactgggcgcaaactataaccaaattgctggagaagtccgcagttttgctgcgattccatgtatgcgggatctatagtaccctacgctatctgttaacaccgttgtaatatgaggttaatcccttgagtgacatggcgaaaaacctgattctctggttagtcatcgcggtcgtgctgatgtcagtattccagagctttgggcccagcgagtcgaatggccgtcgggttgattattcaaccttcctgtcggaagtgaaccaggatcaggtccgcgaggcacgtattaacgggcgtgaaattaacgtcgttaaaaaagacagcaataaatacacgacctacattcctgtcaacgatcccaagttgctcgataacctcttgaccaaaaacgtcaaagtggttggcgaaccgccggaagaaccaagcctgctggcttcaatcttcatttcgtggttcccgatgttgctgctgatcggtgtgtggatcttctttatgcgtcagatgcagggcggcggcggtaagggcgcgatgtccttcggcaagagcaaagcccgcatgttgacggaagaccagattaaaaccactttcgccgacgtagcaggttgtgacgaagcgaaagatgaagttgctgagctggtggaatatctgcgtgagccaagccgtttccagaagctgggcggtaagattccaaaaggtgttctgatggtggggccaccgggtaccggtaaaaccttgctggcaaaagcgattgccggtgaagcgaaagtgcctttctttaccatctccggttctgactttgtggaaatgtttgtcggtgtcggtgcatcccgtgtgcgtgacatgttcgaacaggccaaaaaagcggctccgtgcatcatctttatcgatgagatcgacgcagtcggtcgtcagcgtggcgccggtttaggcggtggacatgacgaacgtgagcagacgctgaaccagatgctggttgagatggatggtttcgaaggtaacgaaggtattattgttatcgccgcaactaaccgtcctgacgtactggaccctgcgctgctgcgtccaggtcgctttgaccgtcaggttgtagttggcctgccagatgttcgcggtcgtgagcagatcctgaaagtgcatatgcgtcgtgtgccgctggcaactgatgttgatgcagcaatcattgcacgtggtacgccaggcttctcgggtgccgatctggccaaccttgttaacgaagcagcgctgttcgcggcccgttcaaacaagcgtgtggtttcgatggtagagttcgagaaagcgaaagacaaaatcatgatgggtgcggaacgtcgctccatggtgatgacggaatcgcagaaagagtcaactgcctaccacgaagcaggccacgccattattggtcgcctggtgccagagcatgacccggttcataaagtaacgattatcccgcgcggtcgcgcactgggtgtgaccttcttcctgcctgaaggcgacgcgatcagcgccagccgtcagaaactggaaagccagatctcaacgctttacggcggtcgtctggcagaagagatcatctacggtgcagaacgtgtttctaccggtgcgtccaacgatattaaagttgcgaccaatctggcgcgtaacatggtgacgcagtggggcttctctgaaaaactgggtccgttgctctatgcagaagaagagggtgaagtgttcctcggacgttctgtcgcgaaagcgaaacatatgtctgatgaaacggcccgcatcatcgaccaggaagttaagcacctgatcgacagcaactaccagcgtgctcgtcagattctgggtgagaacatggacatccttcacgcgatgaaagacgcgctgatgaagtatgaaaccattgatgcaccgcagatcgacgacctgatggcacgccgcgaagtgcgtccgccagcgggctgggaagatccaggcagcaactcagacagcaacggtacgccaaaggctccacgtccggttgatgaaccgcgtacgccaaacccaggcaataccatgtcagagcagtacaacaaataagacgcaacatcgtcagacaaaaccccggctggtccggggttttttacatccagatattgatcagcaaggagtttccgctatgaagttgttcgcccgtgattcccatctcgatttatcttttccacatgtgatgggcattcttaacgtcacgccggactccttttcagatggtggaaagcataacgcgctggttgatgcgctaacgcataccaatgagatggtcaatgcaggtgcaaccatcatcgatgtgggcggggaatcaacccgtcctggcgcggatgaagtgagtgtggaggaggagctggagcgggtgattccggtcatcgatgccattgcccagcgtttcgaagtctggatttcagtggacacctctaaagctgacgtcatccgggaagccgcgcgagtaggtgctcacatcataaacgacgtgcgttcgctttctgaacccggagcactggaagccgcagccgcgaccgcactgcccgtctgtttaatgcatatgcagggcgaaccgcgcaccatgcagcaggcaccggtttacgaaaatattttaagcgaagtggatacttacttcgctcagcagatagcgcgctgcgaagcagcgggcattaaaaaagagcgtctgatactcgacccgggcttcggtttcggtaaaaatctcagccacaattatgaactgctggctcatcttggcgattttcaccacttcggcctgccgctgttagtggggatgtcgcgtaaatcgatgattggccagctgttaaacgtcggcccgtcacagcgtttaaccggcagcctgagttgcgcggtgattgctgctatgcagggcgcgcagattattcgcgcccatgatgtaaaagagacggctgaagcgatgcgcgtggtcgaagcgacccgaagagcaaaaggagtatcatgagtaatcgtaaatatttcggtacagacggcattcgtggcaaagtcggtgaagcacccatcacccccgatttcgtcctgaagctgggctgggccgcaggtaaagtgctggcgcgccacggttcaaagaagatcatcatcggtaaagatacccgtatctctggctatatgctggagtccgcgctggaagctggtctcgccgcagcaggcctgacggccgcctttaccggcccgatgccgacaccagccatcgcctatctgacccgtactttccgcgcagaggcgggcattgtgatttcagcgtcacataacccgtttgacgacaacggaattaaattcttctcatccgagggcaccaaactgcccgatgacgtcgaagaggcgattgagctggagatggaaaagccgattacctgcgttgaatcagcgcagctaggtcgtgccagccgtattgtggatgcagcagggcgttacattgagttctgcaaagggactttccccagcgaaactgaatctgaatggcctgaaaattgtggtcgactgcgccaatggcgccacctaccacattgcgccgaatgtattgcgtgaactgggcgcgacggtgattgctatcggtgtccagccagacggcatgaacatcaacaaagagtgcggtgccaccgatctcaaactgctgcagcagcgcgtgctggcggagaaggccgatatcggcctggcctacgacggtgacggcgatcgcatcatgatgattgaccatctgggtgacaaagttgatggcgaccagatcctctacatcattgcgcgtgaggccctgcgtcagggacagttacgcggtggcgtggtgggtacgctgatgagtaacatggggctggagttagcgctgaaacagcttggcattccgtttacccgtgccaaagtcggtgaccgttatgtactggaaaagatgcaggagaagggctggcgtctcggtgcagagaactccggtcatgtgatcctgctggataaaaccacaaccggtgacggtatcgttgcaagtttgcaagtgctcactgcgatggtgcgtaaccacatgagcctgcacgatctctgtagtggcatgaagatgctgccgcaggtcctggttaacgtacgctttgcgggcgaacatgatcctcttcagagtgacgcggtaaaagctgtcacggctgaagtagaaaaagcgctggcgggtcgcggacgcgtttctgctgcgtaaatcaggtactgagccactgattcgtgtcatggtcgaaggcgaaaatgaggcgcaggtcaccgaactggcgaatcgcatcgccgaccaggtcaaggccgtttaaaacagtaacaggcggtctgcagggtgctgaactgcctgtaaaatcaccgggatggcgtttttttctgcaaacagtatgggtagtaaaaattgcacttgcagagatatgcgcctttggttagtattcacacccgcttctgatgggtgatgacgagactccccatcaatactggttgaagctttaactgtacgattaccgtgcaaggaacaggatgatatgtaccaagctcttttagtagttttccttattgtagctatcgccctcgtgggtatgatcatgctgcagcaaggcaaaggcgctgatatgggagcctcattcggtgcaggcgcatccggtacggtgtttggttcttcgggctcaggtaatttcatgactcgtactactggcatcttagcagcgctgtttttcatcatcagcctggttctgggtaatctgaacagcaataaagcgtctaaaggaagcgagtgggaaaatctttctgcgccggcgcagtcttctcaacagactgaaaagccagctcaaccggtaacgccgggcagcgatattcctaagtaaggtcgtcagcacaacgaatcgttgtggtcagtgcagtgccgtggtggtggaattggtagacacgctaccttgaggtggtagtgcccgattgggcttacgggttcaagtcccgtcctcggtaccaaatagcagtatcccttgcattttatgcaggtctggcgtattattcgccacgttttcggacgcggggtggagcagcctggtagctcgtcgggctcataacccgaaggtcgtcggttcaaatccggcccccgcaaccaattttccctttgagttctttttcaaatatactgtatgcatcgacggacgcattcacggttattttttgaaagaaaattctttggatggagtccgggccgcattgcggcatacagggtccagtgattaaaagccccgaatattcggggttttttgttattagcgaatcgtaatactgggctataggccctttttttatgtcttgggggtgggcttgtccacattagagcaaaaattgacagagttggtatcggctcccgtagaagcgctgggttacgaaactggttggaattgaattcgttcgtagtcgcacatctatcctgcgcatctatattgatagtgaagatggcatcaatgtcgatgattgcgccgatgtcagccaccaggtaagtgcggtaatggatgttgaagatcccattacggtcccttacaacctagaagtctcttcaccgggactcgatcgtcctctgttcactgcagaacactacacccgctttatgggtgaagaagtgagtctggtgttgcgtatggccgtgcaaaaccgccgtaaatggcagggaaccattaagtcagttgatggcgagatgatcacggtgcacgttgagggtagcgatgaagtgttcgcactgagtaatattcagaaagcgaacctggtcccccacttttaaaagtccggattgaggctaaccaggatgaacaaagagatcttagctgttgtagaagccgtttctaacgaaaaagccctgccgcgtgagaaaatcttcgaagcgctggagagcgcgctggcgactgcgaccaagaaaaagtacgagcaggaaattgaggtacgcgtcagcattgatcgccgcagtggcgatttcgatactttccgccgctgggaaatcgtagaagaggtgacacagccgacgcgcgagatcacgctggatgcggcccgcttcgaagatgaagcattcaatctgggcgaatatgtcgaagatcagattgaatcggtcacctttgaccgtatcaccacccagaccgctaagcaggttatcgtgcaaaaagtgcgcgaagctgagcgcgcaatggtggttgatcagttccgtgagcaggaaggcgaaattatcacgggcgtggtgaagaaagttaaccgcgacaacatctccctcgacttaggcagcaatgccgaagcggtgattctgcgcgaagatatgctgccgcgtgaaaacttccgtccaggcgaccgtattcgtggcgtactctactctgtacgtccggaagcgcgtggcgcgcaactgttcgtgacgcgttctaaaccagaaatgctgattgaactgttccgcatcgaggtgccagaaattggcgaagaactgattgaaattaaagccgctgctcgtgatccgggttcgcgcgctaaaattgcagtcaaaaccaacgacaaacgtattgatccggtgggtgcctgtgtgggcatgcgcggcgcgcgtgttcaggcagtttccagtgaaactgggcggcgagcgtatcgatatcgtgctgtgggacgataacccggcgcagtttgttattaacgccatggctccggccgatgtggcgtcaatcgtggttgatgaagataaccacaccatggatatcgccgtagaagctggcaatctggctcaggcgatcggccgtaacggccaaaacgtgcgtctcgcttcacagctgagtggctgggagctgaacgtgatgaccgtcgatgatctgcaggctaagcatcaggctgaagcacatgcagcgatcgatatgttcactaaacatctcgacatcgacgaagagttcgccaccgtactggtggaagagggcttctcctcgctggaagagctggcatacgtgccaatcaacgagctgctggaagtcgacggcctcgacgaagagaccattgaagccctgcgtgaacgagcaaaaaatgcgttaaccaccctggcactggcgaaagaagagagtcttggaaatcaggagcccgctgaggatcttctgaatcttgaaggcctcgatcgtgcgctggcgttccgcctggcgtcgaaaggcgtttgcacgctggaagatctcgctgagcaaggtgttgacgatctgacggatattgaaggcatgtctgatgaacaagccggcgcgctgattatggccgcacgtaatatctgctggttcggcgatgacgcgtaataacaggaaggaacagcatgacagatgtaaccgtaaaatcgctggccgcagaaattcagactccggtcgatcgcctggtacagcaatttgctgatgcggggatccctaagtctgaaaatgacgcggtgacccagcaagagaaagaaaccttactatctcatctgaaccgtgaacacggtcaggtcggttcagctaagctgacgctgcagcgtaaaacgcgcagcaccttgaatattccaggcaccgggggtaaaagtaagtcggtgcaaattgaagtccgcaaaaagcgtacctatgtgaagggtgatgcagaggctgagcaagctcaggcagaagctgaagccgaggcgcagcgtgaagcggaagagcaggcgcaacgcgaggctgaagaaaaagcccgtcgcgaagctgaacagaaagcgcaacgtgaagccgaagataaagccaggcgcgaagccgctgacaaggccaaacgtgcagcagcggaaaatgaaaaagtgacaaatcaacctaccgacgaagtgaccagggctgcgcaatcagacaaagcccgtcgcgaagctgaagctgccgaaactgaagcgtaaagctgaagaagaagcccgccgtaagcttgaagaggctgcccgcctcgtagcagaagaagcccgccgtctggctgaagagaaatcagctgaatgggaaaaaccggaagaagaggataaaggcgactatcacgtcaccacttcgacccatgcccgtcaggcggaagacgaaaacgaccgtcaggttgaagcaggtcgtgcgcgtgcgcgtactactgctaaagctgcgcgtccggcgaaaaaaggcaacaaacactctgaagccaaaactgaccgtgaagaagcgcgtgcgcaggttcgtggtggtaaaggcggcaagcatcgcaaacctagcgcactgcagcagggcttcaacaagccagcgcaggccgttaaccgcgatgttgtgattggcgaaactatcaccgtagccgaactggctaacaaaatggcggtgaaaggttctctggtcattaaagcgatgatgagaatgggcgccatggcgaccattaaccaggtcatcgaccaggaaactgcacagctcgttgccgaagagatgggccacaaagtgaccctgcgtcgtgagaacgagctggaagaagcggtaatggacgatcgtgatactgatgctgcgcaggagtctcgtgctccggttgtcaccatcatgggccacgtcgaccacggtaaaacgtccctgctggactatatccgttccactaaaatcgcctctggcgaagcgggcggtattactcagcacatcggtgcttaccacgttgaaaccgacaacggtatggttaccttcctggataccccgggccacgccgcgtttaccgcgatgcgtgcacgtggtgcgcaggcgaccgatatcgttatcctggtggttgcagcagacgatggcgtgatgccacagactgtcgaagctattcagcacgccaaagccgctaaagtgccggttgtggttgcagtgaacaagtgcgataagccagaagcggatccggatcgtgttaaaaacgaactgactcagtacggtatcattccggaagagtggggcggcgaaaacatgttcgttaatgtctctgcgaaagcgggtaccggcattgatgacctgttaaacgctatcctgctgcaggcggaagtgctggaactcaccgctatccgtgaaggtatggcgagcggcgtggtgatcgaatcgttcctcgacaaaggtcgtggtccggttgccaccgtgctggtacgtgaaggtacgctgaacaaaggcgacatcgttctttgtggtttcgaatatggccgcgttcgtgcaatgcgtgacgaaactgggtcgcgaagtcatggaagcgggtccatctatcccggttgagattctgggcctgtccggcgtgccggctgcgggtgatgaagcgaccgtggtacgtgacgagaagaaagcacgtgaagttgcgctctatcgtcagggcaaattccgcgaagttaaactggctcgccagcagaaatctaagctcgagaacatgtttgctaacatgaccgaaggcgaagtgtctgaactgaacatcgttctgaaagctgacgttcagggttctgtggaagcaatctccgactccctgcagaaactctccaccgacgaagtgaaggtgaagattgtgggttcaggcgtgggcgggattaccgaaaccgatgcgaccctggctgctgcctctaacgccatcctccttggctttaacgttcgtgccgatgcctctgcgcgtcgcgtcattgacgcagaaagcctggatctgcgctactactctgtcatctataacctgattgacgaagttaaagcggcgatgagcggcatgctggcaccagagtacaaacagcagatcatcggtctggctgcggtgcgcgatgtgttcaaatcaccgaagtttggcgcgattgccggttgtatggtgacggaaggtaacatcaagcgtcacaatccaatccgtgtcctgcgtgacaacgtggtaatttacgaaggcgagctggaatctctgcgtcgctttaaagatgacgtcaacgaagtgcgtaacggcatggagtgcggtatcggcgtgaagaactacaacgacgttcgcgttggcgatatgatcgaagtgtttgaaatcatcgaaattaaacgcaccatcgagtaatagactgctgatgtgttgcaatttgggaggcctctggcctcccgaattatttgggagaaataatgatggcgaaagaatttggtcgcccgcagcgcgtttcacaagagctgcaaaaagagattgcgatgatcctgcagcgtgagatcaaagatccacgtcttggcatgatggtcaccgtatcaggcgttgaagtctcacgcgatctcgcttacgcaaaagtgttcgtgactttcctcaacgacaaagatgaagaagcgattaaacatggcctgaaagcgctgaaagaagcgtcaggttatatccgcattctgctgggcaaagcgatgcgtctgcgtatcgtgcctgagctgactttcttctacgacaactcgttagtcgaagggatgcgcatgtccaatctcgtcaccagcgtcgtgaagaacgatactgagcgccgtggtccggacgccactggcgatgacgaggaggcgtaatgagtcgtccgcgtcgtcgcggtcgcgacgtccatggcgtgttgttgctggataagccacaaggcgtctcgtcgaatgatgtcctgcagaaagtgaagcgtatctttaacgcgaatcgcgcaggacataccggcgcgctggatcctctggctaccggcatgttgccgatctgcctgggtgaagcgactaagttttcgcagtatctgctcgattccgataaacgctatcgcgtgattgcccgactgggcgagcggaccgacacgtcagacgccgatggcaacatcgtgcagacgcgtccggtcagcttcactcaggccgatctggacagtgctctggagagcttccgcggcgaaacgctgcaggtgccttcgatgttttcggcactgaagcatcagggacgcccgctgtatgaatatgcgcgtcagggcattgagattgcgcgtgaaccgcgtccgatcactgtctatgaactgcaatttattcgctggcaggataacgagctggagctggaaattcactgctccaaaggcacctatatccgcaccatcatcgatgacctgggcgaaaagctgggatgcggtgcgcacgtgattatgctgcgtcgcgtttcaggttgcccgttatccgtatgaaaggatggtgacgctggaacagctcaacaccctgctgacggaagccacagaagccggcattccactggaaacgcagctcgatccgctgttgttgccaatggacagccccgcctctgatttccctgaagtgaatatcccgcctgccgtagcagatttcttccgccagggacagccggtacaggccagcaatgcgcctgcccaggggctggtaagggtatcggaaggcgaagcgcgtaagtttatcggtatggcagaaattgccgacgatggccggcttgcgccacgtcgtttagtggttgagtatcaggattgagccaggcgttcacttttcgctgatggggcatttgcgttgctatcgggcgcagagtagaatagcgcggctttaaagcgggatgctgaattagagatcggcacccatacattcatttattactggagtttattatgtctctaagcgtagaagctaaagcagagatcgttgctaaatatggccgtggtgctaacgacagcggttcaactgaagttcaggttgccctgttgaccgcgcagattacccatctgcagggtcacttctctgagcacaaaaaagaccaccacagccgccgcggtctgctgcgcatggtatctcagcgtcgtaagctgctggactacctgaagcgtaaagacgttgcacgctacagcagcctgatcgaaagtctcggtctgcgtcgctaagtctgaagaatctgatcgtcggggcattatgcgggcttttgcactctgtgcagcttacgatcagatttgtgcgagtttcgtgaagagggggcctttatggccccttttttcgagcaatcggcagcaatccggaccaaactgatgtattgttgcttagtgtgatctttagtttgcagaatttcgcgcggctaatgagaggctttaccgcaggggcggtcgagggttgtcattagtcgcgaggatgcaactgaagattggtaatcaatggcgggctacagatagccatgccccgaagttaaggactttgattttgctgaatccgatcgtacgcaaattccaatatggtcaacataccgtcacgctggaaaccggcatgatggctcgccaggcgtcagccgctgttatggtgagcatggacgatactgcagtattcgtcactgtagtaggtcagaaaaaatctaaaccaggtcaggatttcttcccactgaccgtgaactatcaggagcgtacttacgctgctggtcgtatcccaggcagcttcttccgtcgtgaaggccgtccaagcgaaggcgaaaccctgatttcgcgtctgattgaccgcccgattcgtccgctgttcccggaaggttttgttaacgaagttcaggttatcgccactgttgtctctgtgaacccacaggttcatccggacatcgttgccatgatcggtgcttctgctgcactggcgctttctggtctgccgttcaatggcccaattggttctgcgcgtgttggttacatcaacgatcaatatgtcctgaacccaaccgcagatgagctgaaacagtctcgtctggatctggtggttgccggtacgcagaatgccgttctgatggttgaatctgaagctgagatcctgtcagaagagcagatgctgggcgccgtggtctttggtcacgaccagcagcagattgttatcgaaaacatcaatgccctggttgctgaagcgggcaaaccacgctgggactggcagccagaagcggccaataccgcactgatttctcgcgttgctgccctggcagaagcgcgcatcagcgatgcttaccgcatcactgacaagcaggagcgttacacccaggttggcgtcattaaagacgaaaccatcgctgcgctgctggctgaagatgaaacgctggatggttcagaaatcggcgacatcgtgcatagccttgaaaaaaccgtcgttcgtactcgcatcctgaatggcgagccacgcatcgatggtcgtgaaaaagatatgatccgtggtctggacgtgcgtactggcgtattgccacgtacacacggttcatcactgttcacccgtggtgagacgcaggcactggttactgcaacgctgggtacgacccgcgatgcgcagaaaccttgatgagctgatgggcgaacgtaccgacagcttcctgttccattacaacttccctccatactctgtcggcgaaaccggcatggtaggttcgccgaagcgtcgtgagattggtcacggtcgtctggcgaagcgcggcgtgttagcggtaatgcctaaagcggaagatttcccttacaccattcgtgttgtttctgaaatcaccgaatctaacggctcttcttcaatggcctctgtctgcggtgcctcactggcgctgatggatgcaggcgtgccaatcaaagccgccgttgccggtatcgcaatgggtctggtgaaagaagatgagaagtttgttgttctgtctgacatcctgggcgatgaagatcatctgggcgacatggacttcaaagtagccggtagccgtgaaggtatcaccgcgctgcagatggacatcaaaatcgaaggcatcacgcgtgaaatcatgcaggaagcgctgaaccaggcccgtggtgcacgtctgcacattctgggcgttatggaacaggctatcagcacaccgcgtactgagatttctgaattcgcaccacgcatttacaccatcaaaatcagctctgacaagatcaaagatgtgatcggtaaaggcggctcagtgattcgtgcactgaccgaagagaccggcacaacgattgaaattgaagatgacggcaccgtgaaaatcgctgcgaccgatggtctgaaagcgaaagaagcgattcgtcgtatcgaagagattaccgcagagatcgaagtgggccgcgtttacagtggtaaagtgacccgtatcgttgacttcggcgccttcgttgcaatcggtggtggtaaagaaggtctggttcacatttcacaaatcgctgataagcgcgttgagaaagtgactgactatctgcagatgggtcaggaagtaccggttaaggtgatggaagttgatcgccagggccgtgtacgtctgagcatcaaagaagcgacagaatctaagccgcaggctgaagaagctgtcacggtgaccacgcctgacgctgctgaataagtcgttgctgatttgcccctctctgcctggcagagaggggcgtttgtatcatcgcgagggcgggaatccttgtgcacagcaggcggatgacaggatggttatcccaatgtttgtattcgggagtgggaaatgaagccttttctgcgctggtgttttgttgcgacagctttgacgctggcaggatgcagcaactccaattggcgtaagaacgaagtttcttgcagtgcctttacagcccacactgcagcaggaagtgatactggcgcgcatggaacaaattcttgccagtcgcgctctcaccgatgatgaacgcgcacagctgttatatgagcgcggagtgttgtatgatagtttaggtctgcgggcattagcgcggaacgatttttcgcaagcgctgtctataagaccagatatgcccgaagtgtttaactacttaggcatatatttaacgcaggcgggcaactttgatgccgcctatgaagcgtttgattctgtacttgagcttgatccaacttacaactatgcgcatttaaaccgtggtatcgccctctattacggcggtcgatacaagttagcgcaagatgatctgctggcgttttatcaagacgatcctaacgatcctttccgcagtttgtggctctatctcgttgaacgtgagatggatgtcgacaaggcaaaagtcgcgcttcaacagcgtcacgacaaagcggtcagagatcaatggggatggaatattgtcgagtttctaccttggagatatcaacgagaaaacgttgatggaaagtctcaaggcggacgcaacggataacacctcgctcgctgaacatctcagtgaaaccaacttctatttaggtaagtactacctaagtctgggggagaaggacgacgcgaaagcgttgttcaaactggcggtggccaacaacgtcaataactttgttgaacaccgatacgcattgttggaactggcgcaactcggccaggcacaagacgatttatcagaatctgaccagcaatagctgacgaacttaatttgcctgtaaaacctgttaagtcatcatcttaaaggatgaaggcttttctgttcgtcaaaacttttaatttgagccggttcacactttttgatgaaaatgactgaaagttttcacgacgagttatgtagactggccgccgcaatctaagaggcacgtgtactacatgactgatattcaaaccacttttgctgaccttggcctgaacgccgacatccttgaatcactgaatggcatgggctacgtaaagccatccccaatccaggctgagtgtattcctcacctgctggcgggccgtgacgtgttaggcatggcgcagaccgggagtggtaaaaccgcggcgttctctctgccgctgttacacaacattgatcctactgttaaagcgccacaaatcctggtgctggcacctacccgcgaactggcggtacaggttgctgaagcagttaccgaattctctaaacacatgcgtggcctgaacgtggttgccctttacggcggccagcgttatgacgtgcagctgcgcgcactgcgtcagggaccacaggttgttgtgggtacgcctggccgtctgcttgaccacctgaaacgcggcacgttagacctttctaacctgcgtggcctggtgctggatgaagcagacgaaatgctgcgcatgggcttcatcgaagacgttgaaaccatcatggcgcaaattccagccgatcatcagaccgcgctgttctctgcaaccatgccggaagcgattcgtcgtatcaccaaacgcttcatgaaagatccacaggaagtgcgtattcagtcaagcctgaccacgcgtcctgatatcagccagagctactggaccgcttacggtcgtaaaacagacgcactggttcgcttcctggaagcagaagactttgatgctgccatcatcttcgtgcgtaccaaaaacgcaaccatggaagtggcagaagcgctggaacgtagtggctataacagcgccgcgctgaacggtgacatgaaccaggctctgcgtgagcagacgcttgagcgcctgaaagatggtcgtctcgacattctgattgcaaccgacgttgcggcccgtggcctggacgttgagcgcatcagcctggttgttaactacgacatcccgatggactcagaatcttacgttcaccgtatcggccgtaccggtcgtgctggtcgtgctggccgtgcgctgctgttcgttgagaaccgcgaacgccgtctgctgcgtaacatcgaacgtaccatgaagctgaccattcctgaggtagaactgcctaacgcagaactgctgggtgagcgtcgtctggctaagtttgctgctaaagttcagcagcagctggaaagcagcgatctggatcagtaccgtgctctgctggctaaaatgcagccagaagacgaaatggatctggaaacactggcagccgcactgctgaagatggcacagggcgaacgtcctctgattctgccaccagaagcaccgcgtccggcacgtcgcgaataccgcgatcgtgacgagcgtgatggccgtcgtgacagccgtgaagcgcgtggcgattctcgtgctccgcgtgaaaaccgcgaaagccgtgatggcgatcgtccacgtcgcgaacgtcgtgacgttggcgaaatgcagctgtaccgcatcgaagtaggccgcgatgatggtgttgaagttcgtcacatcgttggcgctatcgctaacgaaggcgacatcagcagccgttacatcggtaacatcaagctgttcggtacccactcgactatcgagctgccgaaaggcatgccaggcgatgtgctgcagcactttacccgtacccgtattctgaacaagccgatgaatatgcagttactgggtgatgcacagccgaacgaaggccgtggtgaccgtcgtccagctggtgctggcggtgagcgtcgcagcggtccaggtgcaggcggtccgggcgcagctaaccgtgaaggtggtcgtcgcttctcttctgaacgccgtgaaggtggtcgtgaaggcggcggacgtactttcaaccgtgaaggtagccgtggtccacgtcgtgaagagggcgcagccgccgctccacgtcgtcgtgatgcataacgacttagcgtcgtaacaaaaagggaagccaatggcttccctttttttatgcctgtcaggcaccgccgctgatcatcacacgctcgccgctgacccaggcggactcttcagaggccagaaacagcgcaacctgcgccacatcttccggcagaccaaagcgtcccagcggcgtggctgccagcagttgcgctttgagctgtgggctcatcctcttcgcggccagtaatccctccgtcagaatcatgcctggtgccagggcgttaacccggatgttctttgcgcccagctcgcgcgccagtccctgggtcagggtatccactgcgcctttggttgccgcccagagcacggaacctggcgtgctgtttttactgttcagggcgctgagattaataatgctgccgccgtgcgccgggaagtgatgaatcgcctgctgacagaccatcagcgtacccagcaggttaacgttaatctgctgctgcatctcctccagcgtcagcgccgcaaactcgccgtgatgaaagctgcccgcattgttcaccacaatgtcgggcgcgccgaagcactctgcggtggtggcgaagagccgttccacatcccgtaggagagagatatctgcctgtaccgccacggcttcactgcccagggtgacgatatcgctgaccacgtcagccgctcccacttcatcctgacgataattgaccacgacgcgggcgccagccgcggcaaaagcgatggcaatcgccgcaccaatgccttttgaggcgcctgttaccagcgcaattttattctgcagtgccttcattatgttgttctccgccgtaatgattgcgtcgaaagactatgcgcgctggtgccgaaaagcgggtagtgcaatcctgcaagcttcttgcacgatcctgcaaaagtaacgcaacgggccaggtattccgctcagcgtcaggtaatatcagcacagatagcgggaggggagaacacagtgacagagagtgagaagtggcaggggctggcgcagttaattgcccgtcatgctccggaggatgggcggcattccagcgccatagattgcctgttttttggccgggtttcagcaccgactgagccaatgcactttgctcaatgggccagttttgccctggtggcacagggcggtaaggcgctgcatatcggtgatgaggtgctgcactatggtccgggcgatctgctgctggtgacgctggatatgccggtgcgcgcctgcgtcaccgtcgccacgccggaaaaacccaatctggggattggtattgccatcaatgaatcccggctgatgcgctacctcgaacagtttcccccgacgctgccgctggtgacaccagacagtgaaacgcggcgtcaccgtgcataaggtctcacctttgctggtggatgcggttatccggctggtacgcctgcttgaccatcctgaggacattgaggcgctggccccgctcattgagcaggagattttctatcggctgctgaccgggccggaaggttcgcgcatcctgaatatggcgctggctgagcggccgggcaaccgggtcgcgcaggctgcccgctggctgcgggaaaattttcatcagccgctgaagatcgatcggctcgccagcagtgtcggcatgagcatctcttcgctgcatcatcacttcaaagccgtgacggctatgacgccgatgcaataccagaaacaactgcggctgaatgaggcgcgacgtttgatgatggtggaaaagctggatgccggtacggcaggctatcgggtggggtatcagagcgcgtcacagttcagccgggagtatcgccgcctgtatgggcaatctccggccagggatagtcgtcaactggcggtgagcccggacagattgcgcccaccgcagaactgattacaggctgttagccgcttccatcgcaatggcgaaggagcgcaggcgcgcttcggaatcaaaaatctggccattgaccataatttcatccgcctgggtttcacgcatcagcgaggccagcccatgacgcactttgtccgtatcgccgaccagcgacatgctgagcgcctgctgtacgccatactgttctgatggcgaccagaggttatccatgttttcaaccggtgccggtaacgggcccggtttgccgcggcgcaggttgataaactgctgctgctgcgaggtaaacaggaagcgcgcatcacgctcactgtctgcggcgatcacgttaatgcagaccatggcataaggcttgtcgagacgcgccgatggctggaagttttcgcggtagacgtgcagcgcctgaaagagctggtcaggggcaaaatgggaggcaaacgcaaacggcaggcccattttcgctgaaagctgtgcgctgtagagactggagccgagcagccagaccggaatctgcaggcccagaccaggtaccggctgcactggcggctgcgcatccgcttcggcatcgaaccagctaatcagttcagccacatcctcggggaacgtgtcgatgtgcatgttggcctgatgacggcgcagtgccatcatggtgcgctggtcagaaacctggcgcgcgacctaagccgagatcgatacggccaggatagagagaggccagcgtaccaaactgctcggcgatcaccagcggcgcatggttaggcaacataatgccgccggagcccagcttcagagtctcggtattcgccgccagatagccaatcagcacggaggtggctgcgctggcaatccccgtcatgttgtgatgttcagccagccagtagcgttgatagcccagtttttcagcctgacgcgccagcgccagcgaattatggaacgcatcccgagcggtcgcgccctgtggaatcggcgcgagatccagcacggacaggcgaagaggttttttatcagacatgactactcccgttgtatggcgcaggcgttaagttaaggcctgcaccatttagtattacgcatcattccttatattaaaactgctaacctcagcaggaatatagccggtatgtgcttttattcaggatgccagcgtcatgcccgccagtttgcgccagtaaccgttacaatcactgccttttgcgaccattagcggagcctgaccgttttcattggcgcggaaacggtcgatctctgccagcgtcgtcacatcctgcggtgagagccgtatgcaatcgacctggccgtgcataccagccagatcgttacccaggttatagcagtagccgctcatggtctgaatgccattgaggacgaacacctgctgcccctcctgggagttgacgcgccggcctgtcggatagttgatacagcaggtttcgcagtcatctttcgcgcggttttccgagcgggcggtgaagcagcgcgctgagagcgccagcggcagatgaccgtagcccagcacctccacctcaaactgctgccggataccccgcgtctcgcactgctccagcagctgtagcagccagtcacgtgacatctccaccggcatacaccagcgcgtcatgccctctttgaccagcagctgcagcgtgtcggcgttataaacattgagcgtcggacccgcgacaaagggcagatgacgctcagcggccatgttaaccgtgccgatatcattggcttcaatcaggaactcaccgtttctctacgtaacgctgcagctctttcagctcagagggcgattgcagcagcgccagcgtgctcagcaccacctgtttgccgctggccgcgagttcacgagccagcgccatccagcgggcatagggcgtggcgcgacgtttactgcacaccgcttcgccgaggtagataatatccgcgctactgcgggcagcctgctggtaaaaatctcccagcgtatcggtcggccagtaccagagcaccggcccaagggcatattgcatcatgactccttattgccattcacggtgataagcacccagcgtggtttgcgaaccttctgagagatcgcccagcgtctgcatccactgtggtgcgacttcaaactgttccggctgcgccttgcagcgatcaattgcctgacgccagacgcgcgccacgtcagcgacataggcagggctgcgctgacggccttcgattttcaccgaggcgatgcctgcccgcagtagttccggcagcagctccagcgtgttcagactggtgggctcctcgagcacgtgataacgcttgtcgttaaccatatagcgtcctttgcaaagtgtcggataacccgcgctttcgtccggggcgtagcgatcgatcaacacttcattaagacgtgactccatgccctgcggcgtctgctgccagcgcacaaacttagccggggagcaggcaccggcgctgttaggcgattcaccggtcagccaggaagagaggtagcagcggccttccgccatgatgcacaggctgccaaaggcgaatacctccagcggcaccggtgtgctgcgagccagctgtttaacctggtgaatcgacaggacgcgcggcagcaccacacgctgcagattgaagtggcgatggtaaaagcgaatcgcctccagattggttgccgaagcctgtacagaaagatgacgttcaacctggggatagcgcgtcgcggcatactccagcgtggcgatatccgccaggatcagcgcgtcagctccgttttgcgccgccacatcaatcgcccgctgccagcgacccatgccatccggatgggcaaaggtgttgatcgcaacatgcagtttgcgacgatgctgatgaagatagcgcgcggcttcagccagttttttatcggtgaaattcagacccgcaaaatgacgggcattggtgtcatctttcagccccacatacaccgcatcagcgccattctctacagcggtgcgcactgcgggtaagtttcctgccgggcagagcagttccatagatattcctctcaacatgcagatgggcgtcgagtctaggcatctggtccgggcagcgtgttgatttggggcagtgaaattcaaattcatccgcccggcggcgctttttttacctgcatggcagcggtttttattgatctcagaggaggcgcgcagaaaaggatatggcaatatacgtaaaattttctgaagggagtgacgaaagtgttagagcggatacatgcccattgtgtgaaaaacggtcctaaaatcttagggttacccgctgcgttcaccccattcccggtcaaaaagttgcttctgcaacaactcttaaactggcaatttcgtcatgctttggctgaaggtgagttagactttctggatggtcgcctgctgggtattgaaattgccgatctcaatctgcaatggataaccacgctgcaggacggccgactggcggtattgcaacagtccgaagcggatgtctggtttcggggcaatgccaatgatctgttgctggtggcagcacgtaaagcagatcccgacatgctgttctttcaacgccggctggtgattgaaggtgacactgaactgggacttgaggtgaagaacgtaatggatgctattgaacccgaggctatgcccaccgcgttacgcacggcaattgagcagatggcggcatttgtcgacgccggcatgaaacaggacgcgaaggccgctcaggcgcgcgcaggtgctacatgttgattcgtagtgaaattggcgtggatgccgcaggcatcgacgcgctgctcagacgctgcttcagtacctctgcagaggcggaaactgactcaggcgctgcgtgaagatggcttgctgaccttaggcgtggtcgcgacggatgacgagggacaggtgctgggttatgccgcattcagtccggtcagcgttcagggtgaagatcgcggctgggttgggctggcaccgctggccgtcgatgagacgctgcgcggtcagggtattgccagcaagctgatctatgaggggctggatacgctcaatgaatttggctacagcgcggtagtggtgctgggcgatccggcgctgttcaaccgttttggttttgaaccggcggcacgccacggcctgcgcagccgctggccgggtacagaggcaacgttccaggtctaccgtctggccgataatgcgtatgacggggcggaagggcagatcgactacgccgaaccctttaatcgccagccgtaatacccagccagctcaccagacagccgggctggcccgccaccagcagtaatttctgctggcgggtcagttgcttgacctgatactccagcctggaggcgctggcgcgatcgcccgcgtcacagtgaaacaccaggtccagcggccctttgccgcgcagcgcgcgggcgccgcgtccgctctggtgctgagcgacccggcgcaccacatccgtggtgataccggtgtacaggctccctttcgccgtacggacgatgtagagttgccactgctgactcatcgcaatcatttcccaaaaaaaggtgccgggcagtttagcgcgcttcactctccggtgcaccgccaggagtttatcttgtccgatcacgcccatctggttcgctatctgagaaagcagcatgtgctttcactctgctgtaccgccgacgatcaactgtggtgcgctaactgctactacgtctttgacgagacgcgcatggtcttctggatcatgacggaacccgatacccgccacggtgagttaatggtgcagaatccgcaggttgcgggcaccgtcaatggccagcccagaagtgtgctgctgattaaaggggtgcagtatcgtggccatgccaaacggctggaggagacaacagagcagatcgccagagccgcttaccagaaacgttttccggtctcacgcaaagtgtcggcaccgctgtgggagattgtgctggatgaagtgaagatgacggataatgcgctgggattcggcaagaaaattgcctggcagcgggagcaatagaaacgcccttttcagcagaaaagggcgtcgcggcttacagcgcttcgaggatccgcagggattcacgattaaaggccggtaaatcggccggggtgcggctggtgaccagcttatcgccgtctaccaccacttccttatcatggaagtcggcaccggcattgatcaggtcaatggcaacggccttaacggtagtcatcttgcgaccgcgcacgccgttagcgctaatcagcagctgtggcccgtggcagatggcaaaaattggcttgccgctggcgacaaactctttggtaaaagcgacaaaacgatcgtcgccgcgcagggcatcgggcgagtggccgccaggcaggagcagggcgtcaaattcagccgggctgacatcatcaatgctgcgatcgatggtcacttccgcttcgcctttcttgcctttaacgacattaccggcttgtttctcaatggtaaccacctcaaaaccagcgcgtttgtaaacttccgcaggtgaggtaaattctgagtcttcaaattcatcggtaattaaaaccgccactttcttgctcattttttcctccttcagcatgtggagcgcgagacgcgctttccggataacgctataagcctggtcgctgagagtgagaaacgcaagccagcccgttaagatcagctatcttttaaccagtcagcagtgaaataaggatgaatctgagatgaatcgcgtattactgaccggtgccaccggcttagtcgggtcgcatctgctgcgcttactgattgaagatccacgcgtcgatgagatcatcgcgccaacccgtcggccactacccgccatggacaaggtggtgaatccggttgaggccgatctcaccgatgtcctcgggccgctgcaaagttcgctggacacggtgttctgctgcctgggcaccacgcgtaagcaggcgggcagtaaacaggcttttatccacgttgattacaccctggtggtggacagcgggttaagcggattacgtctgggggcgaagcagatgctggtggtcagcgcgcacggggccagtcgtcactcaccgtttttatataatcgcgtcaaaggcgaaatggagaatgcgctgcgccatcagggctggccgcgcctgacgctggtgcggccttcattgctgctaggagatcgcgtgcagaagcgccggggtgaaagcctggcgggaccgctgttttcgctgctgccgggcaactggcgggcggtcagcgcgcacgacgtggcacgctgtctgcaccagcaggcttttacgccggggggcgagagcgtcaatatcattgagtctggcgaaatcccgcgccactcagcgtaactgccagataatctgattacggctgccgcgccattgcagcgtggcatccttctcctcttcgacaaaacgcccatcgatcagcacgtcgagatagaccagcacagcgcgctgcgccgcattcagctcctgcatccggtaaccggtccagagccagatatctttaccgggacacgtctgtcgcacccgtttcaccagacggcgaatgtgcggcacgttatgcggatgcagcggatcgccgccgctcagcgacaatccctggcgcggaatgcgggtgtcctgcaaatccgccagcagttgctcctccatcgcaagcgtaaagggcacgccggaatcaagccgccaggtgctctggttgtagcagccgcgacactgatgttcgcaaccagcgacaaacagcgtgcagcgggtgccggggccattaacgatatccacatcatagtagcgatggatatgcatcatcccagtggcccttcagacagatgcttcacccgacgctgcacttcctgctgtttaccagcattaaagggccgcgcatccgggctgcccagatagccgcagacccgccgggtaacggagacgcgcgccggatcgtggttgccgcacttcggacaggtgaagccgcggctggtacaggtgaactcgccgttgaagccgcactcgtagcactcatcaatcggggtattagtgccgtaatagggcacgcggtcgtagctgtaatcccagacatcctccagcgccttgaggttgtgctgcacattcgggtattcgccgtaacagatgaatccgccattcgccagcggcggatagggcgcttcaaagtcgattttgtcgtaaggattgaccttcttctcaacgtcgagatggaagctgttggtgtagtagcccttgtcggtaacgcctggcaccaggccaaactgcgccgcatcaagacggcagaagcggtcgcacagattctcgcttggcgtgctgtaaaggctgaacccatagcctgtttcagctttccagcgctcggtggcatcgcgcatgtaagcaatgatctctacccctttggcgcgcagggccgcgtcatcgtaaggatgctgatgaccgccgctgagcgcattcagggtttcatgcaggccgatatagcccagcgacagcgacgcgcggccattacggaaaataggaccgacttcatcatccgcattcagccgaaacgccacaggcgccttccatatagaggatgggcgccacgcgtgctttggtcttctccagccgcgccacccgcgtcatcaacgcccgcttagccagcagcagtcgcgcatcgagcagcgtccagaagcgcgcttcatccccgcccgcttccagtgcgatgcgcggcaggttcaggctgattaccccgatattgttgcggccctcatgaatttgctcgccgttctcttcataaacgccaaggaaactacggcagcccattggggttttaaacgagccggtgactttaaccacctgatcgtaattgaggatgtcgggatacatccgcttgctggcgcactccagcgccagttgtttgatatcgtaattaacgtcgcccgcccggcggttgacgccttcgcgaatgctgaacaccagtttagggaacaccgccgtcttgcgatttttacccagtccggccagccggttaagcagaatcgactgctgaatcagccgggccgcccagtccgtccccagaccaaaaccaaaggtgacaaacggcgtctggccgttggcagtgtgcagggtatttacctcatactccagcgactgaaaggcgtcgtagcactctttctccgtacgctggcgcgcatactgctcggcctgcgggatctgccactgctcagcaatcgccagatgccgggcatagctctgctcaacaaacggggccagcacttcatcaatacggttaatggtggtgccgccgtaaatatggctggcgacctgcgcgatgatctgcgccgtcacggcggtggcggtggcgatcgatttaggcggctcgatctcagcattgcccattttgaaaccgttggtcagcatgcctttcagatcgatcagcatgcagttgaacatcgggaagaaaggggagtagtcgagatcgtgatagtggatctcgccgcgctcgtgcgccagcaccacatcgcgcggcaggatctgctgttgtgcgtagtgttttgccacgatcccggccagcagatcgcgctgcgtcgggatcactttgctgtctttgttggcattctcgttcagcagcgccgcattggtctgatcgaccagtccgcgaatggcgtgatgtaactggctctgacgatcgcgggcgacatcgcgatcgtggcggtattcaatgtaggcgcgggccagttgagggtaaggacccgccatcagcgtctcttcaaccgcacactgaatttcacggatatccacttccggacaatcggccagccgcaatgccacgcgctcagcgacctgcgcgcaccaggccgcgtcttctacttcggctgcccgtgccgccgccaccacggcctgctcaatacgctgcgcatcaaagcctgtccggcatccatcacgcttgattaccaccgtcgccatttctctctccataaactacatataggggtcgaaaggattctattcgctacatgtagtgattgctgagaattattgcgatcagatttgacctgaaacaaggaagcctcaacccgctggaaaactctggctgatgtaaaaaatcgggtgctggttcaggtttcctgcaggatccactggcggattggcgagcagcaactttaatcaacgttctgccctgtcaaaacgttgacgttacaaggatgcccgccaatgtggttaccccgtttctctgctcctgctctcggccctcagcccaatcgccctggccagtccgctgccgctgatgccctggccgcaacaggtggaacagcctgccagcggcggcacgcttatcctgacgccgcagctgacgctgcaaatctctggcgatcatctggcgggtgctgaagcgcgctggctggagcggatcagtaatcagaccggctggccgctgttgcccgccacccagccgatagcagcaccgactatccgcatcgtcattgcgaaagcggtggatccgcagccgctgcctgatagcgatgagagctatcagttgcaggtcgatggcgacggcgtcctgttaaccgcgcccagccgtttcggcgcgatgcgcggcatggaaaccctgctgcagctgataaaaaatggcgcacagggcacgaccattccttacgtcaccatccacgatcatccgcgctttccgtggcgcggcgtgctgatcgacacggcgcgtcactttatgccggtggagacgcttaaacgtcagatcgacggcatcgccgccgcgcgcatgaacgtctttcactggcatcttactgacgatcagggctggcgcttcgcctccagccactatccccagctgcagcagaaagccagcgatggcaactattacagccagcagcagatgcgggagatcgtgaaatatgccaccgatcgcggggtgcgtgtggtgccggagctggatatgccgggacatgcttccgcgctggcggtggcgatgccagagctgattagcgcacccggcccctggcagatggagcgcggctggggcgtctttaaaccgctgctcgatcccagcaacgaacaggtttatcaggtgatcgacacgctggtgggtgagatggcggcgatcttccccgatccctggctgcacattggcggcgatgaggtggatccgacacagtggaacgactcgcccgcgattcagcagtttatgcgcgaccacgatctgaaagatgcccatgcgcttcaggcgtatttcaatcagcgggtagagaagatcctggaagcccatcaccgtcagatggtgggctgggatgagattgcccatcccgatctgccgcgcagcattctgatccagtcgtggcagggccaggatgcgctgagcgcgctggcaaaagagaactaccgcggcatcctctccaccggtttctacctcgatcagcctcagcctgccagctatcactaccgcaatgaggtcacgccacagggcctcaacggccaggatcgtctgcggccaggcgatcaggcgcagagctggtcattcaccatgccgcggctgaaaggcagcccggtaaagggcagctttacgctgatacagggagaaccaggctggcgcggttttatcgacttcgatggcaaagcccgccggatggtcggtcagatcaactggctctcgactcagcaggtgcggtttagcgtggatagctggatggggccgttccagccggtgttcacgctgcaacagaacgccctcaaaggttatgcagaggtaggcaacgtgcgttatcccaccagcggtcaacggctggcgcagccgcctgcgggcatcgcgcccgcgctgcccacacctgagcaggtgcagcaaaatctgctgggtggcgaggcggcgctgtgggcggaaaacatcaacagccagattattgataccaaactgtggccgcgcgcctttgtggtggctgagcggttatggtcggcacaggatgtcaccaataccgactcgatgtattcgcggctggcggcgatggatcgctggagcagcgtgtcggtcggaacgctgcaacacgcgcagacggagcagcagatgatgcggctggccagtgggcatgacatcgccccactgcgggtactggccgaggtgctggaaccggcgcaatactacacgcgccagcatctcaagtttcaggcgggccattacgactaccatgaacccctgaaccggctggcagatgtactgcccgctgagagtgaggcggtacgtcagctggagcagcaggtcgccgtgttaatcgccaatcgtaataatccggctgccgcctctgcggttttcgcgcgccgctgcagcgctggcaggctaacaccagcgcggtgctgccgatcattaacgccagtgcaacgctgaagccgctggcacagagcgtgcagcagatcgaggtgctgagcaccatgggcctcgcgctggttaatgcttacgttcgtaatcaggcatttggtgccagtgaagtggcggagatgcgtgcgacactggatgccgccgcagaggtacaggatgaaacagtgattgcgctggtcaggccgctggagacgctgctgcgcgcctttcagtaaacgctgcggccggataaaccggccatagcgtcctcaggccgggccgctgaccgagtggcggcgcaccagggtcgggctgaacatgtgggtcacttccggcagcggctgattgttggccagcgcaagcgcaagctgggccgcctgctgcgccatggtgacaatcggatagcggatggtggtgaggcgcggtcgcacatagcgcgaaaccagcacatcatcgaagccgatcagcgacatctcttccggcacccgaacgccgttatcgctcagcaccgccagcgcgccggcggccattgagtcgttgtagcaggcgacggcggtgaaattcttgccgcgacccagcagttccgtcatcgcctgctcaccgcccacttcatctggttcaccccaggtgaccagccgatcgctgcacggcagaccgtgttctttcagcgcatcgtagtaaccctgcaggcgatcttctgcatcggagatagtgtgggtcgagcagataaaggcgatattctggtggccaagctggatcagatgacgggtcgccagccaggcgccgtagcggtcgtcgagcgcgatacagcgcttttcaaagccttttatcagccggttcagcagcaccatgccaggcacctgcttcatcagcacttccagctctgcatcggggattttcttggcgtgaaccaccagcgccgcgcagcggtgacgcatcagttgttcaatcgcctgccgctctttttgctcattatggtaaccgttaccaatcagcaaaaagttaccggtgtcacctgcaacctcatccacggctttaaccattgcgccaaaaaagggatcggagacgtcaccgacaatcaggccgagcgtttcggtcgattgctgcgccagcgcgcgtgcgttggcgttcgggtgatactgaagctgctccatcgcctgacctacggcctgtcgggagctgtcgctggctttgggagaattattgattacacgggagactgtggcgacagaaacgccagccagtcgcgcaacatcctttatggtagccatgcgttgacctgctttggggaaaacgtttacacatcgcatcagtgttacggaaaagggcggacacatcaacccgacagaatgccagcgtcgtcgcaaaaaggggtaaaaacggtcactgctgcacgtcttctgctgaggcgtcgcaccatgctatgctcaatctcccacctggctaccgtgaaaaacaacgatgaaaaccaaagtgccacatctggcgcactggggcgcctttaccgccgtcactgaaaacgatcgcctgattggctgcgaacccttcttcgccgatgccgatccgtcaccgatgatccacaccattcctgaactggtctattccgacaaacgcattcgtcagccgatggtgcggcgctcgtggctgaagtcacgcgaaaaaagcgatcgtacgctgcgtggccgggaagattttgttgccgtcgactgggaaaccgcgctggatctggtggcggaggagaatcgccgcattcgcgagcgctatggcgcatcgggcattttcaacggttcctacggctggtcatcggccggacgtgttaaccatgcccgcaccctgattcgtcgcttctactttcagggcggcggcggcgttgatcagcagggtaactacagctggggcgccgcgcagttcttcctgccctatgtgattggcacctacatgccgctgaccgggcgcgtcaccgaatggccgcaggtggtggaacatgccgaaatttttgtcgcctttggtgggctggcgctgaaaaacgcccaggtcgcctcggggggcgcagggcagcacagcctgaaaccggcgctgatgcagctggcggccaaaggcacgccggtgatcaatatcagcccgatgcgcgatgactgcccggaatttgtcaacgccgagtggattccgattcgccccaacaccgacgtggcgctgatgctggcgctgggtcatgagatcacccagcgcggcgcggttgacgaagcgtttctcgccagccactgcaccggctggccgcagctgcgcgcctatctgctgggcgaaaccgacggcgtggcgaaaaccgccggctgggccagccgtatcaccggcatcccggccgatcgcattgtacagctggcgcagcagctcacaggcaagcgcagctttattacctgctcctattccgttcagcgcgcccatcgcggcgagcagccttactggatgatgattgcgctgtcgtcgatgctcggccagccaggcctgccaggcgcaggtttctcttttggtcacggttcgatgaacagcgtcggcaacccgcgccaggaaggtccggctccgatgatgagcaccggcccgaatccttccgggctgtcgattccggtggcgcggatcagcgatatgctgctcaatcccggccagccttaccgctttcagggcgaaaccctgcactatcccgacattcacatggtgcactgggcgggcggcaatcctttccatcatcatcagcagctcaaccggctggtagagggctggcagcggcccgatacggtcgtggtgcaggatatcgtctggacgcccgccgcgcagatggcggacatcgtgctgcccgcgaccaccacgctggagcgcaatgacatcggcggctcctcacgcgaccgctttgtgctggcgatgcatcaggcgattaaaccgcagcatcaggcgcgcaacgacttcgatatttttgctgacctggcggagcgcctcggctaccgcgataccttcaccgaagggcgcaacgagatgcagtggatcgcccatctttatcagcagtgtgcgacggcgcatcagcgtaaaggcatcgatttcccgtcgtttgaggagttctggcagcgcggctttgtggagatccccgaagggggcaaaccctatcagtttatggaggaattccgtgccgatccgcaggccaatccgattaaaaccgccagcggcaaaatcgagctcttcagccagaccattgcggactaccagctggacgatttcgccggccatccggaatggcgtgaaccgcaggagtggctcggttcgccggtcagccgcgactatccgctgcacatgatctcgattcagccttccgaccggttacacagtcagctggatgctacagaaacggtgcagggcaataaaaccgccggacacgaaacgctctacatgcatccgcaggatgcggccgcgcgcgggctggtagagggcgacgagatagaggtgagcaacgcacgcggcgtgatgctggcgggcgtgcggatcaccgatggcgtgacgcagggcgtagtgattatcgccaccggcgcctggtttgatcccggctttggcaaggcgtggcagccgcacgatcgcgcgggtaaccccaacgtgctgacgctcgacatcggcacctcgtcgctgacgcaggggccaaacgccatgagctgcctggtggaaatcaaaaaacatcaggattgcacaatagcgtaaggatctcatggctggttacattttgccggtaactgttgcgtttgagatatggcagccgatcgatccctcttgctacattcagggtcccagaggtattgatgggtgaacatcaatagattttcttgattacaccaacctgcgcagatgcgcaggtttttttttgccagaaatcggctgccgataacgaactgatacacagttttcctgttatacggccagcgctttctttataactgctggcaccagcccctttctctttattttgcgcagcggaatgccatgccccggattaaaaaactactgggaaaagaccagataaaagcgccgtttaacccttttcgtttccgactgatctgcctgggtgtcacgacctgtctggtggtgctgctggcgcgcgtcgcggacctgcagttcctgaatcagccgatgctggagcacgaagcggatcagcgatcgctgcgtaccgtgacgctgccgaccagtcgcggcacgctgctggatcgtaacggtgaagcgctggcgctcagcgtcccgtcgcgcgacgtgattgccgatccgcagcgcgtgctggagagcaaccccgattttaccagtgccaaatgggcctatctggcggcggcgctcaacacccgtcccgaagagctggcggcgcagatcaccgccaacccgaaacgtcgcttcctctatctggggcgtaaagtcgagctgggcattgccaaagatattaaagagctgaagctgaaaggcatcagcgaagtctatgatgacagccgtttctatccgatgagcgaagcctctgcgccgctgatcggcatcgtcggggcggataatgtcggcctgaacggactggaaaagggctttgataaagtattgcagggcgagccgggcaaagaggtctatcggcaggatgccgcaggcaatatcatcgcgatgatcaactatcagccgccgacccagccgccgacggtacagctcagcatcgacaaatatgaccagtacacgctctacagcaaactgcgcgacggcgtactgatcaacaaggcggactcgggtgcggccgtgctggtgaaaatcgacaccggcgagattctggcgatggcctcctatccctcgttcaaccccaacaactatgaaggggcaacgcccgcgcagatgcgtaactctgccatcaatgacagctacgaaccgggatcaaccgtcaaaccgttagtggtgatggaagcgctggagcgccacctggtgcgcccggattcggtgatcgacaccacgccttacagcgttaacggccacctgatccgcgacgtcggccactggccgcgcctgaccatgaccggcattctgcaaaaatcgagcgacatcggcgtgtcacacctcgcgctggcgatgcccgccgaagcgctggtcaacacctatcatgcgttcggccttggcaaaccgaccggcttagggctgaccggcgaaagcgtcggctactttccgttgcaccgcacccgctgggcagatatcgagcgggccaccttctcctttggctatggcctgcgtgtgacgccgctgcagattgcccgcgaatacgccacgctcggctcctatggcatttaccgtccgctgtcgatcacccgcgttacgccaccggtcatgggacgccaggtcgccaacccggaaacggtgaaagaggtggtgcacatgctggagagtgacgtcctgccgggcggaaccgggctgaaagctgcggtgccgggctaccgtctggcaaccaaaaccggtacggcggaaaaaatgggcaccagcggcaagtatgatggcggctacgtcaactacaccgccggtctcgctcctgccagccatcctgaagtggcgctggtggtgatgatcaaccatccgacggcgggcgatcacttcggtggctcggttgctgcaccggtgttcggcaatatcatggggccggtactgaaacacatgaatattgcaccggatgccatctacaccaaaccggcggccactccttcagataaatcttagataaatcagagtgtaagcgaggcgtgaaggatattcacacctcgttgcacttccccgaattcggttgcgttttcctgctgtctccgcgcggtcaatcagtgcgaggatagcagtcccagaggtattgatgggtgtgaaaacgacactgcttcggcagtgagaccctgttattacaccaacccacgcagatgcgtgggttttttttgcctgcttgcctgagcctgccgttaccgctgtaaaaacccccgctaaatcaacatcgttcttaacgaaaccctgacagtttgccgatagaaaggcgcatcgcctttcactgataatggccgccgtgaagcctggcggttttttgcccgccgccgctcactgccgcattccgcacgttccgggatttctttttctgcttatctgaagagttcgacgatgactcacctttctcgccccgcgcgttcctttgggcttaaatggctgctcctgttgctggtgatggcgattatcgctggggttatctggcgtctgctggcggcgggtcacgggccgggcgaggggatgccgtcgggcagaccgggtgcgcatggcatgatgggcggaggggcgacgctggttcacagcggtgtcgccagcacggcggatgtgccggtgtggctgaatgcgctcggcacggtcatccccaacgccagcgtcacggtgaccagccgcgttgacggccagctggagcaggttttctttaccgaggggcagaaagtcagcgccgggcagctgctggcgcagatcgatccgcgcagctttcaggccacgctgaaccagtatcagggcgaactcagtgaaaaccaggcgctgctgaaaagtgcggagctgacgctggcgcgctaccgcaaactggcggcgcaggatgcactggcgcgtcaggatctggacagccagattgccactgtcgggcagtatcgcggtgccgtcgccgccgatcaggcgcagatcgccagtgccagactcagcattgaatatgcccggatcaccgctccgatcagcgggcgcgtcggcctgcgtcaggtcgatcccggcaacatggttcagagtgccagcagcaccggcctggtgactattacccagatgcagcccgccgccgtgacctttagcgtgccgcaaagcgaaatcccgacgctggtcagcgtgctgcatcaggggcagagcctgcccgccacgctgtatgatcaggacaaccagcatcagctcggcagcggcgaggtgaagttcatcagcaaccagatcgacaccgccaccggcaccgtggcgctgaaagcggtgttcgccaaccaggatgagtcgctgtttgccaatcagtttgtgaatctgcggctgcagacccgggtgctgaaaggcgcgacggtgatcccggcccaggcgctgcagctgagcagcgacggcagttttgtctttgtgatcaatcaggatcacagcgtcacgcgcaaagcggtcaccaccggtcccgctttcggagacgatcagcaggcgatcctcagcggcgtttcgccgggcgatcggctggtgacggaagggatcgatcgtctgaccagcggcagcaaagtgtcgctggccgatgagaggcccgccgctgcgggtgctgtgtcgaaatgaacccgtcgcgcctgtttattctgcgtccggtcgccaccattctgctgatggtcggcgtgctgatcgccggcatttttgcctggaaattcctctcaacctcggcgctgccgcaggtcgactatccgatcattcaggtcaccacgctctatccgggtgccagcccggatgtgatggcgtcgtcggtcacctcaccgctggagcgccagttagggcagatggcggggctgagccagatgagctccaccagcgccagcggctcgtcgatcattaccctgaagttcagcctcgatctgtcgctggatatcgccgagcaggaggtgcaggcggcgatcaatgcggcgaataacctgctgcccgacgacctgcccaatccgccgacctacaaaaaggtcaatccggcggacagcgcggtggtgacgctggcggcgagctccagcacgctgccgttgaccgcggtgcaggatctggtcaatacccgggtggcgctgaagctgtcgcagatctccggcgtcgggatggtgacgctggcgggcggccaccagccggcgattcgggtgcagatgaatcctcaggcgctggcggcgcatcatctgacgctggaggcggtaaatacgctgattggcaacagcaacgtcaatggctccaaaggcggctttgacggtaaatatcattcggtgaccattgacgccaacgaccagctgcgcaccgcaaccgagtacgggaacctgatcctcagctatgagaatggcgcggcgctgcgcctgaaagatatcgcccacattgaacagggtccggaaaacagcttccagtcggcgtgggccaacaaccagcccgcgattgttatcagcgtgcagcgtcagccgggcgcgaacgtgatccaggtggtggacaatatcaaggcgcagctccccgcgctgcaggcggcgctgccggagggggtgaagatgacgattctctccgatcgcacccagaccattcgcgcctcgatcagcgacgttcagtttgaactgatgctgtcgattgcgctggtggtgatggtgactttcctgttcctgcgcaacgtggccgccacgctgattccgagcgtggcagtgccgctgtcgctggtcggcacctttggtgtgatgtatctggcgggcttcagcctgaataatctgtcgctgatggcgctgactatcgccaccggttttgtcattgatgacgccatcgtggtggtcgagaacatctcccggcggctggagcagggtgagtcgccgatggaagccgcgctgaaaggctcccggcagattggcttcaccattatctcgctgaccttttccctgattgcggtgctgatcccgctgctgtttatgggcgatgtagtcgggcgactgttccgggagtttgcgattaccctggcggtggcgattctggtgtcaatgctggtatcgctgaccctgacaccgatgctgtgcgcgtatctgctgcgccacattccgccagaacagcagtcgacgtttgcccgcaagggcggcgaactgtttgatgccctggtgcgcggttatgatcggctgctgaccgtggtactgaaccatcagaaactgacgctgctggtggcgctggccaccttcgggctgacggcgctgctctacataatggtgccgaaaggcttcttcccgacccaggataccgggctgattcagggcattaccgtcgcctcacaggacgtctcgtttaacgccatggcaacgcggcagcaggcgttgtcggcgcggatcctgaaaaacccggcggtggagagcgtctcatcgacgatcggcatcgacggcaccaacaccagccttaacagcgggcggttgcagatcaacctgaagccgtttggctcccgcgatctcagcgccagcgaggtgatcagccagctgaaacaggcgaccgccgatgtgccgggcatccggctctatctgcaaccggcgcaggatctcaccgtcaacgatcaggtctcgccgagtcagtatcagttcaccctcgatgatgccgacagtgaaaatctggtcagcgagtcgccgaaactggtggcggcattgcagcagcggcccgagtttaatggcgtggtgagtaacctgcaggatcaggggcgcgtctcttacgttgagctgaaccgcgataaagcggcgcgcttcggcattactgcctcggacgtggacaccgcgctctataacgcctttggtcagcggctggtctcgaccatcttcacccagtcgaatcagtatcgggtggtgctggaagtggctccggcataccagcagggtccggcatcgtttgatgatgtctggctgcaatcgtccggcagcagcagtttcggcgtcgtcatccaccagcacgacttcatcaacgtcaacgtcttcgtcaacatctacgtcttcgtcgacgtccacttcagcctctgacaccagcgccagcaccaccagcagcggcatggtcaaactcactgctatcgccaccatccaccggcgcaccggttcgctgatgcatatgcggctgaatcagttcccggcggtgatgatctccttcaaccttaatccgggctactcgctggaggatggacaacgggcgatcgcggaagtacggcagcagctacatctgccggagagcaccacactgcgttatcagggggaaacctcggcgtttcagagcgccaccggcaacacgctgtggctgattctggcggcgctgatcaccatgtatgtggtgctcggcatcctctacgaaagctttatccatccggtgaccatcctctctacgctgccgtcggcggcggtgggtgcgttgctaacgctgctgctggcgggcaccgaattcagcctgattgcgctgattggggtgatactgctgatcggcatcgtgaaaaagaacgccatcatgatgatcgacttcgcgctggaggcggaacaccatcagcaactcagcgcgcgcgacgcgattcatcaggcctgcctgctgcgcttccgcccgattctgatgacgacgatggcggcgctgctgggtgcgctgccactgatgctggcctccggctccggggcagagctgcgtcagccgctggggctggtgattgtcggcgggctgattgtcagtcaggtgctgacactcttctccacgccggtcatctacctcctgtttgatgggctggcgcagcgcggtaacgcttgggtgaaacgccgtcagcagcgggcgcggagcgggcaatgaatctgacccggctgtttatctttcgtccggtggcgacgctgctgctgacgctggcgatcctgctgctgggcgcgctgggctaccggctgctgccggtagcaccgctgccgcaggtcgattttcctaccatcatggtcagcgccagcctggcaggcgccagcccggaaaccatggcggcgacggtcgctacgccgctggaacgttcgctggggcagattgccggtatcagtgagatgacctccagcagctcgcagggctccagcagcatcatcctgcagtttgaactggaccgcgatatcaatggcgcggcgcgcgacgttcaggcggcaatcaacgcagcgcgcagcctgctgcccagcgcaatggcctcgctgccgacctatcgcaaagccaacccgtcagacgcgccaatagtgatgctggcgctgacctctgccacccgcacgccaggcgagctctacgatctggcggagagcaaaatcgaacaggcgatggggcaggtacagggcgtcggcgaagtctcgctgatgggcagcgccttaccggcggtgcggattgatctgcagccgctgaagctgacccattacggcatctcgctggagacggtgcgtgccgccgtcgccaacagcactaccaatctgcctaaagggatcttacagggcagtgaccagtcgtggctggtggacagcaacggccagctggagaaggcggccagctaccgcaatctgatcatcacttatcagcagggcaacgcggtgcgcttgcgtgacgtcgccacggtctatgactcggtggaagatcgctatcaggcagggtttctgaatgccacaccggcggtgatgatcggtatcaaacgtcaggcgggtgccaacatgctggaaaccatcgacgcgataaaagcgcagttgccgcagctggaaaagagtctgcccgctgacagccagctgaaggtggtggttgaccgttcgcctggcgtgcgcgcctcactgtatgacaccgaagagacgctgctgatcgcggtgctgctggtgattgcggtggtgtttatttttctgcgtaatctgcaggcggtgatcattccggcgctggcactgccggtgtcgctgatcggcacctgcgcggtgatgtatctgctgggatacagcctggataacctgtcgctgatggcgctgattatcgccaccggcttcgtggtggatgatgcgattgtggtgctggagaacatcacccgtcacattgagcgcgggctgagcccgttgcgggcggcgctgcgcggggcgcaggaggtgagcttcaccgtgctgtcgatgaccgtgtcgctgatcgcggtgttcatcccgatcctgctgatgggcagcattgtcgggcggctgttccgcgaatttgccgtgacgctcaccgtgtcgctgctgatctcgctgtttgtttcgctgagcctgacgccgatgctctgcgcccgcctgctgaaaccaaagccgcccgtcagccagcggccgcatccgctttatcagttgattgaaaaccagctgaatcgcctgctggccgcctacgggcgcgggctggcctgggtgatgcgccatcagaaactgacgctgctcagcctgctgctgaccgtactactgaatgtttttctcttcgtcgtggtgcagaagggcttcttccccaatcaggataccgggctgctgatgggtgcgctgcgcgccgatcagaacatctcgttccaggcgatgaagccgaaaatgctgatgttcacgcagatcattcagcaagacccggcggtagagagtgtgatgtcgtcgatgggcagcgggatgtttggctcccgtaacagcgccaacttctttgtgcggcttaaagattttgatcagcgcgatgcgaccgccaccgaggtggccaaccggctgacgcgcaaaaccagtcacatcgccggggcgcagatgttcctgatggcggcgcaggacctgcacattggcggacgcagcgccaacgccacatatcagtacagcctgcaggcggacgatctcgatctgctgcgcacctggacgccgaaagtgcaggcggcgctggcggcgatccctgagcttaacagcgtggactccgattcgcagaccggcggccaggagttggagctgaacatcgatcgtgatcgcgccacccgtctgggcgtcaacgtgaacatgctggatacgctgctgaacaatgcgttcagccagcggcagatcgccacgctctatcacaccctgaatcagtatcacgtggtgatgtcactgcaggatagcgacaccgccaatcccgagaccctgcagcagctttatgtgattaacgacagcggtgaccgcgtgccgctctccgcctttgcccgcttcagcggcggcaacgcgccgctgtcggtggcgcatcagggccaggccgctaccagcaccctggcgtttaatctcgacgagggggtgtcactggaacaggcgcaggaactgataaaacaggcgatggcgaagctgggcctgccatcgacccttcacgccggttttgccggcaccgccgccgccttttctcagctgaccgcgaccatgccgtggctgattctggcggcgctggcggcggtctatctcgtgctcggcgtgctctatgagagctacatccatccgctgaccattctttcgaccctgccgtcagcgggcgtcggcgcgctgttactgctgctgctgaccggcacgcagctcacggtgatcgcgctgattggcatcatcctgctgatcggcatcgtgaaaaagaacgccatcatgatgatcgatttcgccatcgacgcggagcggcggcagggcatgtcgccacagcaggcgatcacccaggcgtgcctgatgcgcttccggcccatcatgatgaccacgctggccgcctttttcggcgcgttgccgctggcgctgggcagcggcggtgatgccgatctgcgcagcccgctgggcatcgctatcgcgggcggactggcgctcagccagctgctgacgctgtttaccacgccggttgtttatctttggctcgatcgtctgggccgtgccactcaacgtcaatggcgtcgtctgcgccctacggaatcctgatccatgaaaccgcttattccctttgttgtgatgctgctgctgggcggctgtagcgtcggtcccgactatcagcgccccgagatggcgatgccggtccactataaagaggccagaggctggcagcaggcgacgccgcttgatgcgcaaagcaaaggcgaatggtgggcggtttatcacgacgccaccctgagcgggctgctgagccaggtgagcatctcgaacctgaacgtggcgaattatgccgcgcagtaccggcaggcacaggcgctggcgagtgcgtcacgcgcggcgctgtttccctcgctgggctatgacggcagcgcgacgcgcagcggcagccacgcgactgacagcagcgttcgcaccaccagcagcagccatcaggcggagctgagtgccagctgggagctggacctgtggggcaaactgcgacggacgctggaggagaaccgcgccagcgcctcggccagcgcggcggaactggccaatattaccctgagcgcccagtctgaactggcgcaggactatttccagctgcgcatcatggatcagaaaatcgcgctctatcagcagagcgttgatgcttatcagcgctatctgaaagtgattaccagccagtatcaggcgggcaccgcgtcgcgtgcgaccctggctcaggcgcagctgcaactggagagcgccagcgcctcggcgcaggattatcagtggcagcgcgcgcagatggagcacgccattgcgctgctggtcggcaaagcacccgctgaattcagcctgaccgccgcaccgctgacggccacgctgcccgcgattccggcagccctgccgggcgagctgttgcagcgccgtcctgacattgcttacgccgaacgtaacatggccgccgctaatgctgcggtgggcgtggcggtagccggttactatcccgacctgaccctgagcgccagcggtggcgtcagttcttccgtgctgcattcgctcttctcgctgccgaatcgcgtctggtcgctggggccggagctgagcggcacgctgctggattttggtgcgaccgctgcacaggtcgatcaggcacgagcgggctgggatgccagcgttgcgacctatcgtcagacggtgctgaccgcaatgcaggaggtggaagataagctggtggagctgaacacgctgcagggtgagatcgccgcgcagcagcgcgccaccgaagcagcgcagacctcggcgcgggtgacgcgtttgcagtatgaggcgggcatgattacgtatctggatgtggcgaccaccgaaaacagccgcctgagcgcgcagcagagtttgctgacgctgcagagcacgcagtgggtcagcagtgtggcgctgattgccgcgctgggcggtggctggcaggcaccctgaaggcggcgtcaggtaaccgataattctgttgtcgaaccgcgtcaaatcctgcatcgtgaggggctattttcacgatgctaaggagccggcatggttttcacactattgcgcctgatatttcgcctgttatggcgggtcgaactgcgtggcgacgtcgccgaactgcataagcagaaggtattgatcacgccgaaccatatgtcgtttctcgacggcatattgctggcgctatttttgccgattaagccggtctatgcggtctattcgaccatcagcgaaagctggtttatgcggctggttaaaccctttatcgactatgtgccgctcgatcccaccaaacccatggcgctcaaacagctggtcaggctgatcgacagtggccgtccggtggtgatcttcccggaaggacgtattaccgtcaccggctcgctgatgaagatctacagcggggcgggttttgtcgcggcgcgttcgggcgcgaatgtggtgccgatgcgcattgaaggcgcagagtacacgccgtttggccgtctggcgggcgtgtttaaacgtcgcctgttcccgcgcatcaccctgacgattctgcccgccacccgcattccgatgccggaggcgaaacgggcgcgcgatcggcgcgtgctggccggtgagcatctgcaccatgtgatgatggaagcgcgcatggcggtgcgtccgcgtgaaaccctgtttgaggcgtttctggcggcgcgtacgcgttatggcgcgtttaagcgctgcatcgaagatgtcaatttcaaacctgacagctacaacggactgctgaagaaggcgctgggcgtgggtcgtattctggagcgctacagccagccgcgtgaagtggtaggactgctgctgcccaataccaccgtcacggcggcggcgattttcggggcatccctgcgcggacgcgttccggcgatgctcaactacacggcgggcgtgaacggcatgcgggcggcactgaccgccgcgcagatcaaaacggtcttcacgtcgcgccagttcctggacaaaggcaacctgtggcatctgccgcaggggctagatgatgtgcagtggatctatctggaagatctgaaagataccgtgaccagtaaggacaaactgtggatcgtcgcccatctgctgatgccgcatcgcgcgcagctgccccagcagccggaagacgccgcgatggtactgtttacctccggctcggaaggcaaccccaaaggggtggtgcattcgcataaaagcctgctggcgaacgtcgaacagattcgtaccatcgccgacttcaccccgcgcgaccgctttatgtcggcgctgccgctgttccatgcgtttggtctgaccgtcgggctgtttacgccgctgatgaccggcgcccaggtgttcctctatcccagcccgctgcactatcgcatcgtgccggagctggtctatgaccgcaactgcaccgtgctgtttggcacctcgaccttcctgggcaactacgcgcgctttgccgcgccctatgattttgcccgcctgcgctatgtggtggcgggggcggagaagctgcaggagaacacccgtcagctctacatggagaagtatggcattcgcattcttgaaggctacggcgtaaccgaatgcgcgccagtggtcgcgattaacgtgccgatggcggcgaaggcgcacaccgtcggacgcattctgccgggcatggattcgcggctgatgtcggtgccgggcattgagcagggcggacggctgcagctgcgcggaccgaacgtgatgaagggctatctgcgcgtcgagaatccaggcgtgctggaagtgccggtcgccgacgatggcgaaggcaatcaggaagcgggctggtatgacacgggtgatatcgtcagctttgatgacggcggtttctgccagattcaggggcgtgccaaacgctttgcgaagattgccggtgagatggtgtcgctggagatcgtcgagcagatcgctctgaaggcgtcgccggacaagcaacatgccgcctcgctgcgcccggatggtcagcgtggtgaggcgctggtgctgttcaccaccgacgctgaactggcgcgcgacagcctgcagaaagcggcccgcgagctgggtgcgccagaactggcgctggcgcgtgatatccgggtaatgaagcagttgccgcagctgggcagcggtaaacccgattacgtcacgctgaaaaaaatggcggaagaggagcaggcatgagccttgatcgtaatgcgccgctgatgtcacgcggcatgattgccgtgattatcgcccagttcttttcggccttcggcgataacgcgctgctgtttgccacgctggccgtactgaaaagccagttctatcccgactggagtcagccggtgctgcagatgctctttgtcgcggcctacattctgctggcaccgtttgtcggtcaggtggcggacagcatggcaaaagggcgggtgatgatgctcgccaacagcctgaagctgctgggcgcgctggtgatctgcttcggcttcaaccccttcctcggatataccctggtgggcgcgggcgcagcggcctactccccggctaaatatggcatcctcggtgagattacccacggtgagaagctggtgaaagccaacgggctgatggagggatcgaccatcgccgccattctgctcggctcagtggcgggcgggatgctggctgactggcatctgctggcggcgctggggatctgtgcggtgacctacggcattgccgtggtagccaacctgtttatcccgaaactgcaggcggcgcgtcctggtcagagctggcagctgggcatgatggtacgcagttttttcagtgccgccgcgctgctatggcgtgatgcggagacgcgcttctcgctgctcggcaccagcctgttctggggcgcaggcgtgacgctgcgttttctgctggtgctgtgggtgccggtggcgctgggcatcagtgacaacaccacaccaacaaccctgaatgccatggtggcgatcgggattgtgatcggggcggcggcggcggcgaagctggtgacgcttgaaacggtgcgtcgctgtatgccagccggtgtgctgattggtgtgatggtcgtcgtcttcgcgctgcagcattctctgctgaatgcctatctggtgctgatgctgattggcgcgctgggcggtttctttgtggtgccgctgaatgcactgctgcaggcgcggggcaaagagagcgtcggttcaggtaatgcgattgcggtgcagaatctgggtgagaacagcgccatgctgatcatgctggggctctatacgctggcgatcaaggcgggtgcacctgcggtggcgacgggcgtcggttttggcgtgctgtttgcgctggcgatagcgctgctgtggctgtggcgaccggctaagcgttaagcgattcaccgcctctctccgggatagccggagagaggcgggcgccctcgttaacaatagatgttaacaacgaagattagcgacgaagggcaatcgcttcgatttcgatcttcacatcttttggcagacgcgccacttcgacacaggaaacgcgccgggaagtgcgcttcatgctcggtgaaaaacgcctcataagccgcattgaccgtggcgaagtcatttaaatcttttacgaacaccgtggtcttcacgatgtcgccgaccttcagacctgctgcttcaacaatcgccttcacattttccagtgactgacgcgcctgtgcggcaacgtcatccgccacctggccggtcgccggatccaccgggatctggccagaggtgatgatcatgctgcccagatcgacaccctgaacataggggccgatagcggcaggggctttttcagtactgatttcacgagacatcattgctcctttgattacgtcgtcaggcggcgatgccgccggtgttgcccattataaggtcgggcagggcgattaccagtgacccagcaccacatggcgggcgaactctttttcgcaatatttgcacttcagatgcacatcgtcggcgcgctgcttcacggcaaagctggagaagaccggctcgctgcggctgatgcagttgctgttcgggcaggtcagtacccgttcaacgtggtccggcagcgtcggggcgatcttcgccactacttcatagtcgtcgatgcggttgaccgtggcatggggcgcatagaccgccagctgattcacctgatcgtcggtgagaaaggtgttctcaatcttgatcagatctttgcggcccatctcacccgagggcagattcaggccaatggtaatccgctgatcggtttcggtcagccggaacagggagagcaatttaaagccgatctgcgccggaatatggtcgatgaccgtgccgcgtttgatcgcttcgacctgcagtttgttgtcctgcgtcatggggtatctccttacagggcgagttcgctgtttaaaaccagtgccagcagagcctggcgcgcatagatgccgttacccgcctgctggaaataccaggcatacggggttttatcgacatcggtggtgatttcgtcgatgcgcggcagcgggtgcagtaccttcatattgtcgcgcgccgtagcgagatcggcggcgcgcagaatgaattgcgctttgacgttggcatattctgacggatcgagccgctctttctgcacgcgcgtcatgtagaggatatcgagctgcggcatcacctcttcaaagctgtcgtgacgtgaccagctgatattcttctcatccagcatatcggtgatataggccggcatcgccagcgcatcgggcgcgataaagaagaagcggttgccgtcaaacttcgccagcgcctgggtcagggagtggacggtgcggccatacttcaggtcgccgaccatcgccacattcagctgattaaggcggctctgcgtctcctgaatggtgaagagatcaagcagcgtctgggtcggatgctggttcgcgccgtcaccggcgttgagaatcgggatgccaccggagaaactcggtcgccagccgcgccgcgccttcctgcgggtgacgcatcacaatggcatcgacgtaggtgctaatcactgaaatggtgtcggccagggtttcgccttttttgcccagcgacgtattactaccgtcagcaaagcccaccgctgacgcgccgaggcgatgaatggcggtttcaaacgacaggcgggtacgggtcgacgcctcaaagaagcagctggcgataaccttgtgcttcagcagttccggctgcgggtgggctttcagctttgcggcggtgtgtagcgccagttccagctcttcacgactgaggtcgttaattgaaataatgtgcttgcgatatagcgggttagccatagctttctcctctgcgcggccggattgcggacaaaaaaaagcccctgcttaaggggcttttttaagatcgggtcgatgaccgaaagaaacagtagcaccgcctgcggtcaggcgtgattgagcgtcaaattgtccgctgtgctgtagcatatttcctccggcaaattgggccgcattatacccgttcgcggtgggtcagcaagaggaaaacgtttgcgcctgcctggccgatcggaggccaggccagatcagacggtgaatcgcccgctatgagcagacgcaactcagcgtcctcagccgcacgatgctggtcggtcagcgctggcccagcgtggccaccattaccgctttaatcgtgtgcatccggttctcagcctggtcgaacacaatgctgtgtggtgattcgaacacctcgttgctcacttccatgccgttgggcagatcgtactgttccgccatctgctggcccagcgtggtctgatcgtcgtggaaggcgggcagacagtgcagaaatttaacctgcgggttgccggtcagatcgagcatcgcccggttcacctgatagtcacgcagcagcgcgatacgctcggcccacaccgctttggcttcgcccatcgacacccagacatcggtgtagataaagtcagcgcctttcacgccgtcggcaatatgttcggtgagggtgattttcccgccggtctgctgcgcggcttcacggcactgcgccaccagttgctcctctggccagcagcttttcggtgccaccagacgcagatccagccccacctgtgcggcggcttccagcatggtgttgcccatgttgttgcgcgcatcacccacataaaccagcgtcatctcgctgagttttttgcccggcagatgctcctgcatggtcagcaggtcggccagcagctgggtcggatgaaactcggtggtcaggccgttccacaccggcacaccggcatgttccgccagcgtttccaccagatcctgaccgtaaccgcgatactgaatgccatcgtacatccggcccagcacccgcgcggtgtcgcgcatcgactctttatggccgatctggctgccactcgggccaagataggtgacgttcgcaccctgatcgtaagcggcaacttcgaaagagcatcgggtacgggtcgagtctttttcgaagatgagcgcgatgtttttacctttcagatgctgcacttcctgggcgctttttttcgcccgtttcaattcagcggaaagggtaagcaggtgatcaatctcggcgggcgtaaaatccagaagcctgaggaaatggcgctgatacagctgactcatacaacactccggtaatcattaaagtgaattaaaattcaatctaaccgtatgaatatgcattttcaagtgcagggctaataaacttttcgttttgtgtagtggcgcgacgggcagtatgggaaaataattgattattgccgaactcagagaggatatcgtcatggcatatgaagcattactggaagagcagcaggaagagacgcggcagattatcgaagagctgctggaggatggcagcgatcctgatgcgctttataccatcgagcaccatctctcatgcaataattttgattcgctggaaaaagcggccgttgatgcgttcaagctgggttatgaagtgaccgagccggaagagctggagctggaagatggcaccaccgtgatgtgcgtcgacatcatcagcgaatccgccctgaagcctgaactgatcgatgtgcaggttgagcagctggtgaacctgattggtaagtacaacgtcgattacgacggctggggcacctattttgaagatcccgatgccgaagatgaagatgacgacgccatcgaagatgaagatgatgatggtattcgccactaagtagccggggcggagagttctccgcctgtcacccctgccacctgttttaacatcatgaactacgcacccttacttgaacctatctatcagtttctgcactgccgcacgccacaggcctggattgatgaggcgcgcaagccggaaaatctgaccctgctgttaaccgaccatctggtgtgcgaaactaaaagccgcgcagaccgcggtgtggttgatccgcaaatatgttgccgacaaacccagcggcgacgccattctggcgtggctgaaaccctatgaagattttatcttccgcgaagatggcgacagcgactttatcaacgcccataagaacctgactaaacatatcatcgtgcgcaatgcgctgccgtgggcggatgagctggtggagaagatggtgctgctgattaaagaggagctgcatcacttctatcaggtgtgggaaattatgcagtcgcgcgggctggtctatcagaagatcacctccagccgctatgccaaatcgctgctgcgcgaagtcaccacccatgaaccggaaacgctggtggataagctgatatgcggcgcttacatcgaggcgcgctcctgcgagcgtttcgccagtctggcaccttatcttgatgacgaactggcgaagttctatctgtcgctgttgcgctcagaggcgcggcattatcaggactatttaaccctggcggcgcagattgccaccagagacatcacgccgcgggtgcaggtgattggggcaacagaagggcggttaattagcgaacccgacaacgaattacgctttcacagcggcgtaccggcgttctgaaaagagtaaacggcgctcttacgatggccgtttattttttatattgaaccgggttgattttattaataataaaaagataagtattaacttttaatctaatatgaacgcgttacctccgaaaaatataatttgagtgacccctcacaaaatattttatctcttctgttttttctttgcggaataactatagtgctcttgccggattaggattgttatttttcaagcaaaacctgattcataacgcctctttgccagagagggttgtgaatcaggtttttttttgcaccgggtatagccggggaaaagaatcagcgacttttttttggcgtccagttttgctaataagcatttaatggaaggagtcattaacatgaggggaaagcgcggtattccgttatttattttactgtttttgcagccacctggcgcatgggctgacttttccgacgcattatcgttctctgacaatgctttcctgcgtgattcgcaactcgatctcagactgcgtaatcactggaagtatctcaaggaaaatgaagcgcagcctgccaccgttcataatgcctggggacaggcgtcaagcctgaattttcgttccggctatcagtgggactggctgggttttgatgcaacttatacccgagcgatcaggctgggagccagcgactactttgccacgcgcggcctgctttacgacagcggcggtcatcagcaaaaagctgacgcgcacggcttcagcaagtttggtgaacgctatctgaaagtgaagctgggggacgcgaatgcgggatttaaaggaaaagcgggctggcaggagttaaaaaacatcggcgtgctgaccaccacggaccgcttgtcacgcaacagttactcaggctatagcggcgcgctgaacgtgcagaagatacggctggatttggcttacgtgaccaaaacgcttcgccacgactcgccggagagtcttgccctgcaaacccaggaccgacgaaaaattaatgcgatctataccggcgcactgagctataccggtgatcgcggacgtctcgcctacgcatttggcgaagcggaagcctaccagcggcgtcatgttatcgaagcgaattattcgctctcgccggactggcgcttgtcctctcaaatttatggcagtcaggggctggaaaattataaaagcatggcggccagcaaaagatcgtacgataaccacgcgtggcactatgtcggtgaagcagactggattaacgacagatggacacagaaattcgctgccgcctggacttcggcacccaaacataatgcggtgggatattatgtgcgcccgctgacaaaaaatacccgtgggcgtttcaacgccctgacctctgccggaaaagattatacccgtgataaagaactggcgctggtgtcgcagacggaatttgaaatttcaaaaggcatttttagcggatttcagattaactatggacagtttaattatcgtaatacgcgtatgcgttcgggggaagtcgcgctcataaaccgcttcatcgaaccccatccggtcctgaaggatttatcggtctttacgctattcggttatggctggtcatataagaataataaagaaaccccggtttttaatgcgcaagggaaatatatgcgttctcccagcctttctgcagagatcgcggttgaatataaattaaatctgttcagataaggaaaatacgatgaaaagaatttttaaagcgttgctgattcttattgtggttggggctgtcgcaggcgaagcctttgccgccgatgtcactctctacgttacgcggcatggtaaaacgatgttcaacacggtgcatcgcgcgcagggatgggcagatactccgctaacgccagcgggggtagaggtggcgcaaaagctgggacgcggtctgcagacgatcccgtttatcgccgtctggtccagcgatgctggcagagcgagagaaaccgcgcagcttgtgatgcaggcatggaaaacgccgctgccgctgaacgaacgccgggaattgcgggaagtgggctttggcctgtatgagggcgatctgaataataatatgttgaacgatgccgcccatcagttgggatttgcatccgatacggcgctaatggaggcctatggcaaaggcaaggttcatgtcgacaggatcatagacgctatccggcaggcggaagcgtcaggcacgccggcactgagaggcattaaatcagcaggcatggccgaaagctatcagcaggttgcgaagcgaatggtcgatagtctgactgagatagcgcagcaggcccggcagcagggcggcggtaacgttctggtggtcacgcatggcctggcgattacagcgctactgcaggcgcttggcgatacgtcgttaaaccagacgctggacaatgcgagcgtaacccggctgcgctataccgacagcagagagttcgtgattgaatccatcaacgatatgagttacgtagagcgcggcttataacttccgcaacatacgcacttcgcagtcgacatggccggtgcagcccatcgcgctgtcgatatgctcaaagccgagtgactcataaagtttaatggcccgcgtcaggctggcggtggtttccagatagcagcgacggaaaccgtggctgcgtgcatgttctatcgcccgcagcgccagttcgcgtgccagaccctgaccgcgcacctccggcagaaagtacatcttttgcagttcgcagatatcgggcgcgctgcaggcgagcggcgcaacaccgccgccgccgaccaccttgccctgatactcaacaatccagtaggcgctctgttcggcactgtagagctcaaacagctggtcgagctgcggatcggaaacggtgtagcccttgtcagccgtcaggccgaactccgcggaaacgtcgcggatcacctgggcgatatgcggattatcggcggcagtaatcggccgcacctggaggtcaataagcggggtggcgctggtcgtcatcatctcttccggatttgtacgaggtcaataaaaaagccgggcaagcccggctttatgaataagctgtcagctaagacgcttacaatgccgcaatgaccgcctgctgttcaatcagttttgtttttgattgttgcaggtccgctacgcgttcgcgctctttcgccaccaccgcttccggggcgcgcgaaacaaagccttcgttcgccagcttggtctcgatcttctcgatttccacatccagcttaaccagctctttcgccagacgctccagctcagcggttttatccaccagatccgccatcgggatcagcagctctgcgccttcaaccagtttggtcaccgacaccggacctttctcgcccgcaggcagaatggtcaggctttccagacgcgccaggcgcgacaggaagttgcggttagcttcaacgcgacgcagtgccgcaggcgagcagtcacgcagcagcacatccagcggcttgctcagtgcgatgttcatctcggcacggatattacgcaccgccacgatcgcctgtttcatccactcaatgtccgctttcgcttcggcatcttctttcgccgcatcgtactgcgggaaaggctgcagcatgatggtgtcgtcgctgatatttttcagccccttcacgcgctgccagatggtttcagtgataaacggaatgatcggatgcgccagacgcagcagcgcttccagcacgtgaaccagcgtatgacgggtgccacgcagttcagattcactgccgctgttcatgaccggcttggtcagctccagataccagtcgcagaactggttccaggtgaagtcatacagcaggttagccgcgatatcgaaacggtagctatccagcgcttcacggtacgctttcaccgtgttgttgaactcggtcaggatccagcgatctgccagcgacagcgtcatttcgccgccattctgtccgcaatcctgctcttcggtgttcatcagcacaaagcggctggcgttccacagcttgttacagaagttgcgatagccttccaggcgcttcatgtcccagttgatgtcgcgaccggtagaggccagcgccgccagggtgaaacgcagcgcatcggtgcctgatggctcgatgccgtccgggaaactgcttctcggtacgtttgcggattttctccgccagctgtggctgcatcatgttgccggtgcgtttttccagcagtgcttccagtgaaatgccgtcgaccatatccagcgggtcaatcacgttgcccttggatttcgacatcttctgaccttcttcatcacggatcagaccggtcatgtagacggttttaaacggtacctgtggtttgccgttttcatctttgatgaagtgcatggtcagcatgatcatgcgggcaatccagaagaagatgatgtcgaagccgctgaccagcacgctggtcggatggaaagtacgcagcgcttcggtgttttccggccagcccagggtggagaaggtccacagacctgaggagaaccaggtatccagcacgtcatcatcctgacgcagcgccacatcggcggccaggttattctcggcgcgcacttcgtcttcggtgcggccgacgtagacgttaccgttgtcgtcataccacgccgggatgcggtgaccccaccagagctgacgggagatacaccagtcctgaatatcgcgcatccaggagaagtacatgttttcgtactgcttcggtacaaactggatgtcgccgttttcaacggcttcaaccgcgactttcgccagcggtgcggtacgcacataccactggtcagtcagcatcggctcgataaccacgccgccacggtcgccgtaaggcacggtcagatcgtggggtttgatctcttcaagcaggccgagttcatcgacagcggcaacaatcgctttacgcgccgcaaagcgttccatgttctggaaagccgccgggatctcatcggaacaggcatcgctggcttcgccattggtgtcatacacctgagcacggtcgcggatatcgccgtcgaaggtcaggatgttgatcatcggcagtttgtgacgacggccgacttcatagtcgttgaagtcatgcgccggggtgatcttgacgcagccggtgcctttttccatgtcggcatgttcgtcgccaacgatagggataagacggccaaccagcggcagcatcacaaatttgccgatcagatctttgtaacgtggatcttccgggttaacggcgacgccggtatcgcccagcagggtttccggacgcgtggtggcgaccaccagataatctttgccgtcggcggtttttgcgccgtcagccagcggatagcggatatgccacatcgagcctttgctctcgcggttttccacttccaaatcggagattgcggtacgcagttttggatcccagttcaccaggcgtttgccacggtagatcaggttctctttatagaggcgaacaaacacctctttcacggcgttggaaaggccgtcgtccatggtgaagcgctcgcgctcccagtcgacggagttgcccagacggcgcatctggcgggtgatggtgccgccggactctgctttccactgccagattttgtcgatgaacgcatcacggccatagtcctggcgcgtcttgccctcttcagccgcaattttgcgctcaactaccatctgcgtggcgatgcccgcgtggtcagtaccggcctgccacagggtatttttcccctgcatgcgctggtaacggatcatggtgtccatgatggtttgctggaaggcgtgacccatgtgcaagctaccggtgacgtttcggcggcgggatcatgatgcaaaagctttcctggctggtatcgccattcggtttgaagtagccctgcttttcccaatgctcgtaaagcggctgctcgatatcttgcgggttatatgtcttttccatttctgctatgtcgtttgcggctgtggtggcgctgccgtattcaattggaatccaacgctgcgatacgctttatagcggtcgcgcgccagttgtttgagcgtgtcttcgtaaggaacgaagtctatcacttcatggaaagcagtagcaaaatctgcgaagtggggcagcaggctaatcagcaggtcgcgcggtgaactgccgcgacgctgtggccaggccagctcaaccggcgcaccgtagcgcgggccttcacccgccaggttatgcggcacgaaggcgtttgccggtcgttgccacagcgcttcgtcaagtcgaatggcttgctgttcatcttcgcaggcgatcaacacccgctttccggcccgccagcgtgtttccgccagattgcacaccagcgcttcaacggcgctaaggccatcgctcgttgcatcggtttccagcacgtagaaggttgcgtttttcatcggtttgctcatcagaagatcaagggcggaatgatatccgcccttgctgtcagaaaagagggcgcttaatcgtcgccgttcaatcctgcccgattcaacagaaattgcgacagcatcggcaccggacgtccggtggcgcctttggccttgccggagcgccaggcggtaccggcgatatccaggtgtgcccagttatatttgcgggcaaagcgtgccaggaagcaggcggcggtaatcgcgccgccgggacgtccaccaatgttcgccatatcggcaaagttggactccagctgctcctggaactcatccgccatcggcagacgccaggcgcgatcgcctgactgctccgaggcgctgatcagctcatgcgccagcggattgtggttcgacagcaggccactgatgtgatgacccagcgcaatcacgcaggcaccggtcagcgtcgcgacgtcaatcaccacttccggatcgaaacgttcaacataggtcagcgcatcgcacaggaccaggcggccttcggcatcggtgttcagcacctcaaccgtctggccagacatggtggtcagcacgtcgcccggacgcatcgatcggccatccggcatgttttcacagcccgccagcacgccaaccacgttcagcggcagattcagctctgccaccatacgcatcacgccatagacggcggccgcgccgcacatgtcatacttcatttcgtccatgctgtcggcaggcttgatggagatgccgccggagtcaaaggtcagccctttacccaccagcacaatcggacgtgcttccgcatccggattgcctttgtattcaattaccgacatcagcgattcgttttgcgaaccggccccgacagcgagataggcgttcatgcccagctctttcatctgctgttcgccaatgacgcgggtggtgacatttttgctgaaggcatccgccagctgacgcgcctgtgacgccagataggcggcgttacagatattaggtggcatgttgccgagatctttagccgctttcataccggcagcgaccgctaatccatgctggatcgcccgtttcgccgctggtcagttcacggcgggtcggcacgttaaagaccagcttgcgcagcggacgacgtggctctgctttgttacttttcagctggtcaaagttgtagagcgcctctttggaggtctctactgcctgacgcactttccagtaggtgttgcggcctttgacatgcagctcggtcaggaagcagaccgcttccattgagccggtgtcgttgagcgtgttaatggttttctgaatgacctgcttgtactggcgttcatccagctcacgctctttaccgcagccaatcagcagaatacgctcggacaggatatttggcacatgatgcagcagcagtgtctggcccacttttccttccagctcgccgcggcgcagcagggcgctgatgtagccgtcgctgattttatccagctgctcggcaatcggtgacagacgacgcggttcgaaaacgccaacgacaatgcaggcactgcgctgtttttccgggcttccgctttttacactgaactccatgcactctcctgaatcttaaagacaacggccgctgctgccgctagaatgtagcgcgctcatgacccatttattcatcgtcgcagcatgacattctgctgctggaggtcataatgaatcagggtgacaagatgttgttttttcaccacccggacgcgtttttcatacaaatttagctacggcgacggccattgatgaagaaaaatggctgataagcgttgaaactagcgattttcctgcaaaaagacaagttttcacaggcgtactaagcgtgatcatcattagatatctggttcgggaaacgctcaaaagccagctggctatcctgtttatcctgctactcatcttcttttgtcagaagttagtcaggatcctgggtgccgcggtggatggcgaagtgccgacaaacctcgttctgaccttgttaggactcggtgtgcctcaaatggcacaacttatactgcccttaagtctgtttctggcgatcctgatgacgctggggcggctctacacggaaagtgaaattaccgtgatgcacgcctgcggcctgagtaaggccgtcctggtgaaagcggcgatggtgctgatgctgtttacctcgatagtggcggccgtgaacgtcatctggctggggccgtggtcatcccgctatcaggatgaggtgacgcagaacgccaaagcgaacccgggcgcggcggcaatggctgccgggcagttccagacctccagcgacggcagcgccgtgctgtttgtcgaggatgtgaagggcaacaactttggtaacgtgttcctggcgcagttacggccaaagggcaacgcgcgaccgtcggtggtgctggctgacagcggtcacatggagcagcataaagatggctcgcaggtggtgacgctggataaaggcacccgttttgagggcaccgctctgctgcgtgatttccgtatcaccgacttcaccaattatcaggccatcgtaggctataaagcggcaacgctcgatcctaacgatgcagaacaggcaagcctgaccgacctgttcgcgaataagacacctgagtttcaggccgagctgcactggcgtctgacgctggtgttctcggtgctggtgatggcgctgatggtagtgccgctcagcgtggtgaacccacgtcaggggcgcgtgctgtcgatgctgcccgccatgatgctctatctgattttcttcctgttgcagagctcgctgaagtcgagcggcgcgaaagggcggctcgatccggcgctctggatgtgggtggtgaatatcagctatctggtgctggcggtgctccttaacctgtgggatacggtgccgatgcgtcggattcgcgcccgctttacccgcggagggtcggtctgatgtttcgcgtacttgaccgctatatcggtaaaaccattttcaataccattatgctgacgctgttcatgctggtgtcgctttccggcatcatcaagttcgtcgatcagctgcgcaagaccggccagggcagctacaacgcgctgagcgccggttactacacgcttcttagcgtaccgaaagatattgagatctttttcccgatggcggctctgttgggcgcactgctgggactgggcgcgctggcgcagcgcagtgaactggtggtgatgcaggcggcgggctttacccgcatgcaggttgcgctgtcagtgatgaaaacggcgattccgctggtgttgctgaccatggcgattggcgagtttgttgcgccctcgggcgagcagatggcgcgtaattaccgggcgcagcagctttacggcggtgcgctggtctcaacacagaacggtctgtgggcgaaagatggcaatagctttatctttatcgagcgcatcaaaggcgacaacgaaattgatggcgtgagcatctacagctttaacgatcagcgtcgtctgcagagcgtgcgttacgcggcgacggcgacctgggatgcggctaagaagcgctggatactgtcgcaggttgatgagtctaacctgaccgatcctaaacagattaccggttcacagagcctgagtggcgagtggaaaaccaatctgacgccggacaagctgggtgtggttgcgctggatccggacgcgttatcgattcgcggtctgcatagctacagtaaatatctgaagcagagcggccaggagtcgggacgttatcagctgaatatgtggagcaaaatcttccagccgctgtcggtggcggtgatgatgctgatggcgctgtcgtttatcttcggaccgctgcgtagcgtgtcgatgggtgtgcgtgtcgtaaccggtatcagttttggcttcctgttctacgtgctggaccagatttttggcccgctgagtctggtttacggtctgccgccgattctgggagcgattctgccgagttttgcgttcttcgctatcagtatgtttatgttgattaagcggcgctaagcgcagtaaatgcagtaaaagaaaaggccgcgcaagcggccttttttgtgaccggtgttcaggctcagggcaggctcccatcgctttacgttttgcagccgtgtgggagtaacggtttcagcggcctgattgtctgtacgtaaagccgatggtctgtttgagtgaaggctcagggagcatacgccttccacaaagacgcaaaagcgccatccgtggcggctcagcgcgggcgattacgcacctcatccctgaggtgcgcccgtagccgggccaacgctttgcgttgttcaaaaacgctcccggcgtttttgtcccaggcccgcgatgctttgctacaggcgtatgctcccatcgctttacgtttgtgggtcgtctgtaagccacggtttcagcggctttattctgcgctgacgccctgtttatgcggagtgccgggtcgtctctttcagtgtcctgataagttgctctctgttcagggctacgcaataggcgggcgtcccacgctcgaaacgccagccttccgctaatgctcccgcatccacggcatcaaatccaaaggcttcatataatgccgtggcggtcgctttcccttcgctatcatcccccgccagcggtaacgcctgccggttggcatcgcccggcggcaggccctgcgtttcaagatcggtcatgcggatggcattgaatgccttggtgacgcggctgtcaggaagcaggcgggcaagccgttcactggtgctgatgcggccattgagcagctcttcaatttcgccatcgcggtcgggatagtaattgaccgcatcaagcacgatttttccccgcaattctgtggccggaagttgttccgttgccgtgagcggcacggcaatcaccaccgcgtcgccgaactctgcggcctcggtggcggtgccggtttcacagccaatcatcggtttcaggctgaacagcgttcgtggatcgcgcgagttgctgagcatcacctgatgtcctgcctgaatcgccagttttgcaatcgcccggccaacaaagcctgcgccaataatgcctattttcatacgtttctccttgatgagtttcacgcactgaccttaattaaaaacaggaggtgaataaatcgacaaacagacgcaatataaacaaccaacaggagggaatcatggatcggcttaccagcatgaacgtgttcgttaccgtcgcggaatcgggctcgtttgccgcagccgccgggcatttgcaaatctcaccgcagatggtggcgaagcatatcgccatgctggagaagcatctcggtacgctgcttctgcatcgcaccacccgacgacaaagtctgacggatgtgggccgcaactatttcgaacgctgcaaaatcgtgctggcagaggtgcaggaagcggatgcgatcgcgctggatatgcagcagcggccgtccggtacgctgaaggtcagcgccccggtcacgtttggttcttttagcctggcgccgtttgtgacccgctatcttgaccgatttccggaaacgcaggtcgatcttgaactcagcgatcggctggtcgatccgtttgaagagggttatgaggtggtgatccggattggtgcgctggcggacagttcgatcatcgcccacccactgcagccctaccggctgatagcctgcgcgtcgccagcctatctggcgcggcacggtgttcccgccacgccagcggagctggtgaaccacgcctgtctcgtttatggcatctggtcgccctcaaaaccctgccgctgggtattcagtcaggccggtaaggttgaagaggtgcatccgcaggggcgcatgcgatcaaatgactggaaagcgctgctgcatgcggcgctggagggttatggcattaccctggggccggccaccattctctctgaagagatcagacagggccggctggtccaggtgctgcccgattatgccgggccagcacgacccatgcatgtgctgatcccggcgggccgccgccagacggtgaaaatccgcagctttgttagcgccattatcaccgagtttggcctctatccacccacatctggctaaaccaggcggttatctgttcagcagcggcagtaactggggcagctgcgacaacaggtagaggatcagcccgatggtgccgccaaccagcgtgccgttgatgcggataaactgcagatctttgccgatattaagttcgatctgctgcgacatgtcgcgtgcatcccagctcttcacggtgtcgctgatgtggcgcgtcaggaagccagcaaactctggcgcaacgctgcgtgcggcctgttccagatgctgattcatcgagtcacgcagcgccgggtcggccgccagggtttcgcccagccacaatgctgcaccgcgcactttctcctgcactcgtgaatcatcactgctgagatccgccttgagccagttgcgcatatcattccacagctcgccgatgtagcggttaaacgaggcatcctctttcagccagcctttgatctcctcggcacgttcagccatctccgggtcgttctgcagtttaacgatcagtttgtcgaccgcccggttgaaaccaaggcgcagctcatgcccctgatccagcgccacatcatccagcagtgaatcgaccgcgtttgccaccagctcggcgctgtgttcgcccagccattcggtcggcaacattttggctttgatcggatgctcgcgtttcagccagcgcaccagctgcatggcaataaactcgcgggtgctgggcttgtgcagcagcttcagcagctgttcgattgccgcatccagcagcgcctgatgacggttgtttttcgtcaggctctccagcagcagggcgctggtctggctgagatcgaccttgtcgatggcgcgatgtactgcgcggcgcatgaaattctggatccgtgtgtcatcggtcagatcaaggaagccgcgcatgacctgcagcagatggcggccaatgcggtcagcattgcccggcgcattcagccattgcgccagcaggttggaaggatcgtgacggcgaatcagattgagcagcgagtcggtatcaagaaacttctcctgcacaaagcgaccgaggttttcaccgatacgatctttgttgcgcggaatgatggcggtatgacgcgagataaagggcaccggcacgcgccggaacagtgcgaccaccgcgaaccagtccgccagcgcgccgaccatcgcagcttctgctatcgcctttacgccgctgacccagaagccgggtggcagaaaaagcgtaacgataaaggtaattgcagccagcagtaacagcagcagcgccagacgtttcgtccgtttcagttcgtgttgtttatccatatcctgatcttagcagagagccggtttcatcggcgacgaccacccagcaggctgccgagtacgccacggatgatctgattggtaatctggcgcgtagcgcttttcgccatggtctgcaccacgccatcgtgcttgccgccgcgcgggccggttcggccaaacaggatctctttcagcccgccgagaataccgttatctaccgcgacgtcgtcgcctttcgccggaggcgcgctggcctgatcgctggcggcctgaaaccctttttgcagcttctcaaatgccgattcgcgatcaacttcgctgtcatatttgccatagagcggtgaatggttgatcaggccgttgcgttcatcgcctgtgaccggacccatacgtgagccaggtgcgatcaccatggcgcgttctaccaccgacggactgcctttggtatccaggaaggagatcaaggcttcgccggtgcccagcgcctgaatcgcctcgaaactgtcaaacgccggattggcgcgcagggtatcggcggcggtttttaccgctttctgatctttgggggtgaaggcgcgcagggcgtgctgaacgcggttgccgagctggcccagcacccgatcgggaatatctgccgggttctgggtgacgaaccagacgccgacccctttggagcggatcagccgcatgacctgttctattttctccagcagcaccggcggcgcgtcggtaaacagcaggtgcgcctcatcaaagaagaacaccagctttggctgatcgagatcgcccgcttccggcagatgctcataaagctccgacagcagccacagcaggctggtggcgtagagtttcggcatctggtagagcttctcagcagagaggatgttgatgacgcctttgccgttgctgtcgacacgcatccagtcggcaatatccagcatcggttcaccaaagaagtgctccgcgccctgttgctccagcgtcagtaacccgcgctggatggcgccgactgaggcgctgttgatgttgccgtagtgggtctgaaagctttttgcgttgtcaccgatgtactgagtcatggcgcgcagatctttgaagtccagcagcagcaaaccctggtcatcggcgatgcggaaaataatctgcaatacgccgctctgcacctcattcaggttcagcagtcgcgccagcagcagcggcccgagatcggagacggtagcgcgaacaggatgacctttctcgccgaagatatcccatagcaccaccggattgctctgcggctgccagtcggtgacgccgattttcgccagcctctcctgcagcttttcgctggactggccagccatcgccacgccggtcaaatcgcctttaacgtcagccataaagaccggcacgccgctggcggagaacgattcagccagtttctgcagcgtaacggttttaccggtgccggtcgcgccggtgatcaggccatggcggttggccatttgcggcaacagatgaagttcgacgtctggcgtacgggcaatcagtagcggggaagtcatgatttccactctcaggcattgggttatgcctgaaggatagcaagccggagcggcacaggaggagaactattcaccaaaaaaaggccgctgcccggggagcagcggcctgcaacagtggtttacttctgcacctcttcaaaattgagcaggctgaccccgatgccctgctgcaggtgactgaggttgctgcgcaccgccacctgggttgcgccctgtaacagcatgacaaacggcgaatcctgctggatgcgggtttgcagcccggtgtagaggttgcgacgtttcaccgcatcgctctctccggcggcggcgcgggtctgtgcactcagctccggaatcgtccagccgacgcgccacgccagggttttgccgccgcccggcacgttataggcaaaggtactggcattggtattgggatcgatgtagtccgcgccccagtaagtaaagatggcctggaagtcccggctgcgcattttgctccacagctccgattccgccaccggctggatatcaagctgcacatccgctttggcaaagctggcctgcagtgcctgcgccacatcaatgtaaggcggctggttcaccaccgtcagcgcgatatgggtgccaggtttgatgccgcctttttgcagtatcgcctgtgcctttttcagatcgtaatggaacggtgtcgtgttcagtgcaccatcgaagccgtccggcaggaagctctgatgaatgcggtactgacctttcagcagctggttcgccaggctgtcatagtcaaccagccagcgcgccgcctgccacaacgccggattccccagcgccggttgctgcgggctttgggtgttaaagcccaggtagtaaaccaggctggaagggaaggcatcaatacgcacattggcggtgttcttcagcgcggtaatctgatccgggccgagctgataggcgacatccacatcaccctgctggatcagcagacggcggctgcccggatcggccacacctttcagcaatacccgcttcagatgcggcttccggatgctgttgggattggcttccagcaccagcgcctgcagcgggacaaactgtttgatggcataggcggcgctgccggcggagtgcaccttcagccagctattgccgtaatcgttgttgctggcgtgttcttgtgccagtttgctgtcgacgatggaggagaccggcgcggtcagcaggcgcagcgccagatcgctgccgatctccgctggccagcgcagctcaagctggtggtcgttgatcaccgtgaactgctgatcgatattttctggcgtccagccaaattcacccagaataaaagagggcgctttattgagttttaccgcgcgggttaatgagaagaccacatcctgtgcggtcacgggatgaccactggcgaagcgggcctgcggattaagatcaaacaccaggctgtgaggcgttttgcctgcctgccagcgcgtagccgccagcggtgagagctgctgcggattctgatgatccggctccagcagcgtctggtagatattgcgcaggctactgttgctgacggtctcaaaactttcagccggatcgaaactgatgatgccatcaagcggaacggcaatcaccagcgtgtcgccaggcgtggcggcgtgtgccgggtgaaccagtgccagagccgtaaacagggacaagagtgtttttcgcatggagagttatcctgagtcgttgatagctctactctatcgggcgccggataatctccaaatgcgggtttcttatgagctttgcacaattattagcgtagtcgttcaggcaaagagacaaaataagataatgacgggcagtaattattttattgtcattttacagcgggcggaataaagccggttttactcagccgatcacaaattgcgcacagtctgattgtatgactatcaaagtcactatagtgttgacgatgagaatcattctcttgtatggaagtatgatatttttttatcggttatctggcgtgatgatgacagagtgaaaataataaccctcattcctgcgttaaaagagttaaatacccgatgtttatgcggttttacccccgatttccgcgctgtaaatcttttacctctccgcaaccctttcgcaacaccatgataaacttttactaagacacatcttaaattcaatttttacattcagacatatctatatccctaagattgccaggttattaaccgataagttccgttagtcaccgaaccataattctacctgcccttgtctgttctgccgtcgtctgtgccgcgtgcgttgatctctgcggggaattttccgcctgcactcagcctttcagcttcataacaaataaagcgggtatttagcagatgagagtcgtgcggatatgcttttagaaaaacccaccaccaggcgtaaatttttgctcggttcactgctggcgttgccattaagtgaactggtcttcaaaggcattactgcggcacaggcggcagagatggccgcaccggagttagccgattacaaaccgatcttttttagtgccgatgagtggcagtttatcctggccaccactgaccgtttgattccggcaggcggcaaaggcaaagcgccgggcgcgctggaaactaacgtgccgatctttatcgatcagcagctgcacagcgaagcgtttggcagcgaaatctacatgcaggggccgttcaatacgcaggcgcccgcaaccatgggttaccagatcccgttccgcccacagcagatgtatcagaccggtatccggctgattaatcagtggtcgcagaacacccatcagaaagcgtttcatgcgctgacgctggaagagaaagatgcggtgctgacccaggtaaacaaaaacgagatcgactttgctgcactgggcgaagccgatcttaagcctgcgcatttcttcagccagctgctttccgataccaagcatggctaccttgctgacccgatgtacggcggtaataaaggcatgaaagcctggatcgccatcggcttccccggcgcgcgtgccagcttcaccgaatgggtgaaacagcacaacgttccttatccgctgggtccggtcagtgtgaagggcgaacgcgcgtagggcgcgtccacatcaggtatttgaaacaggattatcatggcacaggttactaaaaaagaagtcgacgtcgtggtctgcggcctcggctgggcaggctcgctgatgagcatcgagctggcactggcaggtctggatgtgcgcgcccttgagcgcggcggcgatcgcgattatgacgagttcgcctacccgaaaccggcggatgaatacgcctatgcggtgcgcaataaagtgtttgccacccccgccgaagtggcggtcaccgtgcgctacaacagcagccagacggcattgccaacccgtaaatggggtgcgtttgcaccgggcaccggcgtaggcggttccggcctgcactggaccgcagtactgatccgtccgacaccgactgatatcaaactgaagacttatgtcgacgaggcttacaagccgggcattctgcaggatgatatgcgggtgatggacttcccgttcagctgggaagagatcgaaccctactactacaaattcgaactgatttgcggccagtcgggtaacaccggcaacctgcgcggcaaaattctggaaggcggcgatccgtttgaaggcccgcgttctgagccttatccgctgcctgcgctggatgacacgctgaacaacgtgatgttcaaagaggtggcgaccaaactcggttaccatccgttcccgaaacccgtcggcctgtgtgtcgcgtgcgtggaaaaacccgtacggcaaccagatcgcgccgtgcaactactgcggctactgcagtaaatatccctgcctgaactattccaaagcgtcgccgcagaccgccgtaatggattcactgaagcgtatgccgaacttctcctatgaagtgaatgcggaagtgatcaaggtcgtgctgaacgatgataagaaaaccgcgaaaggcgtgatctacatcgatgcacagggcaacgagtgcttccagccagcgaaaatcgtggtgctgagcagcttccagctctacaacgtgcgtctgatgctgctctccggcatcggcaagccttacaacccgattaccgaagagggtgtggtagggcgtaactacgcgttcctgtccaacggcggcgcgacgctgttcttcaaagataaaaacttcaatccgtacgctacggcgggcgcgaccggccagatgttcaacgatatctcgccaggcaacttcgacggcccatccctcggcttcctcggcggcgcgaagatccacagctcacaggcgaccggtacgccgatcagcaccgcgctgccaaaaggcacgccgacctggggcatgggatacaaggaaggtctggaggagtggtacggtcattcgatgaagatcagcatcaccaccacctgtcagtcttaccgcgatatctatctggatctcgatccgaactacaacgatcaccgtggcctgccactgctgcgcatgaccttcaactggaaagagaatgagctgaagctgcagcagcacctgaaaggcatcgtcggcaatatcgcgaaagagctgaaccctgacagcatgagcatgagcttcctgccaatgggcgcggactttgacctgaccaaatatgtctctacccacaacgtgggcggtgccgtaatgggcgataacccgaaaacctcggcgctgaacaagtatctgcagagctgggacgtgcataacgtctttgtgccgggcggtaacgctttcccgcagaacttccaggcgaacccgaccgataccatcggtgcgatcaccctgatggcggcacaggcgatcaaagatcagtatctgaaaaatcccggcccactggtacaggcataagcgcatgaataagctgaaactgaaatcttttatctttgccaacgcggtgctgttagccagcggatttgcgctgccggttcacgccgaagatgaagcgcaactgattaagcagggcgaatatctctcgcggctgggcgactgcatggcgtgccactcactgcctggcaagcctgactattccggcgggctggcgattgagtcgaaccttggcaccatcttctccaccaacatcacgcccgataagcagcacggcatcggcaactacagcgagcagcagttctctgacgcggtgcgcaaaggggtattaccggacggttcgcatctctatccggcgatgccttatcctgattacgccaaaatcagtgatgccgacatccacgcgctttacgtctacttcatgaaaggcgtgcagccaagcgcagaacagccgccggagaccgatctgagcttcccgttcagccagcgctggggcatgcgtttctggaactgggcgttcgcctcggataagccgttccagccgattggtggcgcttctgaagaggtcaaccgcggtgcctatatcgtggagagtctgggtcactgcggcagctgccatacgccgcgcggtctgggcatgaacgagaaagcgctggatagcggtgacgataaattcctggcaggcggcagcctgaacaactgggatgtgccgtcactgcgtggcctgccgcgctggagcgagcaggaagtggtggactacctgcagaccggccgtaacgataaagcggcggtgggcggcgagatgacctcggtgattgagcacagcagctcacacatgaccgacgccgatctgaaagccatcgcggcctacctgaagttcctgggcggcaacccgccattgcaggcgtacaacgtgcaggcgcagcaggcaacggaagcgaaactcactgccgcgaagaacctgagcgaaggcgagcgcctctatctggataactgcggtgcctgtcacttcgtgaccggcaaaggcgcgccagggatcttcccggagctggatcaggcgacgatcgtcaatgctaaagatccaaccggtctgatccacaccatcctggccggcgcacagcaaccttccaccgcgaaggccccgtcgaaactggcgatgccaggctttggtcagcgtctgagtgatgaagaggtggcgcagctggcgacctttattcgtcagggctggagcaacaccgcgccagcggtgagcaaagatcaggttgctgaagtgcgtaaaacgctgaagtaatcggtcctgagttttcccctctgcccgttcggagaggggaaatcccggattagtgaaaggtgcgcaccacttccagcacgccgttaatgataaactgcacacccatacagaccagtaaaaatcccatcaggcgcgatatcgcctcaatgccgcttttacccaccagcttcatgatggcacccgaactgcgcagtgaaacccacagaatcagactcaccagcaggaagatcagcactggcgcgacggtgatgacccaggccggaaagtcgacgccgcttcttaccgtcgaggcagaggagatgatcatcgcaatggtacccggccccgccgtactcggcatcgccagcggcacaaaggcgatattcaccggctctttggcttcatccagctcatccagtttctgctttgcttcgacagaatggccggcaggtttagccgggaacagcatccgaaaaccgataaaagcgacgatcaggccgcccgccatgcgcaggccaggaatggagatgccgaaggtattcagcaccgcgctgcccgcgtaccacgccaccatcatgatggcgaagacatagatagaagcctggcgcgcctgtcggttgcgctcctggaagttcatctcacccgccagccccagaaacagcgccacggtggtgagtggattggcgagcggcaggatcaccaccagccccagactgactgctttaattaactccagcatgacaaatcgccttttccgtggtgattagtgcttcggacgctccagcgcctcaagcagttccggaaagaagtcctgcaggatttcaggcgtcatcagttcgggatactgcatcagatgctcgcggatacgctcattgatgtccggcagcagacgctgggccgcagcgctggcggtgattttgtgcttcttcatggcgcgcagcagatcgcccggcagcgcgtcttcgtcgtcggcgtcatccaccatctccagcgcgtccagctcgtcgaacatctccatcagcgcttcggtctgtggcgtgcgcgactcatattcacgcggatgttcatcttccaggaaacgcagcatggcgcgcattggcgtgccgtctggcgtggatggcggctcggtggcgaaccagctcagcagctgatgcatggtgacctgatgaacgcgaaagccgctatcgaccagctcatcggccagcagctcggcggtttcgttttcaatcacgcagatgtgggtacgtttgggtttcgtactgctccagccactggtagatctcttcaatcacgccatcgtcatactcgaattttttggtgacatagctgtcgtcctgttcgtgaacgcaggcctgaatctgatcggggtcgaagtaaagtgcgatgttgatgcctttcatgcgtgctgtcctgtagaaatcaaaacaacactatagcgctcaaccccaggttaagggaatgtcaggcgtcacagcatggggggcgtttaacgctcccctcagagcagagaggggagagagaagggaaggtgatcaggagataaagtttttgccctgcttcagcaccacgtcacaggctttggttttcagcttctcacccatcggtgagttgctcaggctttgcagattcaactgctggccgttaccggtattcagcagaccggccacgccctgggtgtagtcggttttttgttcctgcgcggtggtggtgttcagaccgagcttgctcagcacctgatctttgacagactgcacattgtttttcaccacgttgtgttcgacgcaatactgcatcacaccggcggcgttggtcatgctgttggcgctgaccgctttatcgccgccgcccagcatgctggtaatggtagaaagcgacatgccgccattctgctgcgtggtgccggtggtgctgccgttgttctgctggctgagctgtgacgctgcactgctcagctgatcctgccagcttgccgctgatgcactgcctgcgaccagaagtgccgccagtccccatccccacgcactgcgttgtgcttgcttcatttcaacctcggtatgtgcttattcagttttcctaagaaaggctgaagagcagaaagttcctgacttccttttataaaaagcgtcttaaatagcactttgggaatcttctgtaataagagcgataaaatattcagatgcttgtgggtgttattattctgtgaagtgattttctgcagtcagtaataagcatattccgcggaaacattatttaatatcctcacgatttttatcaggaattgtcctggtttaaattaaagttaccgctttgcttatagcgtgttttctaatcgcttgcgtctggtctggtaatatttacctgagaaatcatattaatgtaacttcatgtattttggttattttatatttttagcgtagcggtgatttaaaccgggctgctgttttttgatgcgcttttttgtgccgtaattaaattgagttggcggagttttttattattccggcttgcgaaatcagccagagtgttcatgcttaatcactgtgtcaggcagttgtggcagatatttaatttaacgggagcgatattatggctggacagccagagcacaataataatgcagaggtcacgcttaaactcgctgaagagcaaatagccctgacgaagcaaaagattgtggatggacatgtccgtgttacccgttccacaactgagcatgacgaggtcatcagtacactgcttaaccgggagaaggttgaggttgagcatgtagcgaaagcgcaacccgttgaaacgatgcccgaaatcagggaagagaacggtgtactgattgtcccggtagtagaggaagaaatccaaatcgtcagaaagctggtgcttaaagaggagatccacatccgaaaagtgcaggaaaatgttccttttcaggaggtggtgacccgacgtgagcagcaggtgaacgttgaaagagatgacgatcaaattagctaacagagaggaacctatcatggcacatgaaaaaatcgtaacactgttcgattctgcaaatcaggcagaggccgcgaaaagaaatctcgtgaaagcaggcttttctgatcgggacatcagtcttatcagtggagaacgtttgcaggaggaaggacactctatccgccatccgagcatctggcagcgtctgtttggtcactccgttgataaagagcaggccgatgtttacaccagagcgatggacaagggcggcgtagtgctgaccatccgtactgaggaggagaagctggctcgcgccatgaccattctccattctcatgactcggtggacgttccgtcacgtatgcaaagctcggttgagaatggcactaccgcgccgggcatcaacccgacgacggcaggcaagcagtttgctggtgagaccaacgaccgacaggttgaaccgcgacgcacctcactgaccggtgatgagagcgaagctgacattctgcgtctggccgaagagcaggttgaagtgggtaaacgtctggtgagcgaaggctctacccgtgttcgccgctataccgtgaccgataccgtatctgaagatatctcgctgcatgagcagcacgctgacatcttccgccgttcggtgaatgaacccgcgctggctggtgaagtggactggtccgagaaaaccgtcgaggttgctgagacgcatgagcagccggtgatcaacaaaacgacccacgtgaaagaagaagtggtggtgcgtaccgacggcagcgatcgtaccgagacgattaacgacacggtgcgtcgtcaggaagtggatatcgaccatgcacgaggtggtctggagcgcgaactgccgggtacaaccgcaggggtaaaacctgcgaccgccgccgcaggcacgcagtcaccaggtgcacataaccgtgaccacaaagagagcctgactgagaaggtgagtgagaaagccagcgaagtgaaggataaggtcgggaacaaactgcacgatcactcgcattgaggcgcttatcctgacaacaacaggcgctaatgggcaccgctgatgcccgatgctgagcatgcaagatgcaagaaggggccaaccgcgaggttggctcttttgcgtttgggggcagtaaaaacggacaacggcgtcatatcttcttcggtataatcaggaaatatctgcgcaggccgggcaggaataaaacataagggaataaagtgaactgtaaaccgatgcttttcgtactggcggtgttctccctgacggctcaggccgcccagagcggaaaaacgcttgagcacaaagactgggaagtggtctgtgataacaccctgacctgtcgcattgcgggttatgccaaagaagaggatccgtccggctccattctgcttacccgtgccgctggaccaggaaacggagccagtgggagaagtgacgctgggtgataccgaagatgacagcacaccggcggaaaaactgacgctgtggatcgacgggaaatcagcaggcgatctggtggcggctgatgacaactggcggctttcggcaagtcagacctctgcggtaatcagtgccgtcaaaggcagcggtaaagtcgaatttaaaggcggcacaaagcctttcctgctttccggcgaaggcgcttatgccgtgctgctgaaagctgatgatgttcagggccgtatcggcacgccaggcgcgctcaccaaaaagggcaataaaccagaaagcagcgtggctaaggctgtgcccgcaccggttattcaggcggcaaaaaccctcagcggcgaaccccgtttgctgaccgcaccagaaatcgacgcgctgaaaacccgcctgctttcaacggtcaatcataatgacgatgacacgtgcgacagcctgtattcacctgcagaaaacagcgatccggaaaccgacggactgactcttacgccactggatgacacacacgctttgctttcggcgctctgctggcgagccgcttataacgaaggatatggctactgggtcattgataaccagctcaaaggcaagccggtgctggtgaccatctccgggtcggattacgacaaaggtgagattaccaatgtgcagaaaggccgcggtattggtgactgcatgagccaggaaagctgggtttgggacggcaaggctttccgcaaaagctatgacggcggaaccggcatgtgccgttatatccatgcgggcggcacctgggatctaccgacactggtaacggatgtgaagcctgtttcgggttaagcaggtgaacctgagaacccaagagacggttttttcagcagttgcacattcgcctgctgataagggttgcggaaacagggggtaacggtataatcctcaacgttttccgcatacccttcagtgccgaagtggcgaaatcggtagacgcagttgattcaaaatcaaccgccgcgaggcgtgccggttcgattccggccttcggcaccatcggaacatcaatagacgtcaacggacgtctttttttgtgcctgaaattcagtatttacccatcattcccgctatattaactctctcaaggccaaccaacttcaacgtacatttaccaacacctgttggtacagatgatggtatttccgattcgataatgcttgtaccaacagggaggggataagcatggcttaacagatatcaaagtcagaacagccaagccaatggataagcaatataagctgaccgatggcaacggtatgcatcttctcgtccatcctaatggttctaagtactggcgtttgcagtaccgttttgacggcaagcaaaagatgctggcacttggggtatatcctgaaatcacattggcggatgctagatcacgccgcgacgaagcgtgtaagctgttggcgaatggcgtcgatccaggagacaaaaagaaaagtgataaggttgagcagagaaaagcccatacttttaaagaggtggcgattgagtggcatagcaccaataaaaagtggtctgaagatcatgcccatcgtgtgctaaaaagcctggaaaataatctcttcgcagagctcggggagcgtaatatcacggaattaaagactcgcgatttattagcacctattaaagccgtggagatgtctggacgtcttgaggttgctgcccgtcttcaacagcgaaccacagcaatcatgcgttatgctgtgcagagtggattgattgattataaccccgctcaggagatggctggggcagttgcttctggaaacaggcaacatcgtccggcactggagttaaagcgcatccctgagttacttgagaaaatagatggctataccggcaggccgctaacccgcagggcaacagagcttactttgcttatctttattcgctccagtgagctgcgttttgctcgctggtcagagatagattttaaaacgtcaatgtggacaatcccgccggaaacgagagcctattcctggagtgaaacattctcatcgcggttcaaaaatgcgcacaccgcatctggttccgctttctaagcaggcattggcgatcctgaaacagataaaacagttttgtggggagcacgagctgattttcattggcgatcacgacccgcgtaaacccatgagtgaaaacacggttaacagtgccctacgggttatgggttacgacactaaagctgaggtttgcggtcacggctttcgtacaatggcctgtagttcgttaattgagtcagggctatggtcgaaggatgcggttgaaaggcagatgagccatatggaacgcaattcggtgcgggcggcgtatatccataaagcggaacatctggatgagcgcaagttgatgttgcagtggtgggctgattttctggatgcgaaccgggagaaagggattacgccgtttgactatgcgaagatcaaccggggagcaggtcacaggaggaacatatcaaaaacaggcagatacacaatttaaattacagtctctttcatcgatttttgtccattatgatgacactctatattcgtattgaaatcacagtaatacagtgcattttttagtaatatttaacctattgattatttcaaggaataatgaccgttgaaatttgcacaagctctcagcattctctcaaagtcttctccgtatgcggttagtaccgagagagagcactatcaagatcacctcgttggattcaagagatacatatacatcacgacagatatagaagcggattttaaaaaagcactcctatctgctaagtccaatcaagtcatcttcctatgcggaagtagtggtgatggcaagtctgagatcttgacgcagtacagccaaaagcacaaagtgactcatgacttccatttggatgcgactcacagcttcaatccaagccagacagccattcaagctcttgatcaaagattcacccagttcaagcaaagtcataaaccacttgttgtgggtattaacgttggtatgctcggcaattatgcagaagaaggttccaaagagcatagcgacatcaaaaaggtgctcagagactttctctctcgtaagcgatcagcaattccaaagcagtacgtattcttggattttgaagactatccaaaattcaccttcaatgctgagggctgtgcatcagactttgcagaaaaatttctaaaaagattgacagcacaaacgcttgagaatcctttctatgcgctttatgacaaagagctcaaatctctaggtcatactcgcctgacggcaaactatgcgctgctgagtcgcccttcagttcaggaatctctgatcggcttattactcaaagcccgtcttatcaaagatcagtttcctcacggcccgagcgttactggatttcattttccagttgctcgcggcggatggctacttgttcgacaacttgtttgcaggcagtgataacgagctgttatcccgtatacagggttttgacccaagtaatctgcacacgcgcaccgtcgatgagtttgtgcttcagcatgagctgggcattgaagatgagcgtttcaatgcgtttagatctaaaattaacgagcttggtttttacgaggtaaccaaagcaacgtcttttcttcgccttttctatttgcttcggggtgacaaagagctcagcaatgagtttgtaacgcctatccaaaacgagttcacaaacaatctggtagaaacctatgcatctgtctggatgcgacatcgtgatttcgatggttcaggaaagatgcgcaaactgcttggcagtttctacaaagaaacgctgatcgcagcgcttcaccgctattgtaatcgtcatgccccaacactcgacaaagacgagtatttagtttctgagcttaatggctacaaaacggcggtgtctcttgaagttaaggccgatttttcagcaatacaaaacagtacactcgaaaaaataggcaccttcaatgtgtatctgacagtcgatgaacaatcgcttaagccaatgccaattagcgtcaaactacttgagattttggtcaagattgggcaggggtatcgccctaacaagcacgacaaaaatgctgttttgttacttgatgaagcattggaacagatactgacagtagctaagcaaaaagagaccttttttattctcaagggtgataagcgctacaaaatcgtgaaagaagaaagtgactattttgaagtgagtggtatgcactaatgacgaccgataatttcacattaccgataaaggccggtttgccacaaacggtagctgataagttccaaaataagaatacgttgagcagttacattcccattcgtacgcaaggcaatgattttgactggtcatcagtcgtgggcttagtcctgcgtggattactttgtaaaaaaataggaaagtacaattaccaagattttactgcggattgcaaaaacaacttacaaaacaaattgggtgaagaggaattttggagtgtacttgaagatatgtatttcactaatgaaaatatattctcggtaacccctgagtttctgttgtttaagagccagaagagtcaagataacaagtacacgcgcgacatgcgaatggcatccttgtttattaatttacttcaaggacagcaaattgaacgatttgaatctaacttgaacttcctcgaagaggagtttcttaaaacgcttttagacaaaacaaagtcagatcgtgacaaggacttccaagtgaccgagtcaccatatttgccctatatagcagaggcgtttaaacgtgacctcgagtttttaactggttatccgaaatacctgttggatgagttcgagcgtttcttggcattttatggctttgcttacacggctcaattaagcctatcgttgtcggattggaaaacaggtgaagccccaaccgcgaaaccgctgtatttcatcatggatcatgagcgcgccagcagtgaacgtatccatatcaaaaagcacggttacaagctttttagcgaatcgtctttcaagctgtttcccttcctctctatgctggaaaatcttcaaccaaacccagaaaaattaaaaaaacctttgtggcaattggcaaaggatattaagagttcagagcggagtgatctagctgggtatattgaaaattacgcaaaaatgtttcgccacaacagaaaacttgaaacagcaatacctgaaaaagcagaaaccgcaattgattggttggaatatgctttgaagcttgctgaagaacagttcagagaccctaaaaccgaccgtccggggactatcaaaaaatatattaaagcggttgaagaaaacatggctactggcttcgtgcaagctcgtggtcgctctggtcgggtgttagtactcactcaagaccacattattttgcttactaacctggtggtgggtaaggaagaaaagcttcgcttccatgagctgataattggcttacagcaaagggggatttttgttgataagcatacagaacaagagcttattaagttctatgagcgaattggcaacgttgaacgcatgagtgatagtggagatgcagtgtatgtgcgcaaaacaatttgaatcgtttctggttgagcagtttttactgcacgcgaaaggaaacatccgcgcaggctatcgctaccagtttaactctcctgaccatgctaatagtcagcgacttttcgatgcgctcttagcgcgaaaaggaggagagagcgaagctcgcaatggtgtagcgctgagctatttagacctagaagactgcaaagtggtgccagtgcttcatagcgaagatgcgtgtgaaacgggctttaccgaaaactacatctctaatttgcgtgacgaaatagcaagccaggaaggtccgttgaagggctgtgcactggtggtgattcacaatagtcgcctagatactctcatcaactcggcggaagatcttggccagtctggccaggtttggagtccagggaaaatcaaattcgctcttagtggctttattgagcaatctgacaaatctcgagacgtttcgctttgccttttggacgaccaatttgacgcgattttggaagatggtgcgaccatgttcggtttcgagtctttatacaaggcagttgaggatggcgagctgtgtttcagcgagctaggcatgtttgaggatccttttgttgctgagttatcgggcaataaaaaacagatcaaacagcgcctagaagaaaaccgtacgctttaccaagagttgtcgtttgaagtagagcattttggtcagcaactcgaagaaaggctgaaaggctttagtagtaggtttatcaaagaacatttttctgacgatggttggaaagatgtggagtttgaaacttatcgagaagagatcaaaaggaataagattcagaaccttaagcatgaaggtgaagacgagaccaataatgcgcaagtgattggtcgctacccaaaagaaactaaagcaggattgcgtgaccgtcacttgattattgcactggaagaagggcaaagtgagtttgaacttaaactgagcttttctggcatcagcgatttaagaaaagagcagtttaaagtctcgccagcgaatgcacttggcaaacaagaagtcatcagcacgcgcctaactagtaaaggggcaaacgctactctagcagctagttatgccaatgagcctttgtttttcacgctagcattgaagcgtgacaatacctctgaacaccataacttccgttgcttggttgtcagaaaaggcgagtttcacctcgaggcattcaaaaacattttcgccgttgagccttcaaaaaaacgccttaccttgaaaacggtagacaacagcttggttattaacccggcgctaactgcaaaccgaagactagatgatgtcggtgaagtggttgaccgcacagaatttggtgttgtcgattttgaatctttggccaacgagtcagaagaaatcagctttgtggtgaaatcaggtgataattccctgacattttatattgagggtgaacaggtagaaagcagcctgtccttcccattgctgcttaaccaatctcgcttccacaaattgtttgacgatcacgtgtttggcgagctttatccgagtaaagacgttgtcgtgatcgatcatagtgaatttcgcgtcatggagccgcgcattagcctacttcgttgggaagagtgtttcgttcagcaaaagcaagtctacctagcggaatccaacagcatggcgttggaacagttaaggtctattgatgacggtcttcactcagcataccaagcactgtttgactatctagcgagccgacgaacaactatttcgttggtttcgtgggggcctatatttacggcactcgtgaaagcgaccgtggatgcattccttgattatttcaacgcgatcccaactggtggcatgcttaccaaagagcaaaagcttgtgatgcaaatcggtttggttcgcgagaatggtgaagaatattactcgccattccacccaatggtgttggcttactacttaaatctttgtaatgaaatgcaaaaagatgacagctttgctgacttgccaactgtcacgttcaatcgcttggggccaagtggactgcttccgtatgtctatcatcccaagcatgggtttgcctacaaccagcaagtaacagaaaacgggttttgggttaaaagtgtccctcaccagaaaagttgtctgaagttcgttcgcaagctggttaaagaaaagatcaacgagttccaaaaagcgtttcgccacttgtttaccggctcagagaagagtgtgttggtgaatgccgtgaatcaagatcgtgcagaagagttattcctcggtttggttgactatgtaaaagataacctcgataaagcggcatcaattcatgtcaacctctacgatgatgagctggttttcaatgcatttgaccagtttgcagaaacgttcaattacgaagaattaaagtcttggttggaattggaccgagagaaagtgcgagaaaatgccgacaccattatcgatattctgcgaacccggctaacttacagcaagtttaccaatgctcaaagtgaacgcgaagggcaagcctactcgcacctgtcttttttcagaaacaacgacaacgtgaagttaacgaccttgagcgttgacgacatgcctagtggtattgcgtgtgatggtctgctgacgggcgacgcttctaaaagtgatgaaggctcatacttcactgcatttggtttgcaaaacgttcaatatagtaaccaaccacacttggaaatagcgaagtatgttggctcgttaatagaaccagcatttaagcccagcacacaatacacgggggccaatgctcctgctcttgcggtcagtgaagactttaaatctctgctagcgcgctcttatgacagctcgatttggaccaccatcatcgacccgaaagtgacgctagacttcttccacgccaatcaatgtatcgtgcttattcattattctgatcagtacaccagctcagccagctacgatgcgataaccgtgacggcacagcgtggtttgttcgaaagggtggttgcacaaagtggcggcaagcacattaacgagttcaatgccttcaatggtgattggctactgaagatgttgacttgcaacgacaccattcgcaaagagcgaactggcattatcggcgcctataaatttgcgacgtgtctggtgcaccaatctgatatcacctgggttccgctctcagttggtgaaatgatccgcgtgtcgggtaacatcggcctgaaaatgaccgacagtgacttctcacgcaatgtgcagagatataaaaaaggcgcgatttcagatgatatactgctggtgggctttaaagagggtaacctttatttgcttcctgtcgaagtgaaagcaggctccacgccagactacaaaaaagcagtacagcaagcgaatgagcttcgccgctatctaacagagcttttgagcgacgagacactggcgtcgaagctataccgaggcttgtttatgcgccaagtgttgatgcaaatcgacaaataccgtctgtacaacgtattcagcaatgactatttcgaagccctgctggcagagaaagaagagtggctacgcggtaaatacgcgattgcggagcttgagaaactatccagcaggtctagtggttagccaccttgaaagcggaagctgtttcgaacctggctataacatgcaggatggcgtgttgaaggttgaccttcctatgtctttgctgccttcactggtgcaacacccgcttcaagtattaatgaacgaaaaggacatcgcacagatctgccatgtgccggcggagtatatgttggtggggcagacagctttgaaaaaaagagagtcgctcgttccattagacgttgtggtcgaaaagccagaggatttaaaaccgaacctccaaacagaggagccgtcaaagttagctgcagagccaactccagattatgcgagtgaatgccgagttgaaattggtcagaatacgcttaccggcgaaaaagttttctgggagtacgggcacaaggatttagcaaaccgtcacctgatcatttttggtagctcagggcagggtaagacctactgtatacaaggtttgttgatgagcttggccgatgctcaaattcggtcgctggtgattgattatacaaacggattcttgccgaatcaccttgagccggagtttattgaacgaacaaatcctaaatccaatattctttgtaatgagccatttggtatgtctccatttagagctcaaaagcaagattttggcgggatttttctcgaagagaagcctcatatggtggctggaagggtagcctctgtttttaacaaggtatattcgacaattggcgagcgccagatcgcagtgctcaatgaagtgattgaatctggtgtccaacgatatggtagtgcttatagcttacagaatatgttggatgacctaaacgaggaagaaactgcaggaccagcacttgcaagcaagctggctcctcttgttaagtctaacttgttttcatctgacagtgataaaagttggaatgatgtgtttgagagtgaacatcaccgctcgacaattatgcaacttgcgtcgcttaaccacgatatttcaatgctttgtactgagtttttactttgggatctatactcctacgcatgtagttacggtagtaaggaaaaaccgattcctattgtattggatgaagtgcagaaacctcgatcatcgcctggagagcccattgggcaaaatgttaacggaaggacgcaagtttggggtatccctaattctggcgactcaaacgctaagtatgctgcgtaaagatgagcaagatcgtttattccaggcgtgtcacaagctgatttttgcaccagcaaaaacagagacaaagacgtacgcgaaaattcttgaactgagcatgccaggtacaaagcaggctgagtgggaaaagcaactaggagacctatccaaagggcagtgtttatcagttggctaccatttggataacggtcagttgaagatgagtgttaagaaagtgaaggtttcctccatgttatcccgcctgaacaattctaagggttgagcctggtaggtctatggatcgtagctttctgaaaaatttagttaatttcgtgctggcggcgaggggactaaagggctcctcataatcctttgatgttgttatatgcactggtaatcccccctgcattcaggttaggagaaaattctacttatgcctgcatcgatttttcggggggattaccatatgtcagatcaagtcgcgactaatacagattaccgttgttagtgtgccattttcatgctttgttagcaaagatgcggtgaatatcgacttattattttccattatttgtatactccatatacaaaatcttttaccgagcgatagtttcttaaccccgcaatcccatcctcaacatgtgctgcccaggctttaatcatatccttctgcgtcatctgtggataaagcatcttcaacaccaattctgtagtctgtaatgtctcccccagccacgtaattttatccagtaccagcgagccatccagcttcttggtatcccgctcaggcgaataacggaactcgctctctaccgaacggaaaaatgccagtcgagcagcgacattgggcgtaatccctgtatatcctttcaattttttaagctgctcttcagtctgacgactaagcaccattcgattcgggagcatcagatcgcctccttagttaattcccagaaatagccaggtttcagtgcagacgatttggtatgtgcattaaacacaatctcataagcatgagagatatcatcacgcaattgatcaacaaaataacgctcatccacttccgtatcagtagatagcagcactacctgatggctggcaaacgggaaatagtggttaatcagtttatcccgatgctgagaatccagacgtcctaatggcgtatcgataatcaccggtaaatcacggcctgaggtttttgctaaagcctcaagaatagcaattgcataaatttgcttttcaccggcagaaagcagcttacgttttatgacggatccttgttcatcaatcagctctacgtcaaacgtctctggggtaatgtgcgcactaagttgtaaatcttctttacgggccagtttgcgataggctatttcgaaattcgctgacagtgttttcactcttgcctgcgttaatacatcactgtatcgatcgagtaaattaatcgtttcttgagcgtttttaaaggtgctactcaagccatgctgacttcgggcaacatcatgcattttttgtacctgacgaacgcaatccagttgctgttgcttaattcgtttagcatcttccagcaatgaaagatatttttgccgctgtttttcacgttgcttgtccagttcgcgtagcttctcaaagagctccattaactggtcgtcttccggggcgcgggcaatatttgcagcagcctgctctaactgctgttcagtctctgataactgggtacggtaaagatcgaagcgttgccatgcctttttgctgtcttgttcaatcgactgttggagcataccggcttcacgttcagagatatcaaacagcaaatcgcctttaggcttagttgccatatactcttttagattatcggtaatcgcttcagctgctattttgccagttccctcagaacgaaatgcaatatcatttctgagttgcgttaaaaagtggctcagctctttttcaaagctttttgcctgtttaatctgcgtttcatcagtaatttgttgcagtaaacgagacaaaatagtgggcgcaagcgcataaggtagcggcccatcacattcctgacgcagtgctttttccagacgttccttatctttcaataacgcatcaactttctgcttttcctgcgcttttgtctgggcaaaagcccccccctgagcatttagcaaaccttcataacggatgatatctttagaaataaactcaatccgcgatttggcaaaatcggctctttccagtatctcttcagtctggcaggccaattctttactttgtttttcaagctctgcaatctgctgttgttgagaaaacccaccaactggctggattgctggcgcttaacaaaaatcattaagtcattacgcagtttggatatcagatccagacctaataaacggcgcactgcggtacgcaaaatattgccggattcatcttccgccagctccgcaattttctcgccatcaaaaaagaacagatcggcaatgccatgcgggattaattcattaagaaacccctggcactgatcgtaatccagctcactgagtggctgtccatcctgttgcagagataggcgatctttcttaccttttttccaggttcgcgtaacggtaaattccgcttcatggccgcccttattataggtaaaggtcaattcgacagcggcttcctcaggttgttcaatatcgtacgcaccgttgtgaattaacgaactaagttgctcgacatattcctgttgttgagtggcaaggccaaacgccagccgaccatatagtgctagacggatcgctgataggatcgacgttttccctgcaccgtttaaaccaccaaacagtacaataggtcgtggattcaaatcgtgtgggcgctttctgggggccagatcaatggtatgagtaccgttaaatacccgaaaattatgtaacactagttgtttaatgagcacgttcgttttcctcctcgactaaaacagaggattcactggcatcgacaattcttcgctgtagaacctgaagttcagcttccagcctggtgacttcttcctggtgaatatcccggtcgttacgtttttgtagtgctgcttgttgctgctggatctcttcgagactgccccagtcctgtctcaggatggtgcctaacttgtcaaagatcccctgacgtcggctcaggccttccatcgatacttccagttcgattaacttcatgaccatctcaggttcaacatcaaatccttgagatatctgcattagcaagtcagcatcactggcatcaaatcttgactggtcgtctacaacccaatccaaatctttttggtagacctcccgatagatacccggcagggcatcataccaatcgggctcattcggatcttttaaccattcctggcgaatagcatgtagttcaggttcagtgataagcgtgatggtgtggccctgagcattcatatctcgctcaatttccagtaaatctttcaaccattgctgacgatacttcatccagtaaggtcctggaacatgcttacgttcagcacttatttcctcgccatctttggcgtattgataactgaccttgccgctacggcgcttatagttacggtaagtgtctttatttgctggatcagtggtgaacgccagaagatcgcgatacttcagtaatggagacatccagacttcaccattctggatcaggctttccattgctttatcttttgtaaccacggtacatgtccagcatccaaagcgtgaactaccgcaagatggcgtactgtcatcgataacgagtggacattcgccttgtgctgaagagtccatgtacagtgtccacaatggacggttgttaccaccccatgggttttcccactcatcaatatcatctggagaataacggaatgcacctctgagtaatttccagacgtcttcagtgtcccaggtatcgataggggtatagataaatgcatttgcaagagtggtatgcctcgccaggcgggtaccatcaattttgtgtttggctatgacctgcgcgcgggatgcgctttcgctgctacgtgatccaagtacaacgatgacttcatcaaactggctgactttatctttaataaaatcgcttaccgggttgattttcatgcgctcagtacaccagcggaaactacgggtaggggccggataacctttacctagcagattgacccagaaggtttcgtgggtctttggcatgacagcatgctgagtgattggaagcccagcgcgtttagcaccggcttcgattcgttgcatggtcttcttgatcaaatccactacgactggtgtctctaccaatgtgtcggacgaaacaagaaacacatctttctgccgcatagcgggcggtagtcccagtagtgcaagatataccaaagtaataacagcgctggaatctttacccccgctgtaaccaatcacccatggacgcttatcggcacaatagatacgttgtacttcagatacgtattctgccaggggccgcccggcaaaattttcctggttgataaaatcttcgtaatcggccagatcgtgggcctgaattagtttactcatgagataaccatttgagcttcgagctcttgttcttcatttgaaagggggagcgataaggcgattttaagagcattgcaggtaagctggatagatgccgtcgtcttactgagtttaccatgttgcattgcacgtttggtaagctctgggctgcttttacgccagtcgaactctctaagctcacaaattattttctgccatgagtcagggtgctctgagagcaggcagtgacccagtaaacccagagcctgaagacctatgccgtgtgcatgaacatactcctggcgaagttgagcaggagatacctctttttttgcagctaattgccagtctggcatgacctgaaatatcgcttgccagtagagggccgcaaggtcagagcactgctcaacatcattggctttaggttcttttcccagcagagaaacgcgtagcttgcttgatgctgcttaaggtgaagagtttgtttgaaaacttactgatgctggatttttccatttcagttagtccgataaaaggctcgatattcatagccagataccgtgataagttcgaactgatatctctgtggtcgtaaagtgtagcaagagaagggcttggcctgatggcatatttgttcaaatcagcaaacatttgctgactgcgtttaagcccttcatctacaaagaataatacgggaatattatcttgtcccaactcaggccttgcatccagtgcgtcttctatcgctttcctgcgatgctgcccatcattgattaaaatttgtgcctccatgggcacccgcaaagtccctaagttattggaacccgaatactcatcgaactgcacatctactgcaatggaagcagttagagctgaaaaaacataatcacttggattttcaagtaagtagcggaccatttcaggtatacgggctttgtttaacgttctttgtgcgcgcaactcaggtggtacttcattttcgtcaaaactaaaaattttggggattatacgcattgggcaggtagcgatataaaacggtcttcctgcctggattcctctgacagcggggaaagagtagcaatagtcagtgtcgaaattcgccatacagaggttacctggaagtaatattaattttacgtaaaaataaacgttttataggcttgtgtcatctttttttacgtagagttttcgcttttttgggcgttttttcctgaatttggtgcgggttttaaatctatttgattcaatagcttatctgaacacctaaatcgtaagcttaacgttttaggagcgttttacttgctcatttaaacctctcacctaaacctaactctaaccctgttttctcttgtcctgatgagccttgcaagctcaaactaagctctccgcacacccaaaaaaacactcaccatcagtgactttccccagcctctcagctcccatccaacccaccaatcccttaccgatacaacgatgctttccccacagatcaaaatagcgctatcttcgccgcaaccacttaactcgcagcctgcatcggtttgctaagcagcgaattaggttcttgtacgtcctgtttcagttcctgctccagcgccaaaaaaaggccttcttcatgtcgctggagatattgattttaccgacgccataacgggtcgtttccgcgacctcgctatctttgttgcccgagccgccatgcagcactagcgggatattaattaactggagaagctcactcgctgaagccatgctggataagaaggtgcttcaggtggccctgggccgaaagtttctgacgacagacagaagcgggaatccgtggaagttatgtgtgatgcaacgggtctgtcgcaacgttgtgcctgcaggctggcagacctgtccctgtcaacctgccgttattcggctcagcgtccggctgctgacgcgcagctgtctttacgcatcacagagatggcacttgaacaacctgacatggtcgatggattttgtcatgaatgcacttaccagcggccgccagattaattgcctgatctgcgtggatgatctcacgaaagagtgtctgacgatcaccgccgctttcgggatgaatgtctgaatgagcactggttcagcgatgttcttcatgcccggaaaatcattaatgactggcggcaggactataacgagtccagacctcattcatcgctgaattaccagattccagctgaatttgcagcagactgtagaaatggaaaatcagaaggtaaacaaaccgacattactaactgatcattgtatctaatactgggggcaggttagaaggcccgtacagcaaagcctgagatgtctcgtatccatgataattagccacaaatcatggggtatcggatgggtttataaccttgccgatttgtcccaataactggtgtcctcgctcagatacgcgataccttggctttgatgagttttcgttataaacagtatctaccattccatcgttcatcaggttggttactatcgtcgcaacattgctaaatccgggaataccccgtgtagcaagggtgcgatccagtatcatccatgtccagtctatgtctttttctgccatgattttcaggatgttgagctttgtagtggttaacacgtatttctttgatatcatgagaaattatgtcaagtgtgaatgacgccttcccggaatgttttaaggcgagatacttcatcaagccattaaccaaaaatgaatggctgaaccgccaacagagcttctgaggcggttcctgaaacgactgttatgataaatcggtctggattaaatcttgatgatcaagttcttccagaagtcgagagccttgctctgatatctgatagtgatccatacctgctggggtttcttggtattatgtcaactaatcccgcttcggataagcccctaataagccgtgcaacattacccactccatccatttttcgctttgacatagcgcgatcaagattataccaattccaatttacgtcatttcttgaagctaacagcttaagaatgtttagttcagtgttgtttaccatgatggggcatccgaatgataaaggtcatcgccagttattctataatcttcgagagttgcagtgtgcgtgttgttccataaatcataagattcaatgtcatcggctggcctgcctgtttcccaacctaaattacagtaacgctgatattctcgacactcatgagtatagtaattcaagtctactttttcaggaggtatttcaccgtttgcaatttttttcaatctggaaaccataaagtcgttgccaggatcgggatcaaaccgtgatatgtgtttttctacgatttggatcccttcatgagtgatttttattccgtctgttgtcaggtgctctattgccccacctgctttttctgggtcaaatgttcttgacgtaaatgtgcctttagccccgaatacttctggtttctctaactcaggaaatcgcattcttcccattgtcagcccggcagcaacagatgcgccggtgataagtaaccctttgttatccatgacctgatcgtaacccgctggtgcattcccgccgagttgctctgcggtcttcctgaatccctcaatattgccgttgtaaaaacccccagcggccagaagccgacccgctgctttactgttgatggtttttgtagactgagcatgttgaatgggtgctgaccgaagaaacgcagtataccgggcgttttagttgatgtgagatcaggtagctaagccgggagtggagaaacaaaggcaggtcattccggaggttgccagaggatgtttgcacccccgtaatgacatgaccaattgcgtcatttcccagtaaaacaaccttcccggatcgaatgtcatccagcacgtcccggtatgccatccagggctgctgaaagtggaactgacgatatcggctgacaaaaagaccatagttgcccggtaaatcccactcccggatgattctatttggccgagcggtctcctcaaggtaacgcactgccatatccgggtggatgatgtcgggaaagtcatcaaggtagatatcatccactgattttgcctgatagtgatgaagcataatgtccctattagcgctaccattgcacacagcttacaaaacgaccgatgttgagtgaggtttaagactatcccttcatttaagaagagtgaagtgtctggcgatatccaggcgactaatcaaaaggtattttgggattacatgtaaattattgtctggcacctctgacagagaggtcatagaggaaaaatatcaatcatcctggtggtgtttacaagaagcgcctgaacccgaagcgcgatcgcgccattatcctggcgaaaggtggggagcactggtttacacgttcctttatgccaaacaggatatggcaaatattgataatcgcgagctggccggatttcgcgagttagcaaagcactatgctactcttagcgatgaaaagatcacggtactgattaagagtaaagaactggtggagatttgccatgactgcaaaaagtaaatttaagagtcctgcatttgaggccatccacagcgcggcttctggattattaagcgtcgatgctatcccgcaggaaacgatgcgcaactttgataaagcgtgcctcaacaatgtggatgagctgcaacccatcgagattaaggcattgcgtgagaagctgaacgtcagccagcccgtttttgccagctatctgaacaccagtgtgtcaacggtgcagaaatgggaaagtggggtaaagcgtccaggtggattatcgctgaaattgcttaccgtagtgcagaagcatgggttgaaggtattagtttgagtgagttgtactggctgcagcattaaatggaaatctgagtgaatcacggcgcagaaagagcaattttaacctcgataattgggagaaatcggctttaagccatacaatgaagaaattgaggccgggaaaattcttaaatttattgaaccacaatctcatgagcaacaatatgagattgtaaggattagtgcagtaacctggggagaatacaatgaggaagaaagttaaactctccctgataactctttatttattgagtcaggaagagtagctgttggtgattttatgatatccgggactaatgttattgatgttttttcctggtgcgcttcttattattttctgccagctaaaacttacgctttatattaaaatgattttatagcttacttatttaactctgtttttagctggacttttcttctctttcctgatgatatatacaggtatttagcgcggtgcggatgtgcgccaacacacccgcgccgctaatcacaatcactatttagaaggaatagtaatcatgactgacgcccattctattgcacaaccgactgaaccagaagtctctcctgcaaataaccggcaattaaccgttagctatgcaagccgctatccggattacagccgtatacccgccatcaccatgaaaggacaatggctggaagctgccggttttgccactggcacagcagtagatgtaaaggtaatggaaggctgtattgtgctcaccgcccggcaggagagcgaaaactgatgcagtctctgcgccaggtatgcaagctgtcggcgcggaaacaaaagcaggtgcaggagtttattcaggtcattgccggtaaacagaaagtcgtctgaatgaaaagccgctcccgacatcgcatcgggaacggttaactatcaggatgcgtaaagtagaacgatggaatttcagactacatcctcgcgagcctctttaacctacggaacgcttaacatcaaaggcgtcggccggttactcgctgctggcggtatctgtaacgataatagtgaggggtttcgtataacgctgaacagtttggtggcgatgtcttcagcaactgattagtgtcaggcggggaaacccccggttaacctgtatcacagattagataatagttgctttagtcaattcaacaggaaagcttgccccttaaaattataaagggcaataattaaactatagttaattgatgtttttcgtattttaatataattatcgtttgagcgcttattgcactctgtacccggtacctgaaatatcagataatcgcgggtgggttttccctggtgttgacttggtctttgacctcctgaccgctaagcatggtgagtgcccggtggtcaggtacttttttaagtatagggtctgcgcaggtgtaataaaagctgtcttaaaagacaggggtaatggttcccatgtgtgattatcaggaatgaatgaatgaattctgctattgagttttttttgcgtgattacaatgaatttccgccagaattagcaaccgaaactctaccggctcagaagaaaaacatttcgtgacaggctcgactggaaagtcgaatgcattgacggcatggaaaaggatcaatttgacaacgaaaatacgacttacctgctgggcatgcataacgggaagttgctatgtggtgcacggtttatagattcgacgcagccgacgatgatgagcgaaatttttcatgaatatttcgagggtataagtggtctccccacagatatcccctgttgtgagattagccggctgtttttagataaacaaagacgtgactctgcaggccttcatggcttgcccgccagtaaagtgttattccttgcaatgattttttattgcatgaagagaaactatcgggggatgtacgctgtggcaagtcgcggcatgtatgcaatatttcgccatgcgaactggaaaatagaagttattcagaaaggcctttctgaaaaaggggaagttatctactacattttcatgcctgccagcatgagcatcgtggaagatattatcaccagggacaaagccagtggctggcttcgtgagatgtcccggcatttacgccatctttaacccgtaacgctggctcagttgtccagcagccggagctccgtcccaagttttaccgcatgtgtggcgttattcactccgagctttttcatgacgttgcccatatgaaattttacggtgcgttccgcaatagataaaatgaccgcaacttcggcgtatgttttcccggcgccgacccacttaagtatctgccgctcacgcggtgacaaaaaaacgttctttttctgattgtgttgactgtataagttaagcgtcttctgatgcaaattaataagaaagctaactatttttgaacgatttttttccatgtcgataccagaatctttctgactgataatggatagcaaagccaggttgttcaggtagtcatgcagagggaatgtctgtccctggaaaatattatattgaaagctttcattaaaaattcgcgtgagattgtagccgcctgacagaatgacgttgttttcccaaaaaaaatcttcaacacaacgtaaactctgaataatgacaggatcaataaactgatattttctttcaaggtatatatcgaaccactcagggttgttattaataatacgcatctgtgaagggtctttcttgttcataatggcgtaggcatagataatacccttgtaatcctcaaagaacgcattcagttcactctggattaacaaattgattcttgtatcgttgtagtatgtatccttcacgtcagtatctacctccgggatgagtggataaaccagtataatccgcttcgttagctgttgctaatcgtattttaatccagttaaaggacagtgcaaacgacatctgccagaaatatcctgaatatttttgctttacaaaacggatggaaagagcagtttacaagattacagatgaattatcgggattcacaaaaatctgcggggacagcaggaacattcgtataatgattcgcgattttaagttattgctgactggagtgaaccgacatcagcatttttcataacaaaactcatgctggcaggcgtaattaaacagacaccgagtcagtatctgactgcagatggtttttaaatcctgatgctcatgctccccttcggctacccagcgttaccgggtcgtcagttttctgctgcgctaacccctgtgggtttcggacataaggcctgatggcaaacgttcaggtcaaccctgcagccggcttaacgcctgcgctttcactggccatatagatgatgacaagcgagtgttaatcagcatgaggcacatcaggtcgtgtaagtaggccagtaatctgattactctcctgaacagcaagcctctattttagctcactattggttactactggtttatgggattgataagtggtttttctatcagaggccagggcgcatggggatgtacaggggcaataatatgttgcaggatgtccccatgctttatcagataatcgtaacagggaaggggcgttaatcatgaaaaacaagatgatgctgggtgtcgtatttctcttaacgggatgccccgggcctggcgaccgaatggtggagcgcgaatctacaacggcatttatcaaagacaagcaagtttgtgtggtgtcgccactggagccacaagaaaggattactgccattcaaatcaacagcgataaaagcaactctcttcacaaaatttttgatgacaagcctgtttatattccaaaaggtgagtgccttcctgtgtttggatttaagttcacaactggagagcattactatttcgcctgtgatgttcaatctgataaatcagcgtcgcatttagtcactgctgatttttcttatccaaaagaataggggggcataacggccctttgattctcataaatgcacgcatgtcatcaggccaggcttaacgacttcacatctgcggtagttaaggtagttaccaatgatgggacatcactcttattcatgggggcgaggcaatgaaaaacctgtttaagtggtccgcacttgtggctgccaccgtcctcattcttattggcttgtttgtctggcttgttgcatcgggctctgatgaaacgactgtctacaaagaaaatgactttttcagctatcacacactgacagacaaggacattgaaaacgcgccgcgtataacggacaactactattttgaagcgcaccctggcgacggttactcaccttcaaatagcatcatatttaagggggctacagatactgcatcgctgcgcgcttatctcgaaaagttgggatacgtgaagcaaaatcgcagtctgggcgagaaggaaatatgggcaaggcctgatcagttggatggggatctgttctatctgtactttaatcccacaacccgtgaggttgagctgaccagggttctgaataattgagtcgcctgaacgggaaattgttacggcgatgccggtctctgccgctggtcatcacgctgctgctggtgggatgcgcccgctctgacgcgctgtggacggtcacgcatgacctctgcatgaataactatcactatcgtcgcgatccggcaccctgccagcaaatctatctgccgcaggacagcacccagggctacagcatcatccagaatcctcgccacaggttgcactttattctggtgcccacggtggcgatgtccggcattgagagcattgcgctgacgcgccccggacgtcccgattatttcggctacgcctggttaatgcgctatcgtctgatggcggcctatggggctagggtgcctgaggatcggctcggcatggcgctgaattccgcttatggccgcagccagaatcaactgcatattcatctgacctgcctgcgggaggatgtctatcgccagcttcaggccgagcgcccctatattaataatgactggcgacccttgcccgaccgtttgctgaatcacacctactatgcccgtcgcgttatgcagccgacggcgatggggatctatcctgttgcctccgtggcacgccatttccggctgtcgccgtcgcagctggcagagtctggcgtggcgctcattccggcgacgttttcgggagagaaagggtttatcctgctaactacccggcgcggctgggataagggcaatcgggcgtccgttgagtcgctactcgataaacgctgcgcaattctttcaacaccgccagctgacgtttcagtcgcgaagtaactaaaccttatcacccttaatcctccaccgacccagccactctgctgtaatcaaacgctctgccagcaagaacctggctgacggggacgatcgcccgtgcatcggtttcgtaaacattgaatcaggttcgtgtccgcccaatatagtgagatcgcatagtcatttatcagaccagtccataggtgacaataagtgcgaaacaaacctcaggatactgcccgcaaaataagctctgatgtttttatagacaaacccaagctagacttaataaaagttattaactgttattaaaagaggtgatcactatgggttctcttacaaaacagaccattagcgcacagatacccaccgatttggctaatgctgtagaaaatctggctgtggagctggattgttctaaaagctggatcatcaaggaagcgttgaccactatgctggctgaaagggaacggcgtcatcagagcattcaggctggtcttgccgatgtagatgccgggcgtgtagtaagtcactcggaccttgttgaatttggtaatcgtttaaagaaaagctgataaatggaaatttactggacgcttaaagctcaggatgacctgaaacgcatctaacgtttttctcttcagtacagccgccagcatgctgatgatgtcttagaccgcctgataaccggcagtgctggcctcaaggcacacccagcaatcggcatacagcaggttcgatatgaacctcgggacgttcgaaaggtgatactggatgactacgagattcacgacgaacttcgtgataatgccatctacatcgtggatctctggcatacgaaagaagagcgatgagcagatctcttttcgttgatggctcttgcttactgacctgatacttatttaaagctcacttctcaaaacccaaaaaagacaccgatccatcagtgcctttcccatactcaactcgcaaccaatccctcaccaaccccttaccgatacaacgccgctttccccaccgaactaaacagagccatcttcgccgcgaccacttcactcgccgcctgcatcggtttaacaaagagggaattaggctcgtgacccccaagcttcagttcctgctccagcgccacgaagaaacgccttcttcatatcgctggagatattgattttacccacgccataacgaattgactccacgacctggctgtctttgttgcccgaaccgccatgcagcaccagcgggatatcaaccaccttacggatctgctgcaggcgctcgatatccagcttcggctgcttccctttggggtagaggccatgcgaggtgccgatggcgaccgccagcgtgtcggtgccggtctcgcgcacaaaggtctcggcctgctgcggatcggtatagagaatctcgttactgccgccttcgccgctgccttctgccacgccgatggtgcccagctccgcttccacagagacattaatcgtgtgcgctatctcgacaatcttcttcgtcagcgcaatgttctgctcaaaagggtgagacgaggcatcaatcatcaccgaggtaaaaccggcgtagatcgctttcatcacctcttccagcgagcggccatggtccagatggatcaccaccggcacgcgcgcctgaatcgccagcgtccgcagataaccgataaattccgggccggtgaaggccatctcttcgggatggatctccagaatcagcggtgaatccagtcgctcggcagtctcaaccgccacccgtccaaactccgcgctggcgatgttaaacgcaccaacgccaaactgatgctgtcgggcaacgctaagcagatctttcatgttgtaaagcataggttttatccttgttttgcaggaacggagatatcttttttcaggaacagcaggatcagcgccgtcagcagactgcctgcggcaatcgcaaacagataacccatgacattgctgatcacgttaggaatgaagatgacgaaaatgccgccgtgtggagcgcgggaagcgcagcccagcatcattgagagggcgcccgctaacccggagcccgccacaatggccgggatgacgcgcagtggatcggcgaccgcgtaagggattgcgccttcggtaatgaatgacagaccgaggatgtaggtgaccttgccggtctcacgctcctgctcggtaaacttgcggcggaagagggtggttgccagcgcgatgcccaatggcggcaccatgcctgccgccatacaggcggcaatcggtccgtaaaccccgctcgacatcaggccaatcgcaaacatacagacggttttattcagcgggccgcccatatcaaaggccaccatcatgccgaaacagcaggccgagaatggccgcattggtgttacccagcgaactgaggaaatcggtcagccagccgagcagcatttttatcggctcaccaatcagcagcgccatcagtgcgccggtcagcagcacgctcagcagaggcacgattaaaataggtttcagtccggcgaccgctttgggcagatggatatggttattgatcagcagcgtgatgtatccggccaggaagccggcaatcagcgcgccgagaaagccggagccggtgtggatcgccatcatcccacccacggcgcccgccacgatgcccgctttgccgctgacagactggctgatccccagcgcaagaatcggcagcatcagcgcaaaggcggaaccgccaccaatgtcagagagcatcttcgctatcgggctgaagttcgcgtcccctggtgtggccgccgtaattccgaatgaaaaactcagcgcgatcagaatgccgcccgccaccacaaacgggatcatcaggttcacgccggtgatcaggtgcacataaatctctgaaatccaggaacgggaacccgatgtctcacgggcactgttagccggttcagatgcactggtctgcggcgcagcgtctaccagcctgggagccagctcgccgttaacaatggcgtttaacaggccttcagcgtccttcgcggcacgggtaacgggcacctcaatcacgtttttgtgctggaagcgcgccatctcaacttttttatctgcggcgatcaacacgacgtccgcccgatgaatatcgtcgtcgctgaaaatatattcgctttcaatcgcaccctgggtttcaactaatacattcaggcctagttttttagccgctttttttaaattactttcggcaaggtaggtgtgggcgacacctgtaggacaggcggtaatggcaataatgttcataaatgttctccagtgaaaattttatatttatgtttttcggtctgaagggatggctacaacctggaatacctccttaattttttaattcatgctgctctccggtttattcaggctcccgatcgggataagagtaaatgaaatatctcttcgcgatgcgggacattaagtaattgctcgacaacatcctcatcgcctaacgcaatggatattttggcgagcattttgatatggcccacatctttatcggactcttttactgcgaacagaataaccagccggactttagtgccgtcgatggtctcccacggaatatcctggcgtaaacgacccacggcaatgcgggttttggcgacggcggcagatttaccgtgtggaatagcaatatggttttcaaatccggtagagcctaattcctcacgcagataaacatctttcaggaaagcgactttatcggtgacggcgccggtctggcagagcagatcggtcagctgagaaataatctgctctttggtctggcaatcgacatcgagaataatgcactcttcttttaatacttcgttaatagccacggctgtcgtcattttgcttctccattatcattaattaatcgaattcgataccagacactccgttacccgagcgatatctttcgccgagaacagggcagagacatacaccaccggtttttccagcggttccagccggatggtggaaatcaccacgtcacactcatgtcgtttcagggagtcagcaatatttttccctggcacgatgtcgataatcttccagtcgggaaaggcacggataatgcgtccgtaaagcagctgcgaggtgcccagaccgctggagcagaccagcaatacccgttttaccttgatgctgttttcgatggccgcctgaatgtgcaccgtcagataagccacttcgtcatcactgatctcatccaggctgtactcctgcgtcagctggctgattaccgctttcacggcggcgaaaacaccgtgcccagctcggtctggatatcatgcagcagcggatttttaatccggatgtgatatctgaggcggttcagcatcggcttgatatgcgaggacagtgaagcctgcaggttctggtcggtagtgatttcgatgttgatgcgctgcgccacccgggcgatcagcgcctcagcaaagcgggtttcacgctctgaaatcagggagtcatcgtgctgtggtgactcaccgcccgccttaccggaggagaccagatactgatagatggagtgagactcctcggccaccagtaccgtgttgtaagcggtctcaatgcgttctatcaccgccagtgacacctgccaggcgtgatggtcgctcacccggttcatcgacaccgcgcgggcgtcggtcctgtgcatcggcgagtgactgcggtggatcagtaccagaatatgcgtaaataaattgatgtagtaaggatcgcttatcgtatattgcagctgctgttcaataaaattaattaattgcagggtaaaatggacagcctgctgaccaaacttctctgaaagctcctgcagcgtgctttcatccagacggctttccatcatgtcctgacggttataaatcgattttaacaccagcgctttcatcgccatgcgaatattatggtcgctgccttttatgctggttccgacgcggctttttaacaaggttaaatcaaactgatgtaaccatgcttctaatgtttttaaatcattcactatcgaggcgcggctgataaaatatttatccgccagttcgctgatggaggaactttttggtgacagcattaataaatcagacgctattttcagcatcctgaagttgctgctgaaatcatccacctcggttgagaaaatccggcgcgcggctatttccgactgcgcatcagcgaatttaattgtgatccctctcccactttttccgctgaggttgattccctggtcagaaagtttatcgttaatgtcggcaatatcgcggcgtagagttctggttgttatagacgttttttctgaaatagcgtgcaggctcacataactgttatgagaaataagctgtcgcataatcgtcagttgccgttcagtcagcgccttcatcatcatcaggttccgcttaatccgttattcgccttgtcagttatcatctaaacaaaggcactatgccatgtaaatattaaaacatggccacaacctggtggtcaggctgaccacctgacagtgaatttcttaaataatcggggacgaggtgaaagaataagtgaaaggggatgggagggtttggcgggctgactggcagtgatccgattggtgggactacatcaatggctgagggcagaaacctggcgggaaagcccggcttacgccgggccaggttttatctttacgccatcttcaaacgctgcaatcgtttctcgcggcgaatcttgcgctcttccatcaccgcaaccagcgccatcaggcagatacaggcgatagcggcggcatccagtgcggcaaaggtgcccgcccagccggtcaggccaaatatcggcgtgccgtcggcaatcatgcccaggcccagtttggcgaagctgtcaccaatcagataggcgaaagtgcctttgatgccatccgctgcgccaatcgcttttttcggtacaaagccgactgcggcgacgccgattaacagctgcgggccaaagaccaggaagcccagggcgaacagcgacgccagatagacatactggttgctggcatgctgatagatcccgagcgtggcaataatcagcgctaatgcaacgcaggcgaccagcgcacggcggccattggccagatcggataaccagccccacatcaatgtgcccaccagtgcgccgacttcaaacagggtaaagccctgaatcgccacctctttagagagcttcagctcctggaaggcgtaaaccgttgaccactgatcgatcccgatgcgcaccacatagaggaagatgttggcgaagcagagcagccagatcaccttgttcttcagtacgtactcgacaaagatctgccatttggtcatcgactcatcttcagcttctttgtcctcatcgctcagctcttcgtcaaacagctcttcggccttgcccaggccataagactccggagagtcgctgccgtagcgcaggccgataaaaccaacaatcagcgcgataatagacgggaagataaacatcccaattacgtggccgtcgaacagcacattggcgccaaacagcgcaacgcccgccgcaccggcaccgccgaggttatgcgagatattccacatgccaagataagtacctcgtttgcggcgcggcgtccacttagtgatggtggagtagctacaggagccgccggtactctggaagaatccgcttaaggcatagaaggcgatcatcaggaacaggctgacggaaccggtgcccatgctggcgctgaaacccagcatacagatggccgagaggatcagcataaacggcaggaactgcttggtgtttttgccgtcagcataataggagaccagggttttcccgacgccataggtgatggagaagcccagaccgatcatccccagctgcgtcatgctcagtccgtaggtggtgatcatatcgttctgcgcgatattgaagtttttgcggatcagatacatggtcaggtagccgataaagaccaccagataggactgcataaacggcttgaaccacatcttgcgccgcagtttcgatgggcagatccagcgtcggtctgcgcacctgtttgaggaatgccagcatggaaggggattctcctggttggaatagctgcaatgggcagcgaatggctggcattgtaaaaacctgccgccagactggcctgagacagcatccaggcgaaaccaggaaaatttcttagttttgccccactcggggcaaaaaggagaggcgtatcacgcttcaggcagggggcgcggtgcctgagcatttaaaaacggcagcagcagcagggcggatatccccgccgccgtggcaatcaccgcaaagaagccgctccagtgccagacgtcgataacccacgccagcggccagccggagagtgacgcaccaagataggcgaaaaggccgacgaagccggttgccgcgcccgccgcatctttatgggaacattcggctgccgccataccaatcagcatctgcgggccaaagacaaagaaaccggtagtaaaaaagcaggctgcctgcatcacgtaactggtaaacggcatcagccatagtgagccgacggaaagcaaaatcccggctgcaaaaatcaggttcatcgggccacggttgccgttaaacagcttgtccgagccccagcccgcgaccagcgcacctatcacaccgcccagctcaaacagggtgactaccgagttggccgtgaccagatctacccccagcgtgtcggagatgtagagatttccccagtcattgagcgcagcgcgaaccacatagaccagcacgtaacagagtgatagcagccagatatagggattgaatagcacatagcgggtcaggatcgccttgcgactcagacctgcgccttcctgctgctgcgccatctccatctcatcctgtcgccagtcgcctaccgcgggcaggccgacagtctgaggccggtcgcgcagacgccagcagagaaacagtccggcgaggatcgctaaactgcccgcaatcatcatcccgattcgccagccatagtgcagcgccaccgcaccgataacgatcgggataaccgcaccgccaacgttgtgcgcggtgttccataatgcccaccagccgccgcgctcgttacgtgaataccagctggtcagcaggcgcgcgcagaccggcgcgccccagccctggaaaaaagcgttgatggtccacaacagcgcaaaggcccacagtgaggtggaaaagccaaacaggatattgaccacgccggtagcgatcagccccagccccataaagtaacgggcgttggagcggtcactgacgatgccggagaagaacttcgacaggccgtaggtgatgtaaaatagcgtcgccagcaggccaatatcggtgcgcatcatcacgccgctggcgatcacttccggcgccgccgcattgaagcttttgcgggtaaagtagaacagggcatagccgatccagatggtcgacatgatgtgccgccgccagtagcgatagcggctgtcaatctcacttttgtcctgcagcggagcggcgttagcgggcgttttcagaaagttaaacacggtgattcctcaggccatacgcagcggcagatgcacactgacgcgggttccatgggtgcaggagatagtcagcgatccgcccagcgcactcacgcgttcgcgcatcccgaccagaccaaagctctgctgaccggaacctggcggcagaccgcagccatcatcttcaatcaccagcaaaacgcgaccattctgttgccagcctttgagcatcacggcgctggcgctggcgtgtttcacaatgttgttcagcccctcctgacagacgcgaaacagcgtgacgcgctgcgcttcgctcagcagcgtctcatcaatacgccactcaaggtgactgacgatgccgcaatcctccagctccatctcacgcatcagggagcgcactgcctgttcaagtgacaggtcatctagctggcggggtcgcagacgtcccagcagtcgccgcactgaatcgtagacacccagtgagagctgctcaatatggacgccgctctggatcacccggccattatccggcgcaaggcgctgcacaatgcccgcctgggtgcggattgctgtaatcgtctgaccgatgtcatcgtgcagctcgcgcgccacctcctggcgcacgttctcttctgtctcgaccagccgtttccgccaggcgccggttgcgtgccagctcactctgcagcgactgattcagctcgcgcagccgctgaataccggcacccagcagcagtccggtcaggctttgcgccagcagcgagagcagaagatcgaccggatgatcgtgccaggtctggctggcgatcagcgcgattgcgttcatcagcgtcgcgatcagcgcaccctgccagccgtagtgccaggccagcgcaataatcggcagcgccagacagaatggcgtaaagcgcgacagttcagcgggcaggccaagctgcaaccacagactgatgacaaacagcagcagataccagataagatgccgggcgcgccagttgaccggttgcgagaccagcgccggtcccagcggctgccagcgggtgctggtgaggtagtgccagatgaccaggcaggtcggggccagcgtcagaccaccggtgagcgtcagcagcagggcgttcagcatctcctgctgtcccgcccacgccagggactgcagcagcgccgcggcgatcagagccgcgccctggctcagcagcgtgcgccagtcacgctgatggcggtaatgggagatcagcgccaccggcagcagcgtcagtacactgcccgccattaacagcggcagatgcgccagcgcgaccaccttcgccagccagatcagcatgatccactcagctaccagcaacaccggccagtaagcgcgtggacattgcagcatcagccccagacgcaggccaaacggaaatagcagcaccgccagctccgggcgttccaccaggtgcaggctgatactccacaggcagaaccaggccgccgagaagatgaaaaagctggcgacaacggagatcagccgcgaaacacagaggctcattgccagccatcaaacatgcggcgcgccagctccacatcattgctgacgccgagcttctccatcagattcgcgcgatggacatgtacggttttcggtgacagcgccagctcaacggcaatttcctttaccgccatgccctgtgacagtttttccgccacctgacgttcgcgtcgggtcagcgggtcctgccgaccagcggccagcttgatcgcaatctctggcgtcagataacagccgcctgtggagaccgtgcgcaccgccgcgatcagttcatcgggacgacagcgtttagagaggaatccgcgcgcaccggcattaagcgcctgctccaccagggccggactgtcatggactgacagcatgatggtggccaggcccgtcggcagcttgctcagcagctccagcccggagagatccggcatcgaaatatcgcagatacagacctgaacgccccggcccggtaaacctgccagcgcctcacggccagaaccaaattccgctacgacctggaaatccgattccaggcccagcaactgggcaaagccggagcggacgataaggtgatcgtcaataagcgcgatggtgatcatgtttattcctggcgggtaaaatcgcgcttaccttagcgataagcacgaagctgttcaagtcgtgagcagtctattcaggtaacggtgtgggtagggtgatgcaggtcaaactgtcgtggatcgtgagaaaagcatgccgggctgaattgccgcccggcagatcgtgaggctaagcagtcgatcagtgcagacagcactgcttatattttttgccgctgccgcacgggcagggatcgttgcggccgggcagtttctctgccgcgacaggcttctggggaacgggaatcgcttctggctgggagatccagtgatcgtgtagcgccagcgcagcaggacggatagcttcaatgctggcttccatctcgtccggcgtcatggcatcgatcttttcaaggttctcttccacgccgtgcagagcgatggcgtccagcgcgggttgcaggtccttcggcagggcagaccagtcggtcagcgcgacaccgcgcatgtaaccgaagcaccactcttccaccacggtaaattccagaccttccatttcacggatgccaaacagcggttcgaactgctcagggaattcagataagcggtcagccacatcattcatatgctggaagcaaagcgacataaagcgcgtcatttcacgctcgttgctccattttgggatctgcttctcgccaccccacagtgccaccagccactggcttggctcgacggtgacgggaccggagagaacggcagtcagcaggccgtcgagctcggagacatcaataatcgatgcttcgctgccatatttttccagcatatcttccagccattgcagctctttttcggacagtgggccttctttcatgcggttgcctcccgggcatttcaaaatttcagcggcgttgagccttaaaaccgcagcagtgtacacccttgtggactgcaacacagctaaccctgttcgggggagctgcggtgattaaaccgcgtttagcaccactttcaccccgttgtgcaggcgatagcccacagcactttatggtacatttttgcgctccagccagacagttgcgtgttaaataataataagttaatgattaatatatgaaaaatggatttactggcaggccggctgttgcagtctcccttgcacggctgacccctggcggccagtggatcagcagattaatgacgcgattcatgccagcctttatcttcctgctggcgggatgtggaaccctgtcgcaaacctccgccccggtgggcgaccgcgtttatctgacacacgccacctttcatgaaaatgtcgacgacatcgtgcagcattacatgcaacagaagcaggttcccggcatcagcattgcggtcattcatcgcggtgggccgacccgctattacgcttttggcgtcaccgatcgtgtgcatcgctatccgatcacgcccgataccctgtttgcactgggatcgctgagtaaaggcgtgacggcagaagtgattatccagctggttgatcagggtaagctgcgctggagcgatacactggccgatcttctgccggaaggcgttcgcctcagcgctgacgcgcagcgcatcacgctgctgcagctggtgacgcacacctcgggtctgccgcgacaggatatggatctgacgatgctgcagcagttcgttcgttatctggacaccggcgagaacttctatggcaatcttgatagcgacaagctgctgagttatctggcggacttctctgcacccgcggtacgcatgccacactactccaacctcggctatgcgctgctcggttatatcctgcgcacgcgttgtcatcaggatattcagacgctggcgtcacagcttatcttcacaccgttaaaaatgaaccaaagcagctttgtaccggaaacgctggcgggctatccattgcgtgcgctgggccatgcaggtgatcagccaaaattaatccgccgcggcacgctgacgcctgactggcattttcacggcaacatggtggccgcggccagtctctacagtaacgcgcgcgatctgagtgcttatttgcgcgcacatctcagcgctaccggtgatgctgcgcgggaccgggctttcgcggcggtagatcaggcgtggtatcagcagggcgcgcaggcgcagaatatcgcctgggtgaccgacactttcgaacagcagcagatcacctatcaggtgggctatatcggcggctatgccagttttatcggctacgataaacgtaacggcaatgcgattgtggtgctgcagaacggctttaactggagtaactatttaggcattgcgttgttggtcgatctggcaactcaggataaagtggtcggacagtgatccgctacctggcctgtgtgcagtaaagtgaatagcgctgtttttccttacacatagcgtcagtgcgccggaactgaagtgcgataaacattgtctttagcctgactgtcaaaattcaacgtggaaatcattatgcgcaggactcaacgtgtacttttatcaatgggattactggttggctcgctgagcctgatccccgctgtacaagccgctggcgaagcaacggataccgttccgccaccgccgcagattcagcctgctaatccggatgcgcagcccgctacgcctgatacgggcagcgttcagccggatgccggtgccgcgcaaagccaggcgccgaccagctcacaatctaatgatggtattacgccgaccacgccagcaccttccaacggcgcgcaccctaattacgacctcagcaccatcatcatcgactacaaacagtatcaaatcggtgacacagtgccagagaagtacaccgataaaacgtacaccatcaatgagtggcaaaagcgtaatctgcctgctccgcaggaaaacacccactgggcctatatcaacgccaattacattcttattactaatgacaccggcaaaatcgtcatgggtaaatcgggcgatatcttcttccgcggttaaaataagcgcggttaaaataagcggtaaaaatcagccggtcgtgatgaccggctttttttagctgaaacgctcagcaccaaagcttgccagcatcggatgcttttcaccgcttacaatctcctccgccagtaattcaccgacaatcagcgccagggttgcgcccgaatgcgtgaacgccacataacagcccggcaccttctgcagttgccccagcaccggatcgccatcgcctggaatcggcttcaggccaattttccagctctggacgctgagcggctcgtcaccccgtaacagctgactcgcttcctcggccagctttgctacaacctgcttatcaatatggtaaccgcctccggccagcttctggatatcagcctcgtaccagtcgtgatccagggcgtaacggttgccggggtttggccggatggcggcgcgaggcgtgttcagcaccgccttgagttcatgtttgcccggctcagtgatcaccagcatggagacgggcgatccgttgggaatcgtcacgcccagtggcgcaatcacatccggtgtccagggcccgcaggcgaccaccaccgcatctgcccgcagttcgcccagctcactgcgaatgccgcaggcccggccctgatcggtgatcacactggctttaccggcgtgttcaatcacttcaccaccccacgcccggaactgattcaccagatactctgacaggtgcggcaggctgacccagccttcaccggggttaaatatcgcctgcgacggcagcgcgtcgggatcgatcgtcgcatccgcctgcgccacgttatcaggggtcatgagttgcgagtcatagccgtgtgctttctcataggcgtgccgcgcctgcgttccggctgcatcattgctgaaccagcagaccccgccatcaaaacgcagccagtcgagggtgggttgttgagcaaacagggtgcgatagcgatcaatgcccgccatgcgcagcgcgtgataggggcgggagcgttcacccgccgagttgagccaggagagtgaacgtcccgatgcgccggaacagagcgcggcttcggtcaccagggtcaccgccgttccccgttttgtcagctccagcgccgtcgagacacctattacgccaccgcccagaacaaccactttcatttcagtttttaccgccattatcagattccttgctcagttacagcacttcagagagaaaacgttgcagtcgcggcgactgtggcgtatcaaaaatggcgcccggcggcccggcttcaacaatctcgccttcgtccataaacaccacctgatccgccactttgcgcgcaaagcccatttcatgtgtcaccacaatcatcgtcatgccgcgacgacagagatccgccatcagcgtcaggacacccttcaccagttcgggatcgagcgcggaggtcgcctcatcaaacagcatgacctcgggatccatcgccagcgcgcgggcaatcgcgacacgctgctgctggccgccggagagatcgcgtggccggtgatcggcgcgctgacccagacccacttcttccagccgctgacgcgcaatcgccatcgcctgcgctttgggcaggcccttaacccgccacggtgccagcgccacgttctccagcgcgctgtgatcggggaagagattgaaatgctgaaacaccatgccgatccgtaaccgcagcgcatctggcttgtcgcgcaacactgaccgatcagccagaagtacatctcccgattgcggttcatgcagccggttgatgccgcgcagcagcgtcgacttacccgaaccggatggcccgataatgcaggtggtgctgccgggcgcgacccgcagcgagacattacgcaacacctcaatcgggccataagccagagtcagatcgcgcagctccaggctggcaccgtgccagctcgcggcagtggtgctgttcaggttattcatggttgcctccgatccggggatgagtgaccagtgcgccgccgggcgctctgacttcatccacctcttttaagccactttgcggggcagtcaggcgacgtcggccggtgcgataacgcacatcgacatagttgaccatgtgcgtcagcggcacagtgataatcagatagaacagccctgccagcatcaggggcgagaggttgccggtgagcaccgccgcatcctggcccacgcgaaacagttcccgttgctgggtcatcaggcccagcaggtaaaccagcgaggaatctttaatgatggcgatgaactggttaacgatggcgggcagtacgcggcgaatcccctgcgggatcaccaccagtcgcattgcccggccataactcatccccagcgcacggcaggcttccatctggccgcgttcaacactctgaataccggcgcggaaaatctcgcccatgtaggcgctggcgatcaggctgagggcgaagatccccagcggatagggcgtaggaccgaacagctgatagctgaagcgcgccaggccctgaccaatcagcagaatggtcagaatcgatggcagaccgcggaacagatcggtatagagccgggcaggcagacgcagccagcgtgagggcgagatgcccatcagcgccagcagaaggccgaatagcgtgccgagcagcgttgccgccagcgagataatcactgtattgaccagcccggtggtcagcatctgcggcagtacttccatcattgatggaaaatcaaagaaggtgcgggaaagaatcgtgagcaagtccatcgccgtctccatgcagggtgggggatcccccggttaactcaggacgcgaacgtccgcatctttactgcccgccaggcagatactgttttggcatcggcgatccggggaaccacttctgatagagccgttgccaggtgccatcctgcatggctgctttgatggcactgtccagcgcggccttgaaggcgggtttgcctttggcaatggcaatgccggccggtgcatcaaacgaggggatgtcggcggcagagaccagcttaaagcggtcggcgtagctttttgccgcctcgtagtcgaggaagattgcgtcgagcgtaccgttgttgagcgcagaaactgcgctgttgttatccgggaagcgcacgagatcggtctgggtgaagtgttcgacggcatagctctcctgcagcgtaccctgaaccaccccgagccggtgttttgccaggctggcgacattcttcacgccgctgtcgtggcgggtcagaacggtgagaaatcccgccagatagccggttgaaaaatccaccgtcttttcacgcgcaggggtgatgccgatagccgccaccgccgcgtcatactgaccgttggccaccgccggcatgatggccgagaagtcctgtccaataaaatcgaccttatcgatcccgatacgatgggcgacatctttgaagaattcgacgtcaaagccggtgaactgaccgctggcatccgtgaaggtgtaaggttttgagtcgccgacgctggcgatgcgtagctgacccggttcgatcagcccatagggattgttatcgctggcagccagcgtacagaaacgacagtgaacagagtgcgagcgtggtgccgagcagtttgcccagggtggtttgcgatttcatagctcatccgtttttgcaggtttaaacatcagagactgttgagccagcgattattattgagaccggtctcaacacaggtgacaccttaagacactgatgttgtgagaccggtctcaaggggttacaatgagtttaagcacagccttttttcggcgtcaatattcctgtcatcaacctgtgattcaaaataattatgaccagccagaaacgacaatctaaagcgcctaccgtggcggatgtggcgcgcgcagcaaaagtatctaaagcccaggcggcgcgtgcgctgggtggctatggggcggtcagtgatgaggtgcaggagcgggtcaacagcgcggcctccgcgctcggctaccgtctgaatgccctggcccgcagtatgaacaccggacgttccaataccattggtgtgattgtcggcgacattgagaatccccatttcggtcttgcgctgcgcggtatggcggatgtggcgcgcactgccggttaccatctgctgctcagtaacagcgatgagaagttgcaggctgagcaggatgcggtgcgggtgatgctggaaaagcgggtcgacggcatcatcgttgcgccctgctgttcagaacaccgtcacaacagtcacctgactcaggtactggaagagggcagagcgctgaaattatttgatcgcgcagtcactgaccttgatgtggaggcgatctgctgcgaatttaccgaagtggctgcagaagcaaccgcgcagttactggaagcgggccatcgccacatcgcttatatcaccagcatggcactggcaaccgactacagcatgccaggcgattttggcctgacgccggtcgcccagcgcgtgggcggcatgatgcaggcatttgctgccgcgggcgtggaatttgatccgacgatggtgaaagtgaatgcgctggacgaagcggagattgcccgtatcgtggccgagctgtggcagcgtccgcagccgcctactgcgctggtggcttctgacagcgtggtggcgatgtggctgctgcgcgaagtgacgcagcgcggactgcgaatcccttccgatctctcattcgtgatgtatgacaattttccatggagtgagattgttacgccaccgctgacggtggtggcgcaaccggtgtatgagatgggccgtgaagcggcacgacgcttgatcgcggagatacgcggcgaagccgtcggaccgatgccgcgctttgatgcccgtctgatgattcgccagtccattgccgcaccggccagcctcatcagtgcggaatgatgcggttaacccggccagcccggtaaccggtatatcgcctgactgatgcgttcgcaggcaatgggtctatcattttcgccagttttggtccttttttatcaattatgatcgtggcaatctgcagagataatctgcagccaggaggcaacatgtcacaacataccaatcagtacggacagccggtcggtgggccaatgccagactggcagccccgacctctgccccagcatcaggtttttactggcgaagtttgtcggctggagccgttcagtgtggcgcgtcatgctgaggcactgtttgaggcatgggcgctggctgaggatgggcgtgactggacttacctgcctgccggtccctttaccgaacgtccggcatggcaggcgtatgccgcacagcttgaagtgagccgcgatccgctgcattttgccgtgatcgatctcgccaccgaccaggcggtgggtagcctgtcgttaatgcgcattcagcctgaacatggcgtaatggaagtcgggcatgtcatgttttcggcccggctgaaacagacccgcatggcaacggaggcgcatttcctgctgatgcgttacgcctttgagacgctgggttatcgccgttatgaatggaaatgtgatagctgtaacgccccttcccgtaaggcggcggcacgtctcggttttcggtatgaaggcgatttccgtcaggcgatcgtctacaaaggacgttcacgtgacaccagctggttctcgcttatcgatagcgaatggccgcaggtgaaaaagggcctgaagcgctggctggcggaggataactttaccgccgacggtcagcagcgcgaaaagctggaggcgctgcgcgacagaccctgacagggtgataacgggatcacattaaaatatctttcaggaccgccgccagcagggtggtggtcatgagaatagataaccgtttgatccagcgcatatcggtggtcagggtaacaacgtcatttctgaggctgtccacagccgaagttaatcggaaattcatttcactgagagcgacatccagcttatccaccttggcttctaactgattaaaacggatggccagtttgtccgtttttctttcaacatggccaagccgctcgtctatctgatgtacttttgttgtgagctgaccaagccgctcatctatctgatcgactttggttgtaagctggccgagccgaatgtctatctgatcaacttttattgtaagctggccgagccggttgtctatttgatcaacttttattgaaagctggctgacccggctgtctgtctggtcgactttcaatgtaagattgccgagtcgatcatccatcaggtcgactttggtcgtaaggtgactgacccgatcgtttgtctcgtcgaccctggtcgtaagatggctgaccagatcgtttgtttcgtcgattttagtcgtaaggtggctaacccgatcgtttgtttcgtcgactttggttgtaaggtggctaacccgatcgtttgtttcgtcgactttggtcgtaaggtgactgacccgatcatttgtttcgtcgacttttgttgtaaggtgtctgacccgatcgtttgtttcgtcgactttggtcctgagctgactgacccgatcgtctgtctggtcggcttttgcctgaagctggccgagccgaatgtctatatggttggctttggtctgaatctgaccgagttgctttccaatctgtccgcctggctgcctctgctgcatatcagtaaacacctccaccatcgcctccgcttgctgatcgtcgatccctgcctgttgcagcgctttaaaggctttgtgggtactcatcattgtgcttgtcatcacgacacctccctgtgcacttcagcgataacggcatcatgacaggcaaaagacgtatcgccactaagccggttatattttgcgcgcctcgccgaaaaatatcaattagtacaacaagtaacgtgcagcagtgtgcgggctgtctcgcaacatttagctgatggcaggatgaggcgactctgcggaaatccgcagagtcggaaagagaaaagcgggcgtcagggctgtggcacgattttaatttcaaccatgccgatgcccagtttgcgcggatcctgaccggtgatattgccggtgttactcagctgcggttcaggtggtgcaatcaccagacgatggctggcgcctgggttatcaaaatgcagggtatgtgtcgatatctcttcactcagtgacagcagttgctgctgatcgccgacccgcaccggaatcgcccggtgcgtgttggggccatacgcacgcgcggtgatcaccagatcgaacttcgcgggcagcgcatcgatatagtcgatatgaacctcgggcgcgagattagcgttagaccagcgtccccagctctctggccgtgagatgccgctgaagcttttaacactctccggcgcgccaggcacgtcgagccggaagctgtcagcgctgtagcgaatgttgttatcttcaatacggatctgcgcgaggtttctgctggtaacgcgcatcgctgatagcgccctcggggaaacggactttgcctttccactgcggtttgtcgacatgcgtcaccgacggcgtgccgccgagctgtcccattgccacacagagatcgccggagagtgccagcgaaggctgccagagtcgcgccattttaaaacagcgatccacccagaggaatttatcggctgaggcgaaatccgccagctgatagcgcagcggtgccgaatattccccctccggcatcggctcaacgtgcttatcactgatgcggaacagaatcggcaatttgaaggtggtccccgagaagctgaagatattcttcgcctgatccaccgtgaagttgtctatcttcttcgggaagttccacagctggataatgtcgggcttccagctcgtcaccttactcttcatatcgtcgaactgggtggagagtgaaagcgatgagaggctgctgcggcccaggccaatcgcgttatcgccgccgagaatatcgagcagcgtggcgccgttatccagcgtgctgcgcttcgcctccatcaattccgcctgcggcttgtcaccacggatcaccatgaaaagattgcgacggggctgtttgaccagccacggatgcgcagtgttgttcatcgccagatgatccgagctcaccacaatcacggtgtttttgaaccacggcgacgctttaatgcgcgcaatcaggcgcgccacatgttcctgcgagcaggcgaccgcactgaatgactgattcggtttgccctcaatgctgtagctcctgcgatcgcagctgcgtgagataaatccgtcaggatgatgggtgtcgacggtcagcgtaaacagcgcaaaaggtttaccggcctgagagagttcctgatacttctcaaacacctcatccattaccgtatcatcgtaataaccccagttattacggtaggtgggatcggcgacgcggcttttcagctcctgcgaaccataaaggttagcgggatcaaaaccgtgtgatttcaggaagacatctttcccggcgaaacgcagatcggcaccctgaataaaccagttctcgtagccggagttcttcaggatgtcgcccagacagacgttctgtggatagaagctggagagcgatgctgacgcattgccatcaaatggggcaaacagcggaatgccacactgtgaggcgaccatgcccgcaatggtgtaatcggtacctggcagctgttcggtttcgctgaagtcgatgctctgctctttctgccggctcagctccggcgctaagccgggaaaggcgatagggtcaaaataggtgcgctctaagctttcaccatagatgtaaaccacgttgaggtgcggctgttcaatgcgattacgcggcactttatagaagttgtcgaagtcagaatctgccagttgggtatgcgacacaatcagggtcgcgacctggcgaaaggccggggtagtctgcaccgagccgagtgcgcaggcggcggccagcagcgaccagcccatgtgatgcggacgcttacgccgccgcagaatccacgacagcaggcagaacagcagaaacagcacgatgatcagcccaatcgccggcaccacatatttactgacgcccgcgccggtcaggctattggtcagggtatagagcaccgcatcgttgatgccgtcaccggtaaaatagttgctggcatagagggtggcgttcagcacaacgaaaagcaccagcagaataagaacgacaataaaccagaatttgttacgcccggctttacaggaatagattgcaatagcggccagaaacaacgcgacggacaccaattcggacaacggcaaatcctctcttcagggctacgcgaggcttcacgcaaccggccaccttcgggggatggtttttcgacaatctatattggctgtaatccggctgcaacatatccggcccgatttgtgcggtgaagagcagattggtttattgtcatttcagaagtgaggttatcaggcgtgacggtggctggcgcgcaccgtcagcagagcagaagtcagggcgattttcagagtttgccggtgagatattgtgcttcgccgtcggcaaaactccagtcacctttgtcgttggtgataaagctgatcattaaatcgttgccctgcacaccacaatgctcacgcagctcacgcgccagctcggccatgaacagctgtttctgttcactgctgcgtgggctggtatagacccgcaccatcaccagattatcgctccggctgaaccccagtccggtatcctgaaacaccatctgatagcgcttgttttcctgaacaatctggtagcgatcgcgttccggtaccttaaaggccgtgagcacggcgcggtgtgccgcatccagcagtttacgaagatctgattctgaacgaccctggataacatcaaattgcagcagtggcatagcggattcctcccggtgattaagaaccctatggtgacccctttatccggcgggaaaaagcgcgtagcctgaaatgattattcactatagtgaacaatcacgatgaaagagatgaaaacggatacgctgtgggatcatctgcactggctgaccgtactggcagagcagggcagttttacccgcgcggcagagcggctcgacgtcagcaaggcggcgatgagtcagaaaattaaagagctggaggagatggccggtgtgttgctggtacaacgcactacgcgcagcgtgcggctgacctctgccggtgagaagctggtggaggagctacgcgagccttttgcccgcattgaacagagttttttcagcgtgcgggacaccgccgggccggtccgtggcctggtgcgcattaccgcaccggtggcgtttgcccgtcagcaactggtgccgattatcggtgagtttctgcgtgattatccgcaggtgcgtctgcagctggatgtgactgaccgcattgtgtcgctgagcagcgagggatttgatctggccattcgacacagcgacaccctgccggaaacccacgtggcactgccgctgtgtgacacgcggacattactggtggcatcacccgcctatctcaacgaaacaggggataccgcagtcgccgcaggatctggcgcagcataactgcctttactatccacgaggcgtcgaatcaccgcgctggcggtttaccaccaccgcggataacgagcaggtccagatacggattcagggcagctttgccactaacaacagcgagtcgatacgcgatgcggccctgcagggattagggatcgctatgctgcccgatttcagcgcccgggaggcgctggcagcagggtcattgcagcaggtgctgcctgcgtggcagcctgttgaggcctttgccgcccgcctgtggatcgtacgaccctgggcggcgcaggtgccacgcgcggttaccacgtttacacactggctacgcgcgcgctttgaccgttgatggcaatgccagcgcaggtggcgtggtgtgcatcatctcgccaatcaggctgctgcggttatataaaccaagccgcagattgaagtcgagatgcagccgctcgttgccggttaattttataatgggtggcggcgtctgtggccgctgctgaaacatcactgactgcgcaaaggcgctgctgctgtcggcatgcaggcgctgatagaaccaggcgctggcttcacttttacgcagatagagattcgcccgccggtattcccgcatcgcaacctgctgcgccagcgacaggagctgacgagacggattctccatattctgcacaatcagcggaaaatcatcacgcttcttcagctcatggaaatagttgcggatgccgacgtttttaaccggcgccagctgtttcagccattcgcggataaacagattttgcggggcggcagcaagaaaccagctctcggtgatcggcgcaagcaggttcagcgttgattgctcgttatagtaaccaatgagatccattgatcgcgattcgtgaacgcgatgcacccaggcgagattctcaaacagcaatgtgctgcaatcaatgccgatgccgccataacggtgaatcagctcaagccggatgatttcacttttatgtgccagcgtcagatcggaagagataaagttgagatcgggcagccactgcgacagggtgcgctgcgtaatcagataaacctggtggtcggggttgtcccgccggattttactgatattcagcgccattgaggcaggcaggtgatcgttatgccagaccatccagacgatttttggaatctccggcagatctttctgctgcgcgatcaatacaacattatcctcctgacccggatcatattccggagcccgacagagtttctgctgttttctattccataacatctggctactgaacgatattcttttccagttacgccagattttatgcgctggacgttggcgatgtgaagtcatggtacacctgttatttttattttcccgtcatagtgcaggctctgcccgttccgccagcggcgggaacggccggaattacatactgactgcaatcccgatgagtgcgggaattaatgaatagttttccctggtggcgacgcagtgctggagcgcgcgatagtttcctcacggctgtttaattgcactgcacctttttaataaaacattatttacacattagctatgtctttttttgactttaggataatacggaaataatccggtcacgttatgaaaataataatgtcgtcactgttaatcatttatttaaatgcgggaataaacgcagttaaggaatatctgaatattattcttaacctgcgcgttatcctgcggcccgggccacaggaacagtggctattgtccttaactggtggtgtaagcccggctcatcaatccgcggaatcagacagcctgaagaggattgtctacgcttaagaagaacttactgagaaaggagcgcgcatgcagagtgaatcttacgggttactggcggttgataagcagggtaatcgcgtcctgtttcttaatccggaaaccttcgcggtcgagcgggaactgaacgcttttccaccgcggccgcatgaactcctgatgctggccccctggggtaaagcctatgtacccatttttggcgacggcgttcatggtaataacccgcatccgggtcacaaagtggcgattatcgatttacagcgtcgggagatcagtggctttatcgatctgtcgccgctgcgggcaccccacagcgggcagctgggccgcgatggcaaagtctatctctgctgtgagcagagtgccgcagtggcggtgatcgatccgcagagcgacaaagtggaaaaaatcattccaattccttctcacaacgcgcatcgcctgacgctgtcacccagcggccgcaagctgttcaccgataacgaagaggatgcgaccatcaccgtggtggatctctgtgaagcagaggggcgggtcatcgacaccatcctgctgcccgggccgattgcgggcatcgctgcctctccgaaacacccctatctggtcgccagcgccgctgatgcaccgttgctctatgtgattgatcggcaaagccaccgcattcgccagcgcctgacgctgccgggtcatgaacggccctgtcaggtggtacgcttcagcgccgatggcgagcaactggtggcgataggggatcaggaaccgctggtgacgctgtttgacgatctgctgaatccgctgggcgacatccgggtaggtaacatgccgatggatggctgttttacgcctgacaggcaacagctgctgattgccaatcaggatgatggcacgctgagcgtgatcgatctggcgcagcgtaaagtgattgccacgccgcgtgtcggaacgggctgtgaggtgctgggctattttccaatcggtcagataaacggacgatgatagatcgcggaactccagtggcggctgctggcgtgcttctccgcctgccagccgcgtttacgtaattcgcgcgcaatcatcttattcatgatgccgtggcccagcagcagcaccgtgccttgctgtgaatgctcgatcagcttctctgccgccgccgaggcgcggctgcgcgcatgttgcagcgactccgcttcacccgcatacccgcagaaccacaatagccgcaacagggccagccagcacagggtaggcaactgcaccgcgccggttcgcagcagtggcacggcgacttcgctgaacacggcatcaacctcatggggctgcagaccgagctggctcagggaggattgtgcgcggggcaggggactacagacaatcaccgcggcctgacgtgcaatctcaatactgcgcggcggcggcccgtcactgacctgtgactgatcgtaggcttcgcaccagtctgccagcgcctgcacgctctggcgacctgccgcctgatgatcgggtttaccatgtcgcatcagaataatggtcataacacctctgcccggactttttgtcagagtaacgtattgtctgcgcttacagcgatatttcagaataaatacacgtgtcatctcatggtcacaggcgtgtgcgacaacagagcccgatgaaaggattttagtcagtcttataacgcttaatcataagagaaaatggtaacttatagtcgatggtgatttttttcaggcgatgtgttgcgggtaactggctgaatttgcgctaaaaatgcgtgacgacgggatgtgatagtgaagttttactaataattttcatcaggatctattgatttatctacgcgcgtagatacactaggtccccagtgattgctcacggtgcccgatgcacagtaggcccatcgattgttaagttacattcgctcagtttaagcgaccggtgaaaaatacaccggcgaaatggggcgaagaacaagattccaacaccagggaatcctttaacctttcatcatggttagtcaactgaacgtcgtcaccggggaatttccgcttttatcagggaatcgacccatggacgggcgtttatcgatctgcatactcattcagggatagggttatgacggcacacaactccgttaatcagcaggcatcactgtcatccacttcagccgccgatgagcggtttaacaccccttcaggccgcaaagatttctggcgcgccactttctcatgctggctcggaacggcaatggagtacgcggatttcgcgctctatggcctggcggccggtatcatcttcggcgacgtcttctttccggaatcaacccctgccatggcactgctctccagctttgctacctggtcagtcggctttgttgcccggcctatcggcgcactctttttcggctggctcggcgaccgcaaaggccgaaaggtggtgatgatctccaccattattctgatgggcgcttccacgacgttgatcggcttaatcccgagctatgcctctattggcgtctgggctcctgcctgtctggttctgctgcgctttacgcagggtttcggcgctggcgcggagttatcgggcggcacggtgatgctgggcgaatatgcgccgacagagcgtcgcggactgatctcctccgtgatcgcgctgggttctaacagcggcacactgctggcttcgctggtctggttgctggtggtacaaatggaccagcagagcctgctggagtggggctggcgtattccgtttcctcagcagtgcgctgattgcgctggttgccttgtggattcgacgtcatctgcgcgaaacaccggtgtttgagcgcagaaaagcggaaatggaagcggaacgcgcaggcgtactggccgctccggtggtggatcagcggcctttcttccagcgtacccgtgccttctggaccatggttggcctgcgtatcggcgaaaatggcccctcctatctggcgcagggcttcatcgtcggttacgtcgcgaaggtgctgatggtcgacaagtccgtaccaaccactgcggtgttcctcgcgtcgttgctgggtttcctgatcattcctttagcgggctggctctctgaccgctttggtcgccgggtggtttatcgcgtgttctgtctgttactgatgttctacgcctggcccgcctttacgctgctcgacacgcgtgaaccgatgctggtgatcccggttatcgtggtcggtatggcgctggcgtcgctgggtatttttggtgtgcaggcggcatggggcgtggagatgttcggcgttcatcatcgctacaccaaaatggcagtagctaaagaactgggctcgattttgtccggcggaaccgcaccgcttattgccgctgctatgctttcttataccggtcactggtggccgattgcggtttatttctcggcgatggccgcaattgggttctttaccacctttgtcgcgcctgaaacgcgagggcgggatctcaatctgcctgaagatgccatctagctttgcctgaggatgccatctgccaggatagcgcgaaaagcagcaggccgtgtaaagcggcctgtttttttatggaggaacgtgatgtgcctaagtcgttaacgggaaaagtgacccgaagtgaagttgcgaaagcggcaggcacctcagtggcagttgtcagttatgtcatcaataacgggcctcgtccggtcgccgaggcgacccgtcagcgggtactggaggcgattaaagcgaccggttaccggccaaatgcggcagcacgcgcactggcatccggcaacaccaaaaccttcggactggtggtgcccaacatcggcaatccttttgtggcctcaatggcgcacgtgttgttgcaggagtcgatgaatcacggccacgtcatgctgctgggtgatgcaggtgatgaccgcaagcgcgaaactggagttaattcagggactgcttaatcggcaggtcgatggacttttttacaacagcgttgatcgccatccttacattgacctgattaaagccagcggtacgccactggtgatgctggaacgggttgagcctcagccgggcgttaacatgctgcgggtcaatgagcgtcaggccgcctggcaggtgacggcacatctgttgagtcacggttatcagcaggtcggcataatcagcggcccggtcgatatgcttaacgcgcaggatcgtattcagggctggcgtgatgccatgcaggatcgcggtctgccgattgatgaatcgctgatgtttcccgccagctacaccccacagggcggatacgctgcggcacaaaccatgatcgcccggggtcgtgtgcctcgtgcactgtttaccagcaacgaaggtcaggcgattggcgcgcttcgcgccttttccgaacatcagattcgtgtgccgcaggatgtggcgctggtctgttttaacggtaccaatcactcgtcgtttcacgtcccgacattaacgaccgtgcgccagccactgcgtgagatggctcgctctgcgattcatatgctgaaagagggacagagcgaagcgcaattaaaggagtttccacactaccttgaaatcggtgaatcctgcggctgtgagccgcaaagccagagttagcctataaaaatatgaaaagaattattattgactgcgatcccggcaacggtatcgcgggtgccaacaccgatgatgggctggcgattgcgctggccttagcttcacctgcactgtcgctggaattgatcaccaccgtggccggtaacacgccatgtgaagttggcgcgcgcgtcgccaaagatctgatcgtccggctgggattatctatcccggtaatccagggggcgacgcaggcgctacaggaagatcctgcgccgtggcgcgagacgctggataaccgggtcaatcagcttgcgctgggtgagatgtggcagggcgtgcgccagccagcggatgtcgcggcggatgcgattgatgccgctgacgctatcggcaaactgatttgcgacaatccgggcgagattaccctggtggcgattggcccgctgacgaatgtggcgctggcaatgcagcgctatcccgccatggccgattctgtggcggaaattgtcatcatgggcggtgtgtttacgctggatgattatatcaaagacaccaattttggactggatccggaagcggcccatcaggtgttgcacagtggtgcagcagtaacgctggttccgatggatgtcaccacgcagacgctgctgacccagcaggatttgacccgcctgaccgccgtcgatcatccactgaccgaatttgtgcgcgatacgctgcgtccctggatcgactattcgatggcgacccggcagctggcgggatgctggatccacgatgcgctggtggtcgcctggttgctgaatcagcgggttgcgtcaggcatcgattaccgggtggatatcgaactgcgtcccggtgcgacgcgcggcaaaagctggcgttatcgtcagccccttcggctcactgtcggcgtgcctgagcagtgcggcgcatcggtgcatgtgctgcatcgtgtcgacaacacgctgctgttatcgattattgaacaggcatttaagcgcctgaaatcctgatgtcgtgggcgattaactcgcccgcttactggcggcggcggatcggtttcctgaagatcgctgtggccatcaaacgctgacggtatctgtcagtttgtcagccgcatcaggacgcgggcagaaggtgcagggcttgtgtgagctgatatccggcattacattgcttcgcacacgtcgatccagcgggcgttagtcagttcagccatcagctgtggggtaatgcggacggcgctgtggatagcgccggcggcgggcaggacttcctcgaaactgcgcagtgagacatcacagtaaacggtcagcgggttctcaaggccgaaaggacagacgccgcccaccggatggccggtccagttaatcacctcgtccacgctcagcattcgcgctttcgcccccagcgccgctttcagcttgcgattatccagccgggcatcgcctcgtgtcacaatcagcaccacgtcgtttttcactttcagtgacagggttttggcaatctctcctggcgtcacgccatgggcgcgggcagccatcccgaccgtcgcagtgctttcggccagttcaataatttcaatttcaggggcgtgttcggcgaagaaactggcgcacggactccaggctcatctttctctccaggctgatcgaaggcgtaaaaattgccacaagcctcagtgcctgtaaacgagataaacggagaattcagcgtaattaagtctgtttagctgccgctcagggtgcagttgccgcattgttcgacatcgggaatgcgataacgctggcagcagctgcgacggaccagttcgccgttgcgcgggatcatggtgcggtagagcgggttttcgctgccatccagcagccgctggttgaagaacagcgcctgctccagttgcagcaccagcgactcatcgatctggcttttcagttcacccaggaaccactggaatgagtagcccatattgttccagatgagtcgggcgttgatatcaccatgctgcgtaataccattgaccaccgggatcagatgctgctgaatcagccgatcgatacgctgctgagggttaaggtagcgcgcttcttcatcctcctgcacatcgatccagaaagtggccggatgaccattttcatgaaaaccgacgcggatatgctctggcgagcagtccagcgcacgcgactcctgcaacagcgccatgatcagtgttggcagcagcaggccaaaataccattgcgcccagagtgacagcaccggtttcgcttcacgaaccgcatcaggatgatcgcgatagaggtaatcgctgtagcgctgaataattggggtaaaggcttctgattgtgaccaggcggcgagggtcagcgtgtcgcgcggagcaggctggctgagcttcgtcgattcaagcagatagctgcgctgttgtttcagccgctcatgcagactttccgccagtggacggtcattctgccggaagatcatcgactgagcgttaaaacgctgttcctgagctgaaacggttgccatgacgactcgcgaaaagtgtagataagaaagcaaatgataatcgttattgattaactctacaagtcgtgtaaaaaatcgtcgttgcgggtgggaaaacggcggggttgaggtcagttatccgatcgggcagagcagcagagagccgggcatatcgcgccgaagcttcagtgattaccgatggcgttacgtttaattaggcatgttcactggcggcgtgatgctgttttcggggtaaatcttcccaggcgagaatggtattccggccctgatttttagccacatataatgcgctgtcagcattggcgaccgccaggtcaaattcattatcataaataggcgcgatgccggcactgatggtgacgtgggttgaaacggtttcattgaaaagatgaggaatttctaaatccagcacgtactgacggattcgctctgccagtttcatggcgatggaaaactgttcacattggtcatcaataccagaaactcttcgccgccatagcgggtgacaacatcgcgtgaacgcaccgcatcacgaattgcgacagagacccgcgccagagcctgatcgcccatcgcatgcccgtaattgtcgttataggacttaaagtgatcgatatccagcagcagcacatagtggctgccagtatggttttccagaatattatccagccggttcttaagaccacgacggttataaagcccggtcagtgggtcgagcatgctgaggtcgctgaatgtctctttctcttcgtagagctgatgcatcaggcgcagagtaaagttgtcggcacggcggcgcatcagatgctgtagtgagaaaccaatcagcggcagcgtaatggttagcaggatcagcggcaggtgctgtgcattgtcgagcagcaatacggtgagcaccggtggcgtgacatgcagacaaaaagcccccagataatcgctcagggcgatggcactgataaataacacactgatcaaactgataataagaaagccaccatcaaaatagaacacctgatgaaagcgataattaatatgccaggcccagagcattcccagcagcagcgccacaggatttaacaggggaagttttactttaggccatattaaaagggaaattaacataatgccgctaaaggccgcgacactcattaccggcagggtcgtctcacttttctcactgctcattattggcagcagatgaaatagcgaaacggcgatattcagaaacaggaaaagcatcactgaaagccggtatttactctgcttcagctcttcataggattgtaatttcattataagtactcgtgacgaccctgaaataccaaagcgcacgccggcaaaaccaggttctgccagacaatgagcaaattattgctgttgctgttattaaaggtgttatcggccgcaatctagcattttccaactggtctgtcatcttcgttgccgggcgtgacaaaaacaggctgcagagcaggcaaaactgtcatatgataatgggaatgcttatcatttgaggttggtgtcatggggatagcgattatcgcggcctgcggcttgtggggagtcagttgggcactgggtaaaaagctggatagtgcgtggggcgtgttgctgccgtgcattgcgctgccgctgttcgccttatgggaaaccgagcttcagccagtggcggatggtgatgacggttgcgctgctgctgacagttgtgatgctgtttaaccagcggctgcgtcactatctgctgctgccatcctgtctggcgttagcgggcggactggcggctgtctctgtgaattttcatctgaattaacataagcggaatggttaaaaccggcgaacggggtaaagcggctggaaaaggtaaagcgaccggaaaacagaacaactggaaaaggtaaaacgagcagggggtaaaacgaaactacaggggaacagaagagatgagcgggaaaggcctgaagatgacaacgttggtgcgaagagagggacttgaaccctcacgtccgttaagacactaacacctgaagctagcgcgtctaccaattccgccaccttcgcatcgagttgtctgttcatatcaccgcaatggtgcgaagagagggacttgaaccctcacgtccgttaagacactaacacctgaagctagcgcgtctaccaattccgccaccttcgcgcagtgctcgcgatatgaaacttgtgattttggtgcgaagagagggacttgaaccctcacgtccgttaggacactaacacctgaagctagcgcgtctaccaattccgccaccttcgcatacccgtaacaccttgagaatgttacaaccacggaggcgcattctagagattttactctttgcgtcaacaactatttcgtcgggctgaaacgatcgctgtaaaaaacaacgttttcagcccggcaaagcagttaacggcaggaaaaacccttagcgcgttttggcaccgcgaccatagacggcacggtaaactttaaagcgcccggtttgcgcgatgacttcgtgactgccgaaggcttcatccagcgcctgcggatagggcaggaaggtgttggcaacgatacgcaactcgccgccggtattcaggtgcttcaccgcaccacgaatcagcgcctgtgcggcgtcgaggctggtctgagtgccttcatggaagggcggattagagataatcatgtcgaaacgaccggttacgtcagagaagacgttgctggcgaagacttcgccctcgatgccattggcggccagcgtcgctttactcgcttcaatcgccgctgcatgcacgtcacacagccacagacgcactttaggcgaacgggcaggcagcgaggcggcaatcacgcccgcgccacagcccatatccagcactttacctttggtgtgtggggtaaaggtcgacagcagcagggcactgccactatccagaccgtcacggctgaagacgccaggcagggtatgaatcgtcagaccatcaagctgatactggtgaccaaaggtgctggcatcgaattcaggctgtttgtcgaggcgaccgtggtagagaccacagcgacgcgcgctgtcgatcttctccagcttcacccatgactccatcatgccttcggcgcttcgcacgccgctgcggttttcaccgaccacgaacacgtcgcagcccaccggcagcagcgacagcaggttctgcagctggaactgcacttccggcttattcttggtccagaagtagaccagggtatcgcagccctgcacatcttcggcctgagcaaccattccgtaacgcgcctgctcgcccatacggcggctcaggttttgccagtgatgatattgctgggtgtgaacgcgcgatgaggcggtttccagctgagcgggcaggtcatcctgcagatcgccagcaaataaaacatggcgggcggtaaattcatcactgtggcgcagaatgacttcgctggccggggtaaaagcagacatgtagggctcctgtaagatctgagcggggattatagtggtttgttggcgcatgttcgatgggtttgctagcatagcgtcgcattcaggcagcagaacaggtaacaccatgacgtccaggcgcgactggcttttacagcaaatgggaattacgcagtaccaactgcgccgcccgcgcgtgcttcagggcgaaattgccgtcacgctggcaccggacacgcagttaattattgtcgctgactcaccacccggcctgcatgaaccgctgatgcgcgatgtgctgcatgccctcaatctgcaacccgctcaggtaatgaccgtgacaccggatcagctgcaaatgctgccggaaacgctgaactgcgcgggctggctgctcggcgtagagagcgaacagactttcaatggcgtggcattaaccagcgcctctttcaatgaactgatcagcagcggcgtcgccaaacgcgcgctctggcaacagatgtgtaaccatgacagccatctctttactcacccctgacgatctggcgcaggccttcgccattgaatgtcgtagtcacgcgtttccctggagtgaaaagacgtttgccagcaatcagggcgagcgctttatcaatttacgtctcgacgttgacggccaaatggccgcctttgcgattacgcaggtggtactggacgaagcctcgctgtttaacatcgcggtcgatcccgcttttcagcgccggggattgggccgccagttgttgcagcatctgatcgatgagttgatcaaacgcgacgtgctgacgctgtggctggaagtgcgggcctcgaacctgcccgccatcgcgctctatgagcagcttggattcaatcaggtcagtcgtcgccccaactattatcccaccgccagcggccgtgaagatgccattctcatggcactgacgccgtagcggtgttaaggagctttaatgattgataactgggattgcatcctgtttgatgccgacgataccctttttcatttcgacgcctatgccggtttgcagcgcctgtttcgccggttatgacgtgcagttcaccgaccaggattacagcgattatcaggcgataaacaagccgctgtgggtcgattatcagaacggtgctatctccgcgttacagctgcagactcagcgtttcaaccactggagcgaaaagctcagcgttgcgccggagatcctcaacagcggcttcctcagcgcaatgggagagatctgcacgccgctgccgggcgcggtcagcctgatgaaccaactgcatggccgggtgaaaatgggcatcatcaccaacggttttactgcgctgcagcagacgcgtctggagcgcaccggttttcgtgattacttctcggcgctggtaatctccgagcaggtcggccagccaaaaccggcgccagagatttttgattacgcactgaatctgatgggcaacccggatcgtgagcgggtgctgatggtgggtgatacgccaaagtcagacattctgggcggcatgaatgccggtattaaaacctgctggctcgatcatggcacccggccattgccggaacatattaagcccacctggcaggtcaaatcactgggcgagctggaagcgctgctcatcggctaacgcaagacgcctcgcaaatcagcatctttcccataaaaaatgcccgcacagcggtaatgtcagtcagttaagcgacaggtgataacgcagtctggtgccgggcaggggctggcggtcctcgcgccgctacgcggttccttcacttcattcctctgcctgacggaccgccggggatggcacatcctgtgccgccccgcctttcgcccgcgtcctgcgggctctcctggcagactcattctgttcagcgctgcggattgcctgctcctgcccggcaccagcctgctctgaaacttcagtgtgtattgttaaaaagggcacgagaatggaggcctgagcgcctctgctgctgaaagggctatccacagcgctgaggcgtgacggtgggccagaagtccacgccgggaagcgtggacagttcggggccggccagggagggccgatccccgaacggttcgtcggcacgacgtcaaagccgaaggtaccgcgtgagcggcgcgaggacggcccggcagcagcagaggtgctcaggcccgcactgcggcccgcccgcaaaaaaatctgccacgtttgaccgtgacagcctttacaaatctaatcttaactgaccagcattaccgttgtgcgggccttttttgttttatctttaccgcagccggagcgttactctttcttctcgtcgtcctcatcccgatcctctttcaccggggtgctggcggtgagcaggaaacggcgactgctgccagcgggtgcggcggtggcgcagcagggtgcgtgagagaataatgccaattgccagcgccagcagcatcatcagacgcagaatattggtggtgttatcgacctgatgtgagtcggtgacgagcacgtgggtatccagcgtcacgcgcaaaaagcccaacggaccctcgtttccggccagcggctgcacaatctgatggttgaaatagctgcccgcgcgctggccgtcgagcgccagccgatcgcggacattgatgttttcaccgctgtgcgccaccaggctgccgtcgccgtcatagaccgatgcatccagaatacggctgttagccgtcatctgattaagaatggcttctatctgagtccgattattttcactgttgtccatcaacggcttaaggctgaacgccacctggctggtcagcgtatgcgccagctcctcgacctgttctgaacgtgccgcctgatggccgagactgaaccaggatgcgccctgcatcagcacgaccagcagcgccatcgagatgagaacgatcacggtacgatgtaagcgaaatttcagtgcggttttagccattaatcatccgggtcatatcacaacagaaagcctggagattatgttgccagaagcggcgcagacaaggtagcctcttgcgtggttttgttgtccctacaggagctctgatgccaaatcgtttaacctggtgcgatcttcccgccgatgtctccctctggccgggtttgcccctttctcttagcggtgatgaagtgatgccgctggattatcgcgctggccgtaccggctggctgctgtatggtcgcgggctggataagcagcggctgaccgattaccagcatcagctgggtgccgccatggtgatcgtcagcgcctggaacgtcgatgagtatcaggtgattcgcctggcgggatcgctgacgccgtttgccagcaagctggcgcacgacgctggcctggatgttgcgccgctgggcaaaatcccgcatctcaaaacgccaggcctgctggtgatggatatggactccaccgcgattcagatcgagtgcatcgatgagattgcaaaactggcgggctgcggcgagcaggtggcggaagtcacggaacgtgcgatgcgcggcgaactcgacttcaccgccagcctgcgtcagcgcgtggccacactgcagggggcagacgccaatattctgaaacaggtgcgtgatgccctgccgctgatgccaggcttaaccaccctgacgcagaagctgcaggcgctgggctggcaggttgccatcgcgtctggcggctttacctactacgccgaatacctgcgcgacaagctgcatctgtcggcggtggtggctaatgaactcgaaattcgcgacggcaaactgaccggcaacgtgctgggaccgattgtcgacgcacaatacaaagccgataccctgaagaagctggcgcagcgttttgacatcgcgccggaacagacggtggcgatcggcgatggtgccaatgacctgctgatgatcaaagcctcagcactgggcattgcgttccatgctaaacctaaggtgaatgagcagactgcggtcaccattcgccatgccgatttaatgggggtgttctgcatcctcaccggcagcctgatccacgaagagcgttaactgaggtattgatttggccaaagcggcaaaacgcgcatttgtctgtaacgaatgtggcgcagattacccacgctggcaggggcagtgcagcgcctgtcacgcctggaacaccatcaccgaggtgcgcattgccgcctcgcccgcggctgcgcgtaacgagcgcctgagtggctatgctggcagcgccggcaccagccgggtgcagaagctctctgaaatcagcctggaggcgttaccgcgcttctcgaccagcttcaaagagtttgaccgggtgctgggcggcggggtggtgccgggcagcgccattctgattggcggcagccccggagcaggcaaatccacgctgctgctgcaggtgatgtgccggttgtcagaggggatgaaaaccctgtatgtcaccggtgaagagtcactgcagcaggtggcgatgcgcgcccatcgtctgggattacccaccgaaaatgtgaatatgctgtcggaaaccagcattgagcagatctgcctgattgccgaacaggagcagccgcaactgatggtgatcgactcgatccaggtaatgcacatggcggaaatccagtcatcgcccggcagcgtcgcccaggtgcgtgaaaccgccgcttacctgacgcgcttcgccaagacgcgcggcgtggcgatcatcatggtcggtcacgtcaccaaagatggctccctggccggaccgaaagtgctggagcactgtatcgactgttcggtgctgctggatggcgatgccgattcccgcttccgcaccctgcgcagtcataaaaaccgcttcggcgcggtcaatgaactgggtgtgtttgccatgaccgagcagggcatgcgtgaagtcagcaacccgtcagctattttcctgtcgcgcggcgaagagatcacctcgggcagttcggtgatggtgctgtgggagggaaacgcgaccgctgctggtggagattcaggcgctggtcgatcactccatgatgggcaatccacgccgcgtggcagtgggtctggagcagaaccgcctggcgattctgctggcagtattgcaccgtcacggcggattgcagatggcggatcaggatgtgttcgttaacgtggtcggcggcgtcaaagtcaccgaaaccagtgcagacctggcgctgatgctgtcgatggtgtcgagcctgcgcgatcgtccgttgccgcaggatctggtgatcttcggcgaagtgggactggcgggcgaaatccgtccggtgcccagcggtcaggagcgcatcgctgaagcggcgaagcatggcttcaaacgcgccattgtgccggcagggaatgcaccgaaaaaaccgattgccgggatgcaggttttcagcgcgaagaagctggccgatgcgctggcgattctggacgatctgtaacgcgcctgcggccgccagcgaaaagccgctggcaggccgctcccaccttaaccgcattgatgcaggaggcacgacatgtcgtcgtttgattatctgaaaacggccattcgccagcagggccacacgctgcaacaggtcgctgatgccagcggcatgaccaaaggctatctgagccagttgctcaatgccaaaatcaaaagccccagcgcgcaaaagctggaggcgctgcaccgttttctgggtctggagtttccgcgccgcgataaaacggtcggcgtggtgtttggtaagttctatccgctgcacaccggccatatctatctgattcagcgcgcctgtagccaggtcgatgagctgcatatcattatgggctacgacgagccacgtgaccgcgagctgtttgagaacagcgcgatgtcacaacagcccacggtcagcgatcgactgcgctggctgctgcagacctttaagtatcagaaaaatatccgcattcacgcctttgatgaggaggggattgagccctatccacacggctgggatgtctggagtaagggcgtcagcgcgtttctcagcgagcacggtattgcgccggactgcatctacaccagcgaagcgcccgatgcggagatgtatcagcagcatctgggcattcagaccgtactggtcgatcccagccgatcctttatgagcatcagcggcgcgcagatccgtcaggatccgttccgcttctgggattatatcccgaccgaagtgaaacctttctttgtgcgcaccgtggccatcctcggcggggagtcgagcggtaaatcgacgctggtgaataaactcgccaacattttcaataccaccagtgcctgggaatatggccgcgactatgtcttctcccacctgggcggtgatgaaatggcgctgcaatattcagattacgacaagatcgcgctgggccaggcgcagtacatcgatttcgcggttaaatacgccaataaagtggcctttatcgacaccgactttgtcaccacgcaggcgttttgtctgaagtatgaggggcgtgaacatccgtttgtgcaggcactgatcgatgaatatcgctttgatctggtgattctgctggagaacaacgtgccgtgggttgccgatggcttgcgcagcctgggcagttccgtggatcgccgggaatttcagtcgatgctggtgacgatgctgcgggaaaacaacatcgaattcctgcacgtgcaggaagatgattatgacacccggtttcctgcgctgcattgaactggtgaaagcgatgctgggcgagaaaaacgcccagccgtaacgcatgctgtaacccggtctgccgcagggcagccgggtcagtgcattaatacaccatcactactttgccgcgcatgtggccttccagtacgcgctgatgggcggcggttaaggtctcaacgcttaagccgtgcagcgtctcgctcagtgtggtttgcagcttaccttcatccagcaacgccgaaaccgcatccagaatctcaccctgacgtgccatatccggcgtgttaaacatgctgcgggtgtacatcagctcgaaatgcagggcagcactcttcagcttcagctgatccatcgacagcggatgttcgttttccacgatggtgcagatatgaccctgcggggcgataagctttgccatggtttcccagtgaccgtcggtatcattcaggcagaagatataatcgacctgtttaatgccctgtttttccagctctccaatcatatctttgtagttgatcaccagatcggcgccacgatcgcggcaccactgcgcggaatcttcacgcgaagcggtggcaatgatcttcaccttgctgcgcagtttcgccagcgggatcgccagcgatccgacgccgcctgcgccgccgacgatcagcagcgtctgatcttccgttgctgactccaggttcagtcgctcaaacagtccttcccaggcggtcagggccgtcagcgggatcgcagcggactgcgcccagtccaggctctctggcttgtgaccggtaatgcgtgagtcaaccagctgctcggtgctgttactgccaggacgggtcaggtcacccgcataaaaaactttatcgcctggcttaaagttgctgactttgctgcccacttccagcaccacaccgctggcatcccagccgaggatgcgtggctgctctagtccgttcttcttcgcccctttgtgaaccttggtatcgaccgggtttactgacgcggctttgacttcgacccgcaggtcatactcccctggcgctggggtatcagggaaaatttcagtaaagttttcaggactttccggattaattgcgatagcgcgaatagacatacatttttcctgtttagtcaggctaaaagcctggatctggtggttgccattctggccctgaaaagtgctcacactccgcaggggttgtgccacgctgtccgtggcagactggctgatgattcggaacaggctttaagtgtagaacctgattttagcagtgataagatggacaatctttcatagagtgttcgtctgaggtgaacaatggcatttcgtcagtggcaggatatggcactgtttgcgctggtggcggagtgcggcagctttaccggcgcggcagaaacgcgcagggctgccaaaatcgagcgtcagtcagcgcatcagccagctggagcagcggctggggattcgtctgctgaaccgcaccacccgccagctcaatctgacctttgccggtgagcgctatatgctgcattgccaggagatgatgcaggccagtgaacgcgccgatcaggcgatcgccagcctgcgtgaaaatcccagcgggcgtctgcgcatcaccagcccggcggggattggtgccacgctgctggcgcgctgtaacgcggcgtttttacgtctctatcccgatgtgacgctggatgtctcgatctccgatgagatgcgtgatctggtgcaggagggttttgatgtggcgctgcgcaccggtcagccgcaggagtcctcgctgattggccgccggataggcaactgcccgcgactgctggttgcatcacagcgctatcttgatcagcatccgccgctggttcatccacagcagctgtcggcccaccgctgtattgcgcatcgtgcctggaatgaatgggtgttgcagcgcgatgacgagttctaccgctggctgctgccgccaggccatctcacggataatttactctatgcgcgcgaatctgcgctgggcgatgcgggcattacgctgctgccgcactttctgaccgacggggcgatggcggatccccggctggtgccggtactgccggaatgggaaatcgaggggaatgagctctggctggtctatccgggccgtaaactgaattcacctgcgctggcgcggtttattgagttcgcgctgcagtcaccggtgttcagggagttttatcgctgaccggtacaatgtggcgcaggaagagtgccgccattttttccgggccactctggtaacccgcgatatttgccgctaaccagtcgctggggctcacgccttcccagctcacctgatagcctgcgtgaagaatgatatgctcgaacagaatgcgtaatgcccgaccgtttccttcccgaaaggggtgcaggatattgaactcgcagtaataccaggcaacctgatgacaaaaagcttcatggtcagtctgctccagccatctttcgcacgccagttttgcaaataatttctccgcttcacgcagaataaaagcgggctggcaaaagcgggtctctcctttgctgatagagatatcgcgtatctgccccgcccaactataaagctcgttaaacaggcagtaatgaatgtgacacagtgactgaagggtaaaaggaggatgagagagcttaatggtgtgaatggtcagtgcggtaacatcacgctcagcctgatccagcagggtttgttcgcggatatcatagcgattgatcagcacatcggaatcgggataacagtagtgatctcgccagacaagataacgattcacgttggcttcctgctactgcttatagcggcgtcgaacctgttccagggtcgataattcagcatctgctgaaatacgtatcccctccagcagggaacttgcggcaaagtttgcgactttagtggcttcataaatcgcttcagcttttttagccactggccgctcagcttttttcttcattgcgttcagcccttaaaacgtcactggtgaagcaggaggaggcctgagcctccccctgacatcgttacttcgtcatacgcttgtacttgatgcgcttcggctccagcgattcggcgccgagggtacgcttcttgtactcttcatattcggtaaagttaccttcgaagaattcgatgttgccctcatcctgataatccaggatgtgcgtggcgatacggtccaggaaccaacggtcatgcgagatcaccatggcacaacccgggaactccagtagggcgttttccagcgcgcgcagggtttcaatgtccaggtcgttggttggctcatcgagcagcagcatgttaccgccaacctgcagcagcttcgcgaggtgcagacgaccacgctcaccacccgacagtttcgcctacgcgtttgccctgatcgacgcctttaaagttaaagcggccgacataggcgcggcttggcatctcggtgttaccgatgcgcatgatgtcctgaccgccggaaacctcttcccacacggttttggcgttatccatgctgtcgcggaactgatccacagaggccagtttcacggtttcacccagtacaatctcgccggaatcaggttgttcctgaccagacatcatgcggaacagcgttgatttacccgcgccgttcggaccgataatcccgacaatcgcacctttcggtaccgagaacgagagatcgtcaatcagcacacggtcgccataagacttacgcagattgctgacttccagcactttgtcacccagacgggcacctggcggaatgaacagttcgttggtttcgttacgcttctggtagtcggtgttgttcagctcttcaaagcgtgccagacgggctttgcctttagactgctggccttttggccctttgcgcacccactccagctctttctcaatcgacttgcgacgagcggcttcagaggaggcttcctgcgccagacgcgcatctttctgctccagccaggaggagtagttaccttcccacggaatcccttcgccgcggtcaagttccagaatccagcctgcaacgttatccaggaagtaacggtcatgcgtaatcgcgacgacggtgccttcgaagtcgtgcaggaagcgctccagccaggcgacagattcggcgtccaggtggttcgtcggttcgtccagcagcagcatgtctggtttttccagcagcaggcggcagagggcgacgcgacgacgttcaccaccggaaagggtggcgattttcgcgtcccagtcaggcaggcgcagcgcatcggcagcacgttccagctgggtattcaggttgtgaccatcgtgagcctggatgatctcttccagacggccctgttcagcggccagtttgtcgaagtctgcaccttcttcagcatagagcgcatagacttcgtcgagacgcttcagtgcgccaacgacttctgacagcgcttcttctaccgactcacgcacggtgtgttcaaggttaagctgcggttcctgcggcaggtagccaatcttgaggcctggctgcggacgcgcttccccttcgatatctttatcgatgccggccatgatgcgcagcagggtagatttacccgcgccgttcaggccgagtacgccaatttttgcgccagggaagaagctgagcgagatgtttttcaggatatgtcgcttcggcggaaccactttgccgacgcgatgcatgctatagacgaattgagccacgttggtttgagcctctgggtctgttggtcgtttgaatgatgtcgaagtttagcctttttcaccgtttaatcccagccggggggcggcgaatattagcgtggcggagccgatgccaggcgatgccaggcataactgactgatttccacgctcaatcgctgacagggtcaggagaggatgtcagaaagaggcgtcagggcaggcgcagcgggatcgcctgctgggccagccagttttgcaacgcctgatcgggcgcgctgtcactcaccagcagatcaaagcgctgcagctcggcgatgcgggcaggcagcaccttgccatatttactgctgtcagccaccagcaccgactttcgggcgcgcagcatggcgtgatgcttcatcatcagctcattggtgttgtagcaggtcgcgccctgatctttgtcgatgcccgctgcagagataaaggccagcgtcgggcagagatcgtcaaggatggtatgcacgccaatcggcgtaaacagggcgttgtcggcatgaaattcaccgccgctgagaatcacgttacaggccggtttctctttcagcgtcagaaaggtattcatggcgcagcagatggcggtaaacgccagggtgtcgggaatcgcatccacgatgtagggcagggtggtgccgcagtcaaaaaagaccgtatcgttctcattgatcaggctggcggccgcctgtgccagtcgctgctttctggcggcattctggccatgctgatcgctgacaaaatagtggctggcatgacttttcggatcgctgacgatatagccgcccagcaggaccacgctggagcccggctcggttaaatcgcggcgaaccgtcatctctgagacgccaagcagctgggccgcatctttcagatgcagtttgtcggtgcgtttcagcgcctgcgtcagcttgtgaatgcgttcgtcgcgccgggtttccatggtcatctctctgttccctatcctgcagtgcggaggaaagacgccgggatcgacgtcaatacgctacaaacctcacagatttgaatgagttgcgtctcatccgccaggctggcagtcaatcttacccgcattccgtgagggccgcaaacctccgccgtgctgtcagcgcgtggtgatatcggcacatcaccgcgggcggctgtggctttcatccaccgcggttagtgatgttggcttgttataataataacactgaaaatcccctttcatggcgtcatctgcctgttctcaccgcctcaggatgtggtttttgtcacatatttaacctttaagaattgttattgttaatttaataacattttaagtttaaaaaaacatccgggagaaaaggtcatgacaattgcggtcatcggctcaaacatggtcgatctgattacctataccaacagcctgccgaaagcgggcgaaacccttgaagcgcccgactttgccattggctgcggcggtaaaggggccaaccaggcggtcgcggcggcaaaaatgggtggcaacgtaatgatggtcagcaaggtcggtgacgatctctttgctccgaacaccgttgcaaaccttcaacagcagggcgtggacacgcgcttcgtcaccaccgcaccgggcacctccagcggcgtggcaccgatttttgtcgatgaccagtcgcagaaccgcattctgattatcaaaggtgctaaccagcagctgaaaccggccgatatcgacgacgcggctgaggcgctgaaagcctgccagctgatcatcctgcagctggagatcccactggagacggtctattacgccatcgattttgcccgccagcatcagatcacagtgatccttaatccggctccggccgtcgccacgcttgatattgattacgcctgcaaatgcgacttctttatgcccaatgaaaccgagctggagatcctcaccggtctgccggtcagcagcgatgaagaggtgatcctcgccggacagtcgctgctgaagcgcggccttaaaaatctgatcatcaccctgggcagccggggatcggtctggatgagcggcgacgagatccatcgcgtggatgccacaccggttcaggcggtcgacaccagcggcgcgggcgatgcctttatcggctgctttgcgtatctgctggtggaaaccggcgatgtggccgccgccatgacccaggcgtctgcctatgccgcctgcagcgtcaccgggcgcggcacccagcgcgcctatcccgacgcagagagtttccagcgctttctcaaccgtaactgagggtctgccatgcaacagaaaattgttcagcaatctgatggctatctgaataaaacgccgctgttccagttcattctgctgtcgtgcctctttccgctctggggctgtgcggcgagtcttaacgatatcctgatcacccagtttaaaagcgtatttgccctgagcgactttgccagtgcactggtgcagagtgccttttatggcggctattttctgattgcgatccccgcgtcgctggtgatccgcaagaccagttataagatggcgatcatgatcggcctggcgctctacattgccggctgtatcgccttctatcccgcctcgcacatggcgacttacaccatgttcctggcggcgatatttgccatcgccatcggcctgagtttcctggaaaccgccgccaacacctacagctcgatgattggccatcgtgatcacgccacgctgcgcctcaacgtcagccagaccttctatccgatcggtgcgctgatggggatcgtgctgggcaaatatctggtgttccaggatggcgacagcctggagagtcagatggcgaccatgacggcagagcaggcgcatgcgttccgcctgacgatgctggaacacacgctggagccctacaaatatctggtgatggtgctggtggtggtgatgctgctgtttatgttcacccgctatccgcgctgtaaacccgaaagcagcgagatgtcgcgcccctcgctgggcgagactttccgctatctggctggcaaccgacactttaaacgcggaattgtgacccagttcctctatgtcggcatgcaggtggccgtctggtcgtttaccattcgtctggcgctgacgctgggggcgactaatgaacgtcacgcctcgaactttatgatctacagcttcatctgcttctttatcggcaagttcgtggcgaacttcctgatgacccgtttccgcgcagagaaggtgctgattgcctattcggtgctgggcgtgctgacgctggcttatgtgatgctggtgccgaactttaccgccgtctacgctgccgtctttgtcagcgtgctgtttggtccctgctgggcgacgatctacgcgggaaacgctggcgacggtcgataacaaatacaccgaagtcgcgggcgcgtttatcgtgatggcgattgtcggtgcggcctttgtcccggcgctgcagggcctggtttcggactcactgggttctatgcagctggcatttggcgtctcgctgctctgtttcgcctgggtcggattctacttctatggcgaactgcgccataaaaaacagccggttgcgaccggtcgtctggcggaggagttaccatgaaaacccgtttacccttagcgcgtgaacagtttcacaccacaccctgggtgcttttagaaagcgataatttccgggttgagctgtttcgctatccggcgggcattgaggcggtgcgcattcataaccggcgtggcagcgtgaccgtgctgccgtttctcgggcagatgatctgggacgcagagttcgacgatcataacctgaccatgggccacagttttaagcagccgctgcccgcaaattcgatcatcgacacctatggctgttttgcgtttcattcgggactgctggccaacggctgtcccgcaccagaggacgatcatccgctgcacggtgagatggcctgcgcccgcatggacagcgcctggctggtgctggaggatcagacgctgtcgctggaaggggagtgtgaatatgtcaaaggcttcggccatcactacctggccgcacccgccgtccgcattccggccgatcagccccggctgacgattgaaatgacagtcactaatctggctggcgcgccgatgccgctgcagtatatgtgtcacctcaacagtgcgtggatcgatcagggccgcttccggcagtcgatccccgaacaggcattccagctgcgtcgctcgatcccggcgcatctgcgaccgacgcccgcctggcgggattacaccgatcggctggcgcgcgatccgcaggctttacagcagctcgatcagccgcagctctgcgatccggagatcgtcttcttcgcggacgacctgtcgcagtatagcgatgaggtgcagtttgagttgcatgcgccgcagggctatgcgctgatgacgcgcttctccaccgcgcagttcccgcacgccactcgctggctgctgcacaaccacgatcagcaggtggcggcctatattctgcccgccacctgccggccagagggctctcttgccgcgcagcaggctggcacgctgatcaccctagcgcacggtgaacagcgccacttttctgtcgagaccggcttactctgagccgggtttaaatcgccaccaggccgcgcacaccctctgcttccatggtgtcaccgcggccacgctgcacaatttctccgcgcgacatcaccagatagctgtccgccagctccgccgcgaagtcataaaactgctccaccagcaggatcgccatatctccccgttgcgccagctggcggatcaccgcgccgatctctttgatcaccgaaggctggatcccttcggtcggctcatcaaggatcaacagctggggccgacaggccagcgcccggccaatcgccagctgctgctgctgaccgccagagaggtcgccgccccggcgtgacttcatcgccagcagcaccggaaagagctggtagatctcctccggcacttcacgcgcctgcgcagccggaaagcgtgacaggcccatcagaagattctcttccaccgtcagacgcggaaagatttcccgcccctggggcacccaggcgatgccagcctgcacccgctggtgcggcttgcggccattcatgcgctgctgctgccagtgaatctcgcccgacttcgccgggatcagccccatcaggcatttcagcagcgtggtcttccccacaccattgcgccccagcagacaggtgatttcgccaatctttacctcaaacgacaagccgcgcagaatatgactgccgccataatattgattcagttcagtaacctgtaacatttcagcgccccagataaacgtcgataacctgctcgttggcctgcacgtcgcgcagcgaaccctcggccagcacctgaccctgatgcagcaccgtcacgtggtcggcaatggtttcgacaaagcccatgtcatgctccaccaccatcagcgaatgcttgcccgccagtctgcggaacagctcggcggtgtagtccgtttcggcatcggtcatgcccgcggccggttcatccagcagcagcagatgcggctcctgcaccagcagcatgccgatctccagaaactgcttctggccatgcgacagcaggcccgcgcgacgctggcgtttcgccgcccagccgcagcagtttcagcacctcatcaatgcgatcacgctgttcaccgctgaggcgggcgcgcaggctggcccagaccgatttatcggctttaagcgcgatctccagattttcgaacacggttaacgcctcaaacaccgtgggcttctggaacttgcggccgatcccggcgcgggcgatctccaccggcgagagacgggtcagatcgctgtcctggtcgtagatcacccggccggcgtcgggccgggttttgccggtgatcacatccatcagcgtggttttgcccgcaccgttggggccgatcacgcagcgcagttccccgacgccgatctgcagcgaaagatcggtcagcgcccggaagccttcaaacgacacgctgatcttctccagttgcagcaccggatcgcgctgcacccgatggcgatccgccagttgagtttgggtaaacagggcatcactcattttttcctccggcgcagcaggccaatcacgccgtgcggcagaaacagcgtgaccaggataaacatcagccccaggaaaaagagccagtattcggggaaggcgacggtgaagaagctgcgtgcgccgttaacaatcgcggcacccagcagcgggcctatcagcgtaccgcgtccgcccagcgccacccagattgccgcttcaatcgagttggccggtgacatctcacccggattgataatgccgacctgcggcacatagagcgccccggccaggccgcacagcacggcggagagcgtccagacaaacagcttgaaaccacgcgggtcgtaaccacagaacatcagacggttctccgcatcccgcaccgcagtcagcacccggccaaatttgctgcgcgccagggcgaagccgatcgccaggctcagcagcagcagcagcaccgtggcgataaacagcccgatacgggtgggggttgccgtcaccgaaaagccgagcagggtggtaaagccggtaaagccattgttgccgccaaaaccggtttcgttgcggaagaacagcagcatcccggcgtaggtcagcgcctgggtcatgatggagaagtagacgcctttaatcttcgagcgaaaggcgaagaagccaaaaatcagcgccagcaggcccggcaccagcatgctcaggcagagcgcccaggcgaaatagtcggtgccggtccagaaccagggcagttcccgccaggagagaaaggacataaaggcgggtaaaccctcgcctgcggcctggcgcatcaggtacatgcccatggcatatccacccagggcgaaaaagatgccgtggcccagcgacagcagtccggcgtagccccacaccagatccagcgccaccgcgaccaccgcgtagcagaggattttgccgaccagcgtcagggtataggtggagatcgccagcggatgcgtggcgggcagcagcgccagaaacggcatcaccaggagcgctacggtaatcgccaggccaatgctgatggtcaggcgcggcgcggtgcgcgccacgcgaagcgtgatgggttgcgtcatcagtcagtcacccttccttttaccgcaaacagcccctgcggacgtttctgaataaacagcacgataatcaccagaatcaggatcttgcccagcacggcgccaatctgcggctccagcactttgttgagaatgcccaggctgaacgcggcaaccacggtgcccgccagctgaccgacgccacccagcaccaccaccaggaacgagtcgataatgtagccctggcccagctccggtccgacgttaccgagctgcgacagcgccacgccgcccagcccggcaatccccgagccaaggccaaacgccagcatatcgacgcggccggtcggcacgccgcagcaatccgccatggcgcggttctgggtcacggcgcgcacgttcatgccaaggcgggtccggttcagcagcagccaggtgagcgccagcacaaacaccacaaacaggatcaccgcgatgcggttccacggcagcaccagattgggcagcagctgtaagccgccggagagccacgccggattcgccacctccaggttttgcgccccgaacagcacccgcaccagctggatcagcatcaggctgatcccccaggtggcgagcagcgtctccagcggacggccatagagatggcggatcaccgtgcgttccagcgccatgccgatggcggcggtgaccagaaaggcgaccggcagcgccagcagcggataccaggctaaatagtgcggcgcaaactgctgaaacaggctctgtacccaccaggtggcgtaagcaccgagcatcagcatttcaccgtgcgccatgttgatcaccccgagcaggccataggtgatcgccagacccagcgcggccagcagcaggatggaacccagcgacaggccgctgaaggcctgccccagcagatcgccccacatcagccgtttctgaatctgttgcagactttccgccgcggcggcccgtaccgtggcgtccggctcattcgcgggctgggtcaggcgttgcaggctggcttgcgtattgggatcgctggactcacccagcagtttcaccgcccgcaggcgcaccatcggctcgccatccgccagttgcagattcgccagcgccagtgccagtgcggcatgaacccggctgtcctgctcggcggcaaaacgctgctccagcagcggcagctggtcggcaacgccctcactttgcagctgctgcgctgcacgcagacgcagggccgtatcagtgctgacaagctggtgggcggccagcgcgttgttaaccagcacgcgcaggcgattgttcataaacagctttttcaggttgcccgtgggctgcgccaccgcatccagcggctgcagcgtggatccctgctggctgaacggctgtttattctggtcgatgaccaccgtttcggcatgcagcgcttccagcagcggcaggcgatggctgtccggtgcggcggcccactgttgcagcagcgtggcctgctgactgcggctggcagcggcaaagtcagccgccggtccggcactggccaacagcggcatcagcagcagcaggctgaaaaagcagcgacatagattcataaaaggagcctcgtcaggggagggcagcacggcggggtgccgtgctgccgcttcacagcgggtgacgctgcgtatctatcagcaacgcgcgattactgcgcggtcttcaccgggtgatcgggttttttgtcgttaccggcaatgtacgggctccacggctgcgcgcgtaccggctgatcggtctgccacaccacgctgaactggccgttctcttccacttcgccaatcatgaccggcttatgcagatgatggttggtctgatccatggtcagggtaaagccatccggcgctttaaaggtctgaccggccatcgccgcccgcactttgtccacatccgtggtgcccgctttttccaccgcctgcgcccacatatgaatgccaacataggtcgcttccatcgggtcgttggtgacgacggtggcggcgtttcggcaggttatgtgctttggcatatgcgcggtagtcggcgacaaacttcgcgttggtcggattatcaatagactcgaaatagttccaggcggctaactgacccaccagcggtttggtatcgatgccgcgcagctcctcttcgcccaccgagaaggcgaccaccggaatgtcagtggctttgatcccctggttcgccagctctttgtagaacggcacgttggagtcgccgttgatcgtggaaaccactgccgttttgccgccagccgcaaactttttgatgttagagacaatggtctggtagtcgctgtaaccaaacggcgtgtagacctcttcgatatctttatccgccacgcctttgctgtgcaggaaggcgcgcaggatcttgttggtggtgcgcggatagacatagtcggtgccaagcaggaagaagcgtttcgcgctgccgccatcttcgctcatcagatactccacggccggaatcgcctgctggttaggcgcagcgccggtgtagaagacgttgggtgacatctcttccccttcatactgcaccggatagaacagcaggccgttcagctcttcaaacaccggcagcaccgatttgcgcgacaccgaggtccagcagccaaacaccaccgccgccttatcctgagtcagcagctgccgcgccttctcggcaaatagcggccagttagaggcgggatcgaccaccaccggctccagctttttccccagcacgccccctttggcgttgatctcatcgatggtcatcagcgccacatccttcagcggcgtttctgaaatcgccatggtgccggagagcgaatgcatgatccccactttgatggtgtcagccgcctgcgcactccaggcgcaccccatgctgacaacggtggcggagagggcgaaagccttgatcaacgaacgtcttttcatcatctgaaacccctgagtagttgttgtgttattcggtgagctggagccgggcctgctggaggcggtgcagcgtgatctttctgacctccgccttactcacggcgatgtgatcggtcaggatgcgttgcgccccggcggtctgctgctgaaaaatcgcctgtaaaatctgtgcatgttcctgataagtggcacagatgcgatcgtcgcgagtgaagtcgagccgacggataatgcggatcttctcggtgagttcggcgtgaatgcgtgccatctctgggttacccgctgccgccaccagcgtcatgtgaaatgcctcgtcatgctgcgataccaccaggccctctgtaagcggctctgcctcgcaccagaactggttcagttcgtttaacagcgcggcacactgcggcgcgggcagggcgcagaggcgttttaccgcctcgcactccagcacggtgcgcaggtcatacagcgattcgaaccaggcgaaatcgaagttcttaatctgccagccgctgcgaaaccagacttcgacaaagccttcgcgttccagccggaacagcgcctgacggaccggggtgcggctgaccgccatccgtccggcgatttcgctttcgctgaagcgatcgccgggcatcaggcgaaaggcgaagatatcggccttcagcgcctgataaacccgttccgccagcgcttccgggcgggctttaggggagtggggttgcgttgtcattaccgctccttattccagccacagcaggttatcgccaggactgaccggacggcccgcctggcaggcaatccgcgtcacacgaccggcctgcggggcgacaatcgccagctccatcttcatcgcctccacgataatcagcgtctgcccggcgctgacctcgtcgcccggctgcaccagcactttccagatgttgccattgagatccgcctgcaccgccagcccgtttctcctcctcttcgctgacgctggcgcgcgtttcatcctccggcggcgcgttctgctcctcctgcgcccatagctgcacttcctgttcaaaggcggcggcctggcgctggcggaacgctgcaatttcagcggcgtggtcggcgaggaactgctggtgggcggcaaaatcaaactgcgtctcttcaatacgcaggctggcgcggccttcgcggaaatcttcgcgcagctgggtcagttcggtttcactcaccggatagaagcgcacctgatcgaagaagcgcagcagccacggcgcatcggtagcgaactgcggatttttcaggaaggtgttccagatgggcagcgtgcggcccaccagctgatagccgccgggcgaatccatgccgtagatgcacatgtacatgccgccgatccctacggtgccttcggcggtgaaggtgcgcgccggactgtatttggaactcagcaggcgatggcgcggatcgatcggaacggcacagggcgcgccaaggtagacgtcgcccagccccagcacgagatagctggcgttgaacagggtatcgcgcacctcatcgcggctgcttaagccattaatccgctggataaagtccacgttgttgggcagccagggggcgctggcgcgcaccgtctcctgatagcggctgacggcacccagcgtggcgctgtcttcaaatgccatcggcatccacactacgcgggagggcactttcagcgtgctgacgtcgcccagcgtcgcttccagcgccagcagcagtgacatcagccgggactggttaatgatgcggctgtcgtagcgcacctgcagcgaacgcacgccaggcgacagctcctctacgccgggctccgcctgcgccgtcagcgcattcatcagcagatggacacgcagacgcagcgccagatccagcacattgtcgccatactcaatcagcacatatttgtcgcccgcctggcgatagaccactttcggcgtgctggtcgtggcctccagagcggccagaatcgtggcggaaccgtgggcggtttcggccagtgacggcacggcaaacgtgggcggatgctcaggccgcaatgtctcaatcagatgcatctgcgctttttcccgcgccagcgcatcgtctgcggtgatggggtggaagcggatggtgtcgccaggtttaacctggcctactttccacagctcggctttggcgatggtcaccggacagacaaagccgccgagactcgggccgtcgtgcgtcaggatcaccgggaagtcgccggtgaaattgaccgcgccaatggcatattcacagtcgtgaacgttggagggatgcaggcccgcttcgccgccgttggcgcgggtccaggtcggtttcgggccgaccagccgcacgccgaggcggttggagttgtagtgcacctgccagtcactggcgaagaacgcatcgatggcggcctgggtgaagaagtccggtgcgccgtgcgggccgtagagcacgccgatgcgccactcgctgccgtagtgcggaatcagcgccgcatcgagcggctgcggatcgctgaccggggcaggcgtggtgcaggctgcccgctcaggctgggagatcgccagcatatcggcaacccggagggtgcgtccggcgtgaccgccaaactggcccagcgaaaaggtgctgcggctgcccagatactccggcacgtcgaagccgttacgcacggccagatagctgcggcagcccgtccgggcgcgtcccagcgccagagtctctcccgctttcaccgccagcggctgccaggtgctgaccggttcgccctccagcgtggcgtcgcagtcagcaccggtcagcgccacgatggcatcacagtggaaacgcagcgtcggcccctgcagggtaaattccagccccgccgccgcgtcatgattaccgacgatgcggttagccagccggaaagcgaagtcatccatcgggccggaaggcggcacgccgatatcccagtagccgaggcggcctggatagtcctgaaccgaactgaaggtaccaagttgcagcacttccaccacggaggaggcaggcaccacgctgtcgaggtagcgcgtccagacgttgccgctgcgaaacgcgtcgctggcggtaatctggcgcagatagtcgaggttggtggcgatgccgtgcagctgagtggcatccagcgcatggcgaagtttttccagcgccgcatcgcgggtgtcggcatgcacgatcagtttggcgatcatcggatcgtagaagctggagacctcgctgccggtttcgatgccgctgtcgacccgtacgccgtcagggaaagttacgccggttagccggccggggctgggctgaaagttcttgagtggatcttccgcatagagccgcacttcaatggcggcgccctgcggcgcctgctgcagacgtgaccagtcaaccgcatcgcccgccgccacctgcaacatgcactccaccagatcgagtccggtgacgcactcagtgaccggatgctccacctgcaggcgggtgttcacttccagaaagtaaaaggcctgctggtcgacgtcgtagatatactccacggtgcctgcgctgcggtagttcacccgctcgccgagccgcaccgccgaggcgagcagggcgtcacgcgtcgccggagacaggccgggcgcgggcgtctcttccaccaccttttgattgcggcgctgcagtgagcagtcgcgttcacccagtgcgaccacagtgccgttaccgtcaccaaaaatctgcacttctacgtggcgggcgcgatcgatgcagcgctccagaaacacgcccgcatcactgaagaattgctcgccaagacggcgtacgctctcccaggcgctggcgagcgcaccggcgtcggcgcagcgcgtcaggccaatgccgccgccgcccgccgtgcttttcagcatcaccggatagccgatcttatcggccgcctgtatcgcctcctccagcgacgcaagcagcggtgtgccgggcgtcattggtacacccgcactggctgccagctcacgggcacggtgcttaaggccgaactcaccaatctgctgcgcggtggggccgacaaaggcgatccccgccgcttcacaggcttcggcaaacggctggctttctgaaagaaaaccgtagcccggccagatagcctgcgcgccgctctgctgagctgccgccagaattttgtcgatgcgcagatagctgtcgctggctttatcgccgcccagcgcgatagcgatatccgcctgcttaacgtgctgcgcgttgcggtcagtatctgaatagaccgcgacacttttgacgccaaggcgcttcagcgtccgaatggcgcgacaggcaatttcgccgcggttggcaatcagtacggtggtgaacatgatcagtgactcccctgtgatgccagccagttgcgccagccgcccgtctcagtaatctccagcgcgttgttcagcgccgcgccttcgcagataaagcctttcaccacccgcccatccgccagcgtcagactgccgatgcccagcggtgcgggaatctccgccacaaactcaccaaagcgcgccagcgggatatcccacagctccacggtgatagcggcgccctgttcgtcacgcatcaggccgggttttttgatcgcgccctccagcagggcaaacaggcgatagtgtggcgcggtcttcgtctcttccacccagacggcatggcgatcggtgagctgaaaattaagcggcattccggtgagatgcgcgcccaccaccgccagccggacatggtcggcggaggcgggcaggctggtgcgccaggcagggcagggctggccggtcgcgcccagtggcagagcaagctgctgctgccagcgaatgccaaactcagccagcgcccgatcgtgccaggcgggcgcaatcagcgtgatgcctgccgggagatcgtcattgcgaaacggtgcgggcagcgccagcgcggcgaggtcggcaaggttggtaaagttggtataggtgccgaactgcgagttgtagtgaatcggctcctgcttcatctcctccagggtatgaatcgtgggcgaggtcggcaccaccagcgcgtcaaactgtgccagcgtctgctgaatctggcgcgtcagttcggcccgcagatactccgccttataggcgtcgactgcgctgtatttcaggccgctggcgataatctcgtgtaccaccggatccatctccgccgggcgatcaagcatcccgcccaccgccgccgtgcgttcggcgacccatgcaccgtagtagagctgttcagccagcttccggaacggggtgaagtcgatagggtgcagcgtcacgccacccgcctgcaatgcctccagcgcctggtcccaggcggcttcggcggcggcatcatcaaaaaactccgggttcaaaggtaccgcaaaatggggatggacgggcaggctggccggggcggtgcgcggattaatgcgcgaataggcgtcaccggcatcatagccacccatgacgctggcgacgctaaaggcatcttctgccgtcaacgcaaacacggaaatcgtgtcgttgaggcggcaggcgggcaccacgccgcgtgcagagaaccagcccttggtcggcttcagtccgacaatattgttaaagcccgccggaacgcggcccgatcccgcagtatcggtgcccagtgaaaatgcgaccagcccgcgcgccagcaccgacgcggagccggagctggagccgccactgacgtaatcggcatcaaaggtgttactgaccgcgccaaacggggagcgggtgcccaccaggccggtagcgaactgatcgaggttggttttgccgatgactatcgcgccggcggctttcagccgggcgaccgctaccgcgtcttcgctggcggtataggtaaaggcggggcaggcggcgctggtcggccagcccgccacatcaatgttgtctttgacggcgaagggaacaccaaacagcggcagcgatccgggatcgcgctgatagtgcgccagcagtggctcaatctgagccgctaactgatccggtgtcgccagataaatccaggcactatcctggggatcgagtgccgccaagtgtgcgctcagcagcgaagtaatctgttgcggcgcctgctgatagcgctgctgccaggcgtgaagcgtcaggccaaaggttgaagtcatacgaagaattccagctggtatacaagatggaattcaacagagcaaaggctgtgccacttttttaacgcaatgattcaacagtttaatgcgtgcagtgataagattttctgatgataatttgcacaattacggcgcgcacgctgagcgatgacggtgcgtttacctttcgtgtgcgtaaattttgtgaagaacatggcaagagtccggtggcctggttagcatgaagactgtctggcaactcgccggccccagcaacagaggagatttacgtggtgaagtggcgtaactggataatagggatctgcatggccggcacggccagcagcgcatgggccgattcgcttgatcaacaacggcaacgttatcaacaaattaaacaggcctgggacagcaatcagatggccaccgtggatcagctgttgcccacgctacaggattatccgctctatccttatctgcaatatcgcctgctggcacaggatctcgatcaggagaccaccctggcggtacagaactttattcgccagtatccaacgttgccacccgcgcgttcgctcagcacccgctttattaatgtgctggcttaccgacaggactggcagggggtgctgaacttcagtccgactgaacctaagccggtgcaggcacgctgtaactggtattacgccaaatgggccaccggtcagcagcaggccgcgtttgacggcgcgaagcagatctggctgcgtggcacggcgctgcccgcggactgcgataagctcttctcggtctggcaggcgtccggtcagatttcgccaattacgatcctggagcgtatccggctggcgatgaaagcaggcaacgacagcctagtgagctatctggcgaaaacgttgccaactgactatcagaccatgtctgacgcgatacaggccctgcagcaggacccgttaacggtcagtaccttcgccagcgccgtcgggccaaccgactttacccgccaggcgacgatttacgcctttacgcgtgtggcgcggcaggacatggaaaatgcccgcagcctgattccgatcctggtccgggcgcagaagatggggccggaggatgagcaggcgctgaaggagattgtggtctggcgcatgatgggcagcgatctcacctctgagcaggcacgctggcgcgatgcggtggtgatgaacagcgagtctaccgcgctggtagaacgccgggtacgactggcactctctcagcatgaccgacgcggccttaacacctggatcgcccgtctgccgctggaagccaaagagaaagatgagtggcagtactggcaagccgatctgctgtttgagaaagatcgcaaagaggaagcggaagagatcctgcgcaaactgatgcaggcgcgtggcttctacccgatggtggccgcgcagcggctgggcgttgactacccgttgcaggtggatgaagcgccgaagcctgacagtgccacggtgcagggaccggagctggcccgcgtttcgcgagctgatgtactggggactggataacctggcgcgcagcgagtggagcaatctgatcggcagccgtacgcacacgcagcagcagatgctggcgcgctacgccaatgagcaggactggtgggatctcagcgtgcaggcgaccatcacggccaaaatgtgggacagcctgaaagagcgtttcccgctggcgtggcagagcgtctatgagcgcaataccgcggtgaagcagatcccgccgagctatgcgatggcgatttcgcgtcaggagagcgcctggaatccgaaagcgcgttcaccggtcggcgccagcggtctgatgcagattatgcctgccacggcggcgcataccgtgaagatgtataacatccctggctacagcaacaccagccagctgctcgatccggaaaccaatattcagatcggcacccagtatctggaatatgtctatcagcagttcaatcagaaccggattttcgcctcggcggcctacaatgccgggccgggccgggtgcgaagctggcagaaaaccagtgcgggcaatcttgatgccgtcgcgtttatcgagaccatcccgttctctgaaacgcgcggctatgtgaagaatgtgctggcgtacgacgcctactatcgtcacttcatgggcaagcctgacaagatcctgtcagatgctgagtggaatcgccgttactagctgtgctaagcttccgtactctttagcgagtacggaagcctcttcatgacccattctgattcccccaccgatgcgcatccggcagaagatagctggcaacgctttgtcgtgctgatgcagcaggcctttgctgatggtcatgcgctgccactgatgcaactgatgatgacgcccgacgagcgggaagcgttcggcacccgcctgcggattatcgaagagttaatgaacggcgagatgagccagcgtgaactgaaaaatgagctcggcgttggcattgcgaccattacacgaggctcgaacagcctgaaagaggcgccgccggagctgaaacgctggctggaggcgcgtctgggacgcgcctgatcactgctggtaaagcggatggatgaacgggcagagcgccagaatcagtgcctgatgatagacactggagcggctgagcaggccgtttgtgaacgccccgatagcgccaccctggtgtttgatattttcgatgccggttaaccgcgccatctcttcgcccagctcccgcccttcacgcagactcgccagcaccaccggcggcagggtgaaactggccgagcgcgattcgccgcgctgcttctgattttctaccaccatccaggcaaacgcgctgtcatcttcgatgcccgcctcaatcgctacccagaacgccgcttctggccggacctgccgggcattcatcacgcgctgacgtgcgccagttcgcgtttcgagatgggttaacggttgtgctgctacgccgctatcgacctcgaccccttcaatatggcaggatccctcgccgaaaacgtcgttgaatgcctgagcaatcgcatgaattttcgctggattggtggtggctgcgacaacatggtacataattggttgaaccctcaggtgattaagcgcctggtccatcgggctgtttgatttgtcattctgaacccgggcagtgctcacaatcctcacgtactttccgtacgcgccggttgtttcgcgctctccgtgtgcagactgactgcaacaatgacgcctgatggggtaagctctaaagcgatttttgtcgcagtataacggaaactaacatgctacaggtctatcttgttcgtcacggtgaaacggtatggaatgcggagcgtcgcattcagggtcagtccgacagtccgctgacggaaaaaggtgagcagcaagcctggcaggtgggtgagcgcgtgaaacatctgggcattacgcacattattgccagcgatctggggcgaaacgcgccgcaccgcggagattattgcggatgcctgcggttgctcagtcacgcttgatccgcggttgcgtgagctgaatatgggggtgctggagaagcgtccgctggatggcttaaccgcggaagaagagcagtggcgcgccacgctggtcaacggcaccgaagggggccgtattcctgaaggggagtcgatgactgagatggcgacgcgcatgcacgccgcgctgaatgcctgtcttgatcttcctgccggaagccgtccactgctcgtcagtcacggtatggcgctgggggcgctggtcagcacgattctcggtctgcccgcctatgcggaacgtcgtctgcgtctgcgtaactgctcactctcgcgtgttgattatcagcagagcgcctggctggcagaaggctggattgtcgagacggcgggggatatttcccatctggatgcgcctgcactcgacgagcttcaacgctgatctacttaaggctgccgtcgcgatgacggcagccttaacgtcagctggctacggtctggcggcgaatgggaatcagatattcgcaacggatctcggtcggtggctcagcgcgttttttaccgccatcggtgtaaaagcgttcgatgtcctgtccctgacggcgggtcagccccagcgtcggcatgcaggtgccatagagcagcagaataaactcctgcagattgacgcgcgggccggtataggtgaactgcacgtagtcgcccgcttccagaatcacgttctggccggagtgcaggttaaccgcgctgtcagcaggcaccgccgtggtgtagagaatctcctgctcatcatctttgtcctggctggcgcgcacctgatgcaggccatacagtaccggcggcaccgtgtcggtttccagcaggaactgcttccagaaatgaatacgcatttcgtcgcggtagctggaaatctgctccagaatacaggtgtagttctgggtttgtcctaccagcaccgtctccggtaaggtgacgaaagccggttccggctgcgtctcatcgtccagccgaataggggggcgaataccgaatgagttccagtcggaagagcggcgataccacgccggtgtctgagcaaactgcttcttgaatgcgcgagtaaaagtctgttgtgaatcaaaacgatactgcagtgcgatgtccagaatcgggcggctggtcaggcgcagcgccacggcggctttagacagacgacgcgcacgaatataggcacctattgcgtgtccggttacgtctttaaacatcctctgtaaatgccatttagagtaaccggctttctgggcaacattgtccagtgaaaggggttgatccagatggctctccagccagacaagcaaatcgcgaatgataccggcttggtccataaaacatcctcatactctggtggtacagctaaacgcattcgaagaatattagcactcattgctcaaaagacgtgggccgttttccggggaaggttgtgctaaatcagtacgggcttcaacccgttttggtttggtcattaactcgattaacagtacattacattctcatctattccatttgcaatggtaactccatgacaatattccgacttatgatcgctgcgctgaccacgctgaccttttccagcccgctgtttgccgaacagattggctctgttgatacggtattcaagatattcgggcctgaccacaagattgtcgttgaggctttcgatgatccggacgttaaaaatgtaacctgttatatcagccgggcgaaaaccgggggtattaaaggcggactgggtctggcagaagatacctctgatgccgcgatttcctgtcagcaggtgggtccggtcgaactgagtgataaaatcgctcagggcaaagcagagggtgaagtggtattccgccagcgcacctcattgatcttcaagaagctgcaggttgtacgcttcttcgacaaaaagcgcaacgccctggtctatctgacctattccgataaagtggttgatggctcaccgaaaaatgcgattagcgctgtgccaattatgccgtggcactgattatgccgtcacgctaaggacaaaaaaaacgcccgcaggggcgttttttatttgccgcgtctgacaggggcttaatcctgcaggtcaccgcagaagcgataaccttcaccatgaatggtggcgatgatctctggcgtgtccggcgttgattcgaaatgcttacgaatacgacgaatggtgacatcaacggtgcgatcgtgtggcttgaggtcgcggccggtcatttttttcagcagatcggcacgggtctgaattttgcccgggttttcgcagaagtgcagcatggcgcggaactcactgcgtggcagtttatagtgctcgccgttcgggttgatcagtgagcggctgttgatatccagctcccaaccgttgaacttgtagctctctacctgacgacgctcttcgcctggcatggccagattcatggtgcgcgacagcagattgcgggcacgaatagtcagctcacgcggattaaacggtttggtgatgtagtcgtcagcgccaatttccagaccaagaattttatcgacttcgttgtcacggccggtcaggaacatcagggcgacattggcctgctcacgcagttcacgggccagcaacaggccgtttttaccgggcaggttgatgtccatgatgaccaggttaacgtcattgtcggtcagcacctgatgcatttcagcaccatcagtcgcctcatacaccacataaccttccgcctcaaaaatactcttgagggtattacgcgtgaccagttcgtcttcaacgataagaatgtgcggggtctgcatgtttagctacctaaaatttgccaacaaattgaaaacagggcgtacagcggtatggcgtttctccatcatcgagagcggcgggccgcgctgaaccgttgtacgaaatcatattttgataagccatctatcaacgtcaacaacagtattagctcagccagtcaggatgaaaattgcatgccccgggcgttaatgataatggcgcatatcctaactgtattaacagcaacctaacagcaccaactacaaccgataagcataaaaacaacgcttcgttgacttatatcaaatgcaattgtagcacgttaacacttttgtgaaaaacttctcgcagattgcctgtttagctcacaaaaagcatcattttcgttacattttttacgcagtcgggccaaaataaaacccgccggaaatcacattctatctcgttgaagttaaatggtttaataatgatttctttaataaagctcgtttcagggataaaaagattcaggccatcacttttaaccagttttaacatggttaacacacgattttcttaataccttctggcgactgaatcattaacagccatgttaatatggcgttatgttaatggaccaatggaataaatatgctttttcccctgattctcgtctcgcccgcgcggccagaaaatatcggcgctgcggcgcgtgccatgaaaaccatgggattcagccagctgcgcatcgttgccagtgacgcctggcaggatcccgcagcgcgccgggtggcacatggtgccggcgaaattctcgacaacgttcagacctttgcaaccctggccgacgcgttagcggacatcgatttttcggtcgcgaccaccgcgcgcagccgggcaaagtttcgttattacgccacaccggagcaggttgaaacgcaactgctggagaaacgccagtgggtaaacagtatggcgctggtgtttggccgcgaagatagcgggctgaccaacgaggagctggagcttgtagacctgctgaccggcatcccgatggcgaatgactatccttcactcaatctcggacaggcggtgatggtctactgctatcagctgtcgaagctgaatcaggttgaggcatcaaaagcctctgcggcggatgggcagcagttgcaggcgctgcgtcagcgtttccatcagctgctggcacaactggaggtcagtgatgatgagaagctgtcagactggatcgatcagcgggtggggctgctggaacagcgcgacagtgcgatgctgcatcgtctgctgcacgatattgaaaaaaaactcacagataaatcctcggcaaaaagctgattttacagcaacagatcgcagggaatttctgcatcgcaaccgatcgaacagcgttttacgctttcaccggtggctgtgcgcagtggtggaaatctgtccgccggacaaatcgggttgacttaatgtgcgctttgctttacttctggaagcaagacggacagacaaaaacagacagaaaataaatctaaatgcgtaaaatcagcctgaacaccacaattattaccaccaccattaccacaggtaacggtgcgggctgacgcatacaggaaaaacagaaaataagcccgcacctaaacagtgcgggcttttttttcggcttaaattcaggagagtttatattatgcgagtgctgaaattcggcgggacctcggtagcgaatgcagagcgatttcttcgcgtcgctgacattctggaaagtaatgcgcaacaaggacaggttgcaaccgtgctctctgcgccagcaaagatcactaaccatctggtggcgatgattgaaaaaaccatcagtggtcaggatgctttgccgaatatcagcgacgccgaacgcatcttcagcgagctgttgcagggactggctgacgcgcagccgggctttgagtacgatcgactgaaaacccgcgttgacctagagtttgcgcagctgaagcaggtttctgcacggtatcagcctgctggggcagtgcccggacagcgtcaacgcggcgattatctgccgcggtgaaaaactctcgattgcgatcatggaagcgctgctgcaggcgcgcggccatgaggtcagcgtgatcgatccggtggaaaaattgctggcggttggccactaccttgaatctactgtcgatatcgccgaatcaacccgccgcattgaagcaagtcagattccgccgcagaacatgatcctgatggcgggcttcacggctggtaacgagcgaggcgagctggtcgtactgggccgtaacggttctgactattcagccgctgtgctggccgcctgtctgcgcgccgactgctgtgaaatctggactgatgtggatggcgtctatacctgcgatccgcgtcaggtgccggatgcgcgcctgctgaagtcgatgtcctatcaggaggcgatggagctctcctatttcggcgccaaagtgctgcatccccgcaccatcgcgcccattgcccagttccagatcccctgcctgatcaaaaacacggccaatccgcaggcacccggcaccctgattggagcagaaggcgaacaggatgagaacccggtaaaaggcatcaccaacctgaataatatggcgatggtcaacgtctccggtcctggcatgaaagggatggtcgggatggcggccagagtctttgcggcgatgtcgcgcaccggcatctcggtggtgttgatcacccaatcctcttccgaatacagcatcagtttctgcgtgccgcagagcgagctggcgcgggcgcgtcaggtgctggaggaggagttctacctggagctgaaagatggcctgctggatccgctggatatcattgaaaacctggcggtgatttcagtggtgggcgatggcatgcgcacgctgcgcggcatttcagccaaattcttctcggcgctggcgcgcgccaatatcaatatcgtggcgattgctcagggctcctccgagcgttcaatctcggtggtggtgaacaatgatgaagtgatcaccggggttcgcgtggtgcatcagatgctgttcgccaccgatcaggtaatcgaagtgtttgtggtcggcgtcggcggcgtcggcggcgcgctgctggatcagttacatcgccagcaggcgtggctgaagaaaaagcatatcgacctgcgcgtctgcggcatcgctaactcccgtgcgctgttaacccacgtccacggcatcgatttaagcaactggcaggcggcattaggcgaagcgaaagagccgttcaatctcggtcgtctgacccgtctggtgaaagagtaccacctgctcaatccggtgattgtggactgtacttccagccaggcggtcgccgatcagtatgctgattttctcagcgaaggtttccatgtggtgacgccaaacaaaaaggccaacacctcatcctggaattactatcagcagatgcgagccgccgctgccaaatcgcggcgtaaattcctctatgataccaacgtcggcgccggactgccggtgatcgaaaacctgcagaacctgatgaacgccggtgatgagctgctgcgcttctccggtatcctctctggctcgctgtcctacattttcggccagctggatgacggaatgtcactgtcgcaggcgacaacgatggcgcgtgagatgggctttaccgagcccgatccgcgtgacgacctctccggcaccgatgtggcgcgtaagctgctgatcctggcccgtgaagcgggtcatcagctggagctgagcgacattgagattgagccgctgctgcccgccagcctgaccgaaatccaggacattgagcagtttatgcagcgtctgcctgagctggataacgcctttgccgcccgggttgcgcaggcgcaggatgagggcaaagtattgcgctatgttggcgtgattgaagagggcggcatctgcaaagtgaagatcgacgccgttgatggcaacgatccactctataaggtgaaaaacggcgagaatgcgctggcgttttacagccgctactatcaaccgattccgctggtgctgcgcggatacggtgcaggaaatgatgtcacagcggccggtgtctttgccgacctgctgcggacactgtcatggaagttgggagtttaatcatggtaaaaatttacgcaccggcctcgattggtaacgtcagcgtcggcttcgatgtgctgggcgcggcggtttcgccggtagatggctccctgttgggtgactgcgtctccgtggaagcggcagagcagttttcactgaccaacgccggacgttttgtcagtaagctgcccgccgatccgaaagagaatattgtttaccagtgctggcagcgtttctgccaggaaatcggcaaagcgatcccggtggcgatgacgctggagaagaacatgcccatcggctccgggctgggttccagcgcctgctcggtggtggccggtttaatggcgatgaacgagttttgcggcaagcctctcagcgacagcacgttactgaccctgatgggtgagctggaagggcgaatctccggcagcgtgcactatgataatgtcgccccttgcttcctcggcggcattcagctgatgctgcaggagaatgacattatcagccaggcggtgccgggctttgatgactggctgtgggtgatggcctatccgggcattaaagtttcgaccgcagaagcgcgcgccattttaccggcgcagtaccgcaaagaggactgcatcaggcatggccgtttgctggccggcttcattcacgcctgccatacgcgtcagccgcagctggcagctaaacttatgcaggatgtgattgccgaaccttaccggacccggctgctgccaggcttcaccgaggcgcggcaggccgcgaaagatattggcgcactggcgtgcggtatctcaggctctggtccgacacttttcgccgtttgcaatcagatggaaacggcacagcggatggctgactggctgagccagcactatctgcagaatgatgaaggcttcgtccatatctgccgtctcgacacggctggcgcacgacaattgggataacgcatgaaactctacaatcttaaggatcacaacgagcaggtcagcttcgcccaggcggtgaaacagggtctgggttcgcagcagggtctgttctttccgctggaactgccggagtttgaactgaccgacatcgacgcgatgctggagatggattttgtcagccgcagcagcaaaattctctcggctttcattggtgacgagattccggcccagcagctgcatgagcgtgttaaagccgcttttgcttttccggccccggtgaaagccgtcagcgaagatatcgcctgtctggagctgttccacggcccgacgctggcgtttaaagatttcggcggccgttttatggcgcagatgctgtcgtatgtctcaggctcagatgagcagatcaccattcttaccgccacctccggtgataccggcgcggccgtggcgcacgccttttacggcatgaagaacgtgcgcgtggtgatcctctatccgcagggcaaaatcagtccgctgcaggagaaactcttctgtaccctgggcggcaacatcgaaaccatctctatcgacggcgattttgatgcctgccagtcgctggtgaaacaggcgtttgatgatgaagagctgaagcgcgcgattggcctgaactcggctaactccatcaacatcagccgcctgctggcgcagatctgctactactttgaagcggtcgcgcagctgccacaggaaaaacgtaatcagctggtggtgtcagtgccgagcggcaactttggtgatttgaccgccggtctgctggcgaaatcgctgggcctgccgatcaaacgctttatcgccgccaccaacgccaacgacacggtgccgcgcttcctgggcaacggcgagtggcagccaaaccagacggtctctacgctgtcgaatgccatggatgtcagccagcctaataactggccgcgtgtggaagagctgttccgccgtaaaacctggcgcttaaccgatctggcctgtggtgcggtctcggatgagaccacgcgcgccgccatgcgtgaactggctgagatgggctacatttccgagccgcatgccgccatcgcctggcgtctgttgcgcgatcagctgcaggaaggggagtatggtgtgttcctgggaaccgcgcatccggcgaaattccgcgaaagtgtggaagcgatccttgaacagaccctgacgctgccgccggagttagcggagcgcgccgacctgccgctgctgtcgcatcagatgaagggtgatttcgcctcgctgcgggcgtttctgctgaagtaaacctgtgaaaggcttcccggttgcgggaagcctgtttgtggaaagcagagggcgcggggtgttactgctctgcgcgcttaaagaccagctcgctctcgctgctgctggctgcatcaaaacgatagccatccagatcaaacgccttaagctgttccggcttcgtcaggcgctgctgaatcacatagcgactcattaatccacgcgcctttttggcatagaagctaatcactttgtaactgccattcttctcgtcgaggaacaccggcttaatcatctgtgcccgcagcgtcttcggcttaaccgcccggaaatattcgtccgaggcgaggttgatcagcacctcatcgccctgttccgccagcgcggcattcagcgtttcagtgatgagatcgccccagaaggtgtagagatctttgcccgccggattcgccaggcgaatgcccatctccagacggtaaggctgcattaaatcgagtggacgcagtacgccatacaggcctgataacatacgcaggtgctgctgagcaaaatcgaaatcctgatcgctgaaggtctctgcctgtaaaccggtgtagacatcacctttgaacgccaggatagcctgacgggcattcttaggggaaaaatcgggctgccagctgttaaagcgctcggcattgaggtgcgccagtttatcgctgatgtccattaacgaggcgatgctggcgggtgacagctcgcgcgcaatttcaatcagctgttgtgacttttctaacagcgcaggctgggtgaaacgcgttgtcgccagcgggctttcataatccagcgtcttggcgggagagatcaccatcaacatagttgcttcctcggttaatgcctggtttaacagggcattggctgcttatcaggcttcgcagtgtaccaaaaaagccgcaaagaatgacgaatcacacctatttgttcgcgctatcgtaaacggcattccctgaccttgcgccaccgttgccgcgtgatattatcgcaacagccttttttcacactgacagttaactaagagaaaagaacatgacggacaaacttacctccctgcgtcagctcaccaccgtcgtcgccgacaccggtgatattgcagccatgaagctgtatcagccacaagacgccaccaccaacccttctctgattctcaacgccgcgcaaattcctgaataccgtaaactgatcgatgaagcgatcggctgggcgcgtgagcagagcagcaacaaagaagagcagctgcagctggtttctgacaagctggccgtgaacattggtctggaaattctcaaactgatcccaggccgcatctcgacggaagtggatgcgcgtctctcttacgacactgaaggcagcatcgccaaagcccgcagcctgatcaaactctacaatgatgccggtatcagcaacgaccgcatcctgatcaaactggcctctacctggcagggcatccgtgctgcagagcagctggaaaaagagggtatcaactgtaacctgacgctgctgtttctcctttgctcaggcgcgtgcctgtgctgaagcgggcgtgttcctgatctctccgtttgttggccgtatcctcgactggtacaaagccaacaccgacaagaaagagtatgccgcgcacgaagatccaggcgtggtttcagtttctgaaatctacaactactacaagcagcacggctatgaaaccgtggtaatgggcgccagcttccgtaacgtcggcgaaatcatcgagctggctggctgtgaccgtctgaccatttctcctgcgctgctgaaagagctggcggagagcgaaggcaccctggagcgtaaactgagctacagcggcgaagtgaaagcgcgtccggcccgcatgaccgagtctgagttcctgtggcagcacaaccaggatccgatggcggttgcgaagctggcagaaggtatccgcaattttgccgttgatcagggcaaacttgagaagatgctggcagaactgctgtaatctgttgaccgtggcggcgcaggctgccacggttttcccttttccgaccctttcactttatattatcctctcggctattccccttttactccaaccgcaccgcggtaaatcacagcgaagctaatcatgaatacattacgcattggcctgatctcggtctccgatcgcgccgcgaacggcatttatcaggatcagggtattcccgcgctggagagctggctcggcagcgcaatcagcagcccgtttgagattgagtcccgactggtgcccgacgagcagccgatgattgagcaggcgatttgcgaactggtcgatgaacgtttttgccatctggtgttaaccaccggcggcaccggtccggcccgacgcgatgtcacgcccgatgccaccttagccgttgccgatcgtgaaatgcctggttttggtgagcagatgcgccagatcagcctgcagttcgtaccgaccgcgattctgtcgcgtcaggtcggggtgatccgcaagcagtctctgatcctcaatctgcctggtcagccgaagtcgatcaaagagacgctggaagggctgaaggatgagcagggcaacgtaaaagttcacggcatctttgcatctgtaccttattgtttacagttgctggaagggccttacgtcgaaacgcattccagcgtagtagcagcatttcggcctaaaagcgctatacgtgagataaataactaaatattccccatttcaggcataagctatagccttgctggtgtggcaaaagattgacggtatagtaataagatctttacaactttatctcttttgcctctggaatattatgaatccgactcacactcagcgtctgaccggtaaggattacaagaccctggcgctggccgcgctgggcggcgcgctggaattctacgacttcattatcttcgtcttcttcgccaccgtgattggcgaactctttttcccctcggatatcccggaatggctgcgtcagctgcagacgtttgccatttttgccgcaggctatctggctcgtccgctgggcggcatcgtgatggcgcattttggcgataagctcgggcgcaaaaagatgttcagcctgagcattctgctgatggcgctgccgaccctgatgatgggcgctttacccacctggcagacgattggcattgctgcgccactgctgatgctgctgatgcggatgttacagggcgcggcgattggcggtgaagtgccgggcgcctgggtgtttgtcgcggaacacgtgccctataaacgtatcggcatcgcctgcggcacgctgacggccgggctgactatcggcattttactggggtcgctggtagccacgctgatcaatacctcaatgtcgcagcaggcgatccatgatggcggctggcgcatcccgtttcttcctcggcggcgtgttcgggctgatcgcgatgtacctgcgtcgctggctgcatgagacgccagtgtttatcgagatgcagcagcgtaaagcgctggcggaaactctgccgctgaagaccgtgctggcagagcataaaaagtcgattgtcatctctatgctgctgacctggctgctctccgcctgcatcgtggtggtgatcctgatgtcgccggtctggctgcaaaaacagcagggcatcgcgcctgcgctgaccctgcaggccaacagcatcgccaccgtgatgctctgcattggctgcattattgccggactcgcggccgatcgctttggtgccagtcgtacgctgtgtgtcggcagcctgctgctggcgatctgtagctggcagttttatcacctgaccgccctctatccacagcagctcttcctgctttatggcgtggcgggtctcagcgtcggtatcgtcggcgtggtgccctttgtgatggtgcgcgcctttccggcagaagtgcgttttaccggactctcattttcctacaacctctcctatgcgatctttggcgggctgacacccatctttgtgtcgctgctgatgaacgtctcagagatggcaccctgctggtatgtgatggcgctggcgctggtaggattgctgacggggatctggctgcggcgtgatgtcagccacgagcctggcctgcagcaggggattaactctttgtaatgcggggacgcggagcctggctccgcgtctttttttatgtgtaaaagcaggcttaaagcgatttcgcgccaatcggcagaatagtgcggccaaaggtttcgttcagcacttcacccatcgccagatagcaggcgctggctccacagagtatcccgacccagcccgcggagaccaccagcgccggcaggtgcataagatgggccacggccagcagcagaaacagcagcgagagcgagccgaaaacaaactgcagcatccgcgcacctctcagcgtaccgacgaacataaacagcgtgaaaatgccccacagtgccagccaggctcccaggaaacgttcgtctggcgcttttgccagacccatttcaggtaacagcagaatcgccacaaagcttaaccagaacatgccgtaagaggtaaaggcggtcagcccgaaagtgttgttctttttaaactccagcagaccggccagcacctgtgcaatcccgccataaaaaatgcccatggctaaaatcgccacgtccatggcaaacaggcccgtgttgtgcaggttcagcaaaatggtcgtcatgccaaatcccattaatcccagcggggcagggttagccagcgttgaatttgccatagttcctcggcagtaaaatgatcgttgatgtaataaacggatttcgtcctgctccctgaggggaacaaggcgacgcatcatattcagcgttgtggcagcgtttctttgatcccgacagggccaaaggtaaaaatttttttttggtttagcccttgatgcgcatcgaagcggccccatttacttgtcatagagcgttgtgaacgttggaaaaaaagcatgtgctggcagttgaatgcaaacaacccgcccacataaaaggttcacaacccaaattggcaacgaatttaagtgggagatgtttagatgggtaagattattggtattgacctgggtacaaccaactcttgtgttgcgatcatggatggcactaaagcacgcgtgctggaaaatgccgagggcgatcgcaccacgccttcaattattgcgtatacacaggatggcgaaattctggtcggtcaaccggctaaacgtcaggcagtgaccaacccgcagaataccctgttcgcaattaagcgtctgatcggtcgtcgcttccaggacgaagaagtacagcgtgatattaaaatcatgccgtacaaaattaccggcgctgacaacggcgacgcatggctggaagtgaaaggtcagagaatggcaccgccgcagatctctgctgaagtgctgaagaaaatgaaaaagaccgccgaagattacctcggtgagccagtgactgaagcggttattaccgtaccggcttacttcaacgatgcgcagcgtcaggcgaccaaagacgccggccgtatcgcgggtctggaagtcaaacgtatcattaacgaaccgactgctgctgcactggcatacggtctggataaaggccagggtaaccgcaccatcgcggtttatgacctgggtggcggtaccttcgatatctcaatcattgagatcgacgaagttgacggcgaaaaaacctttgaagttctggcgaccaacggtgatacccacctgggtggtgaagacttcgatagccgcctgattaactatctggttgctgaattcaagaaagaccagggcatcgatctgcacaacgatccactggcgatgcagcgtctgaaagaagcggcagagaaagcgaaaatcgaactttcttctgcacagcagaccgacgttaacctgccatacatcacggcagatgcgaccggtcctaaacacctgaacatcaaagtgacccgctctaaactggagtcactggttgaagatctggttgctcgctcaatcgcgccactgaaagttgcgctgcaggacgccggactgtctgtttcagacatcaacgacgttatcctggtgggtggtcagactcgtatgccactggttcaggccaaagtgactgagttcttcggtaaagagccacgtaaagacgtgaacccggatgaagcggtcgcggtcggtgctgcagtttcagggtggtgtactgggtggcgacgtgaaagacgtgctgctgctggacgttaccccgctgtcactgggtatcgaaaccatgggtggtgtgatgacttcgctgatcagcaagaacaccactatcccaaccaagcacagccaggtcttctcgactgctgaagataaccagtcagccgtgaccattcacgtgctgcagggtgagcgtaagcgcgccaatgacaacaagtcactgggccagttcaaccttgacggtattcagaacgcgccacgcggtctgccgcagatcgaagtgaccttcgacatcgatgcggatggtatcctgcacgtgtcggcgaaagataagaacagcggtaaagagcagaaaatcaccatcaaagcctcttcaggtctgagcgatgaagagatccagaaaatggtgcgtgatgcggaagcgaacgctgaatctgaccgcaagttcgaagagctggtacagacgcgtaaccagggcgatcagattgcccacagcacgcgtaagcagctggaagaagcaggcgacaaactgtcagctgatgacaaaacgccaatcgaagccgctctggccgcgctggaaactgcgctgagaggcgaagacaaagcggaaatcgatgccaaaatgcaggcgctgatggaagtgtccggcaaactgatggaagcagcacagcagtctcaggcgggtgcagcggatgccggtgacgcgtcagcgaagaaagatgacgacgttgtcgatgctgaattcgaagaagtgaaagacaacaagaaataattgcccctgaccgggcgcgacggttggcctgacagccgttgaaaccagcacgggcgtaggagatctctccacgcccgtgcgatcatgttaagggctaaataaacatggcgaagagtgattactacgagattttaggcgtcgccaaatccgcggacgagcgtgaaatcaaaaaggcttacaaacgcctggcaatgaaatttcacccggaccgtaatcccggtgacaaagaagccgaagccaaattcaaagaggtcaaggaagcgtacgaaatcctgaccgatgcgcagaagcgtgcggcctacgatcaatatggtcatgcagcctttgaacagggcggtatgggtggcggtggatacggcggcggcggctttggtggcggcggcgcagacttcagcgatatctttggcgacgtgttcggtgacatctttggtggtggacgccgtcagcgcgcctcccgtggcgccgatttacgctacaacatggagctgtcgctggaagaagcggtacgcggcgtgaccaaagagatccgcattccaacgctggaagagtgtgacgtctgccacggcagcggcgcgaaagcgggaacgcagccacaaacctgttcaacctgtcacggtgcaggccaggtgcagatgcgccagggcttcttcaccgttcagcaggcctgtccgacctgtcatggtcgcggctcggtgattaaagatccgtgcaacgcctgtcatggtcatggccgcgttgagaagtcgaaaacgctgtcagtgaaaatcccggcaggggtcgacaccggcgatcgcattcgtctcagcggcgaaggcgaagcgggcgagcagggcgcaccagcaggcgatctctacgttcaggtctcggtgaagaaacacccgatcttcgagcgtgaagagaacaatctttactgtgaagtgccgatcaactttgcgatggcagcgctgggcggtgagattgaagtaccgaccctggatggtcgcgtgaagcttaaagtgccgtcagaaactcagaccggcaagctgttccgcatgcgcggacgtggcgtgaaatctgtgcgtggcggcgcggtcggcgatctgctgtgtcgtgtcgtggtggaaacaccggtcagcctgaatgagaaacagaaagcgctgttgcgtgaactggaagagagttttggcggcccgagcggcgagcataatagcccacgctccaagagctttttcgacggcgtgaaaaaattctttgatgatctgactcgttaagtctgcctgataaaaagcggagctccggctctgatgccagtcagttaagcgacaggtgataacgcagtctggtgccgcgcaggggctggcggtcctcgcgccgctgcgcggttccttcacttcattcctctgcctgacggaccggcggggatggcacatcctgtgccgccccgcctttcgcccgcgtcctgcgggctctcctggcagactcattctgttcagcgctgcggattacctgcccctgcccgaccccagcctgctctgaaacttcagtgtgtagtgttaaaaagggcacgagagtggaggcctgagcgcctctgctgctgaaagggctatccgcagcgctgaggcgtgacggtgggccagaagtccacgccgggaagcgtggacagttcggggccggccagggagggccgatccccgaacggtttcgtcggcacgccgtcaaagccgaaggtaccgcgtgagcggcgcgaggacggcccggcagcagcagaggtgctcaggcccgcactgcggctcgctcgcccggaaaaaaagctgccacgtctgaccgtgacagcctttacaaatctaatcttaactgaccagcattggagccccggctccgctttttttactttaaatcccctgcctgtgatggctgcattatctctccctcaccgcagcactcataaaaatgtcgacgtttactgctattactgctcggcgaaacagagcatatagcgcggtataagctgcttttaacgaactatatgaatcgttacactgtttaacattctgtctctgctcaggaagatgaacgttgaacaagccgcgcaaattaaaaaatctgctaaaaagttttattgaaagtgatgccagcaatggcgtgatgttgatcgtggcggcggtcgcggcgatgatcctcgccaatacggccgctaccgcccagggttaccaggcgttgctgaatgaaccggtacaaatccgcttcggagcgctggatatcagcaaaaacttgctgttgtggatcaacgatgcgctgatggcgcttttctttctggttattggcctggaagtaaagcgtgagttgatggtcggcgaacttgccagccgtgacaaggcgatcttcccggtcatcgcggcaataggcggcatggcgttacccgccctgatcttcctgcttttcaaccatggtgatgagattgcacgtaacggctgggccattcccaccgcaaccgatatcgcttttgcgctgggtgtgctggcccttctgggcagccgtgttcccgttgcgctgaaagtctttctgatggcactggcgattattgatgacctgggtgccattgtgattatcgctctgttctataccagtgacctctcagtgctctccctgtgcgtggctgctggcgcaattgtcgtgctggcactcctgaaccgctttaacgtccgtagaatctcagtctacatactggtgggtatcatactctggaccgccgtgctgaagtcgggcgtccacgcaaccctggctggcgtcattgtgggcttcttcgtgcctctggagaagaaagaggggcactctccagcggaacatctggcgcatggtctgatgccgtgggtgaactggatgattctgccgctgtttgcctttgctaatgccggtatctcacttgctggcattacgctgagtgatgtcctctcgcctgaaccgtcaggcatcatcttcggcctgttaatcggtaagccattaggcattacgctcttctgctggctggcggtaaaactgcggctggcagtattacccaacggcacaaccatacgcgatattatggcgattggtgtgctgtgcggaattggcttcactatgtcaatttttatcagtttcgctggcctttgatgccgcgcatgaacagctggtgaccttttctaaactgggcatactgaccggctctctgctttcagccgtcatcggctatacgctgctgcgaattaaactgcgttaatggggaggaggcgaaagcctcctttttgctatgaatcagctcaatttcaatcatctctactactggcacgcctgccgtgcgggatcaattacggcggcagcagaggcactctccctgacgccgcagaccattaccgggcagattaaggcactggaggagcgcctgcagggcaagcttttccggcgtcagggacggggcctggtaccgactgaactggggcagctggtttttcgctatgctgaccgcatgtttatgctgagtcaggagatgctggatattgtgaattaccgcaaagagtctcatctgctactggatgttggcgtggcagatgcgctctcaaagcagctggtcagcaaggtgctggagacggcggtggtcgcagaggagaaaattcatctgcgctgttttgaatcgacccacgaaatgctgctggagcagctcagtcagcacaagctggatatgattatctctgactgctccatcgaccccacccaacaggaagggctattttcggtgaagctgggggaatgcccgatcagcttctggtcaacccagccgctcagcgatctctcttttccggcctgcctggagacgcgtcccctgctgattccggggcgccgctccatgctggggcgcaaaatcctcaactggatcagcacccagggagtgcaggtggagattctcggtgagtttgatgatgcggcactgatgacggcgtttggtgcgcgacagaatgcgatttttgtcgcgcctttgctggagatgggtcaacgtgaggggatatatgaagtcgggcggctcgacgcggtatcagaggagtatcacatactcttcgcggagcggatgattcagcatccggcggtgcagcgactctgtcacgcagacttcagcgaactctttccccgccaggggacagacgaaaaaaaaaccggcgtaagcgccggcttttttaacaaagcgattaacaacaggcgattaagccagtttgttgatctgtgcagtcaggttagacttataacgtgcagctttgttcttgtggatcagacctttagcagcctgacggtccacgagtggttgcatttcattgaatgcgttctgcgcagcagctttgtcgcctgaagcgatcgccgcgtatactttcttaacgaaggtacgcatcatagagcggcggctagcgttatgcttacggcgtttctcagatgttacggcgcgtttcttagctgatttgatattagccaaggtacaactcccaaatgtgttctatagagacaaatcaaaggccgaggactatgcccttctaacctgattttgtcaatggatttgtgcaaataagcgtcgccctgagagcggcactcggttacgtatttgatggcgcaggattctaccagcttcccctcgctgaatacagtatttcgcgacaaaattcttaacatgcgcttctgcaacaggaaatgcagcgcctaaagcatgaaaggcgtgctgacgggttaacctgagtcgctttcaagggtataatccgccgatttccaccggtttgggccagccatgaagtttatccgcggtattcataatcttaacgagcagcatcgcggctgcgttctgaccattggtaatttcgatggcgtgcaccgtgggcatcaggcgctgatgtcgcggctgtgtgaagagggacgtaagcgcaatctgccggtggtggtcatggtttttgagccacagccgctggagctgtttgccggtgacaaagcgccggctcgtctgacgcgtctgcgtgaaaaactgcgatacatggcggaagccggcgtcgataaagtgttgtgcgtgcggttcgaccgtcgctttgcggccttgtccgcccagcgttttatcagtgacctgttagtcgaaaagctggacgtaaagtaccttgcggtaggcgatgatttccgcttcggcgctggtcgccagggtgatttcctgttattacagaaagccggtgcggagtacggctttgaggtcgtcagcaccgaaaccttctgtgatggcggtaagcgaatcagcagtactgccgtgcgtcaggcgctggccgtggatgatttagcgctggcgcagtcgctgcttggtcaccctttcactatttccggccgcgttgtgcacggtgatgcactgggacgcacgctgggtttccccacggcgaacctccctttacgccgcagcgtctcgccggtgaaaggggtttatgcggtagaggtacggggtctgacgcccgagccactgccaggtgtcgccaatatcggcacccgtccgaccgtaaaaggtttacgccagcagcttgaagttcacctgctcgacatcaatatggatctctatggtcgtcacattgatgtggtgctgaaacagaaaatacgaaacgagcagcgctttgcctcactggaggcgttgaaagaacaaattgcgaacgatgtggtaacggcccggcagttctttgggctgctttaacctgagcgaaaaacggaatcgagaatctgatgagtgactataaatctaccctgaatttgccggaaacgggattcccgatgcgtggcgatctggccaaacgcgaaccgggaatgttgcaacgctggtatgccgacaatctgtacggcatcatccgcgaagccaaaaaagggaaaaaaacctttatcctgcatgatggccctccgtatgcgaaacggcagcattcatattggtcactccgttaacaagattctgaaagacattatcgttaagtcgaaaggcatggcgggttatgattcgccgtatgtgccgggctgggactgtcacggtctgccaatcgaacacaaagttgagcagatgatcggcaagccaggcgagaaagtcaccgctgctgaattccgcgaagcgtgccgcaaatacgccgcagaacaggttgaaggccagaaggcggactttatccgtctgggcgtgctgggcgactgggatcgtccttacctgaccatggatttcggtaccgaagccaacatcattcgtgcgctgagtaaaatcatcggcaacggccacctgcacaaaggcgctaagcccgtgcactggtgcctggattgccgttctgccttagcagaagcggaagtggagtattacgacaaaacgtcaccgtcgattgatgtgatgttcaacgccattgatgccgacgcggtgcgtcaggcgtttggtgtggcacaggttaatggtccgatttcactggtgatctggacgacgacaccgtggacgctgccagctaaccgcgccatctcgttaaacgcggaatttgagtatcagctgctgcagatcgacggtcgcgcgctgatcctggcaaaagatctggtcgagagcgtgatgaagcgcgcgggcgtcagcgaatggcaggtactgggcgaatgcaaaggcgcggcgctggagctacagaaattccagcatccgttcctggcgcttgagtcgctggtggtgctgggcgatcacgtcaccctggaagcgggtaccggtgcagtccacacggcacctggccacggtccggatgactatgttatcggtcagaaatatggcatcgaaaccgccaatccggtcggaccggatggccgctatctgccaggcacctatccgacgctggatggggtcaacgtctttaaagccaacgacatgatcgttgagctgctgaaagagaagggcgcgctgctgcacgttgagaaactgctgcacagctacccgcactgctggcgccataaaacgccgatcatcttccgcgccacaccgcaatggttcatcagcatggatcagaaaggattgcgtgcgcagtcgctgaaggagatcaaaggcgtgcagtggatcccggactggggccaggcgcgtatcgaatcgatggtggcgaaccgtcctgactggtgtatctctcgtcagcgtacctggggcgtaccgatggcgctgttcgttcataaagagagcgaagagctgcacccggacacgctggcgctgatggaaaaagtggcgcagcgcgttgagcaggaggggattcaggcctggtgggatctcgatccgcgcgagctgatgggcgacgatgccgatcattacgtaaaagtgccggatacgctggatgtctggtttgactccggttcaaccagctattccgtggttgatgcgcgtccggaatttgacggacatgcgcctgacctctatctggaagggtccgatcagcatcgcggctggtttatgtcctcgctgatgatctccacggcgatgaagggcaaagcgccttatcgtcaggtactgacacacggtttcaccgtggatggtcagggccgcaagatgtcgaaatcgatcggtaacacggttgcgccgcaggatgtgatgaacaaactgggcgccgatattctgcgcctgtgggtggcatcaaccgactactcgggcgaaatggcggtctccgatgagatccttaaacgttctgccgatgcctatcgccgcatccgtaacaccgcgcgtttcctgctggctaacctcagcggctttaacccggcgaccgatctggtgaaaccggaagagatggtggtggtggatcgctgggccgtcggtcgcgctcaggcggcacaggccgatatcgttgcctcttacgagaactacgatttccacgaagtgatccagcgtctgatgcagttctgttcaattgagatgggcagcttctatctcgacatcatcaaggatcgtcagtacaccgcgaaaggcgatggcctggcgcgtcgcagctgccagaccgcgctgtggcatatcgtcgaagcgctggtgcgctggatggcaccgatcatgtcctttacggcggatgagatctggggctacctgccaggcgaaacgtgcgcagtatgtctttaccgaagagtggtatcaggggctgtttggcctggctgaagatgaagcgctgaatgacgcctactgggctgagctgctgaaagtgcgtggcgaagtgaacaaggtgatcgagcaggcgcgtgcggataaacgtatcggtggcgcactggaagcaacggtcacgctctatgccgatccggagctggcggctaaactgcaggcgctgggtaatgagctgcgctttgtgctgctgacctctggcgcacaggtggctgattacgccctggcgaacgacgaagcgcagcagagtgagctgctgaaaggtctgaaaatcgcgctgcacaaggcggaaggcgagaaatgtcagcgctgctggcattacactaccgacgtcggacagaatcctgagcatgctgaggtctgtggtcgttgttacactaacgtagccggtgacggcgaacagcgtgaatttgcctgatgcgtaaacctattttatcaaccggattgcgctggctgtggctggtgctggtggtgattgttgtcgacttcgccagtaagcagtgggtgatgaacaacatgatgctgcatgaaacccagccactgatgccctacctgaacctgttctacgcgcacaactacggcgcggcgttcagtttcctggcggacaaaggcggctggcagcgctggttctttgccggtattgcgctggctatcgtgatctcactggtcgtgatgatgtatcgtaatcatgccagtcagaagatcgctaacatcgcgtatgccctgatcatcggcggcgcgataggcaatctgtttgatcgctcataccatggctttgtggtcgattttatcgatttctatgtcggtaactggcacttcgctacatttaatatcgctgactgcggcatctgtatcggtgctgcattggtggtgctggagggctttttcagcccgaacggcaaacaggctaaacagaaagggtaagtgatgactgagtccgtacagcgcgaaagcgcggtgttggtgcattttacgctgaagctggaagatggctcgacggcggaatcgacccgtgcaaacggcaagcccgcgctgttccgtctcggtgatggcagcctctctgcggcacttgagcaggcactgctggggctgaaagcgggtgaaactaaacagtttaccctggaaccggacgacgcctttggcggcgtcagccctgacctgatccagtatttctcgcgtcgggactttatcgatgcgggtgagccggaagtgggagccatcatgctgttcagcggcatgggcggcagtgaaatgcctggcgtgatccgtgaaatctctggtgactctatcactgtggatttcaaccatccgctggcaggtcgtcgtattcagtttgatgtagaggtgctggaaatcgatcccgcactggaggccaacgatgcaaatcctgttagctaatccgcgcggcttctgcgctggcgttgatcgtgccatcagtattgttgagcgcgcgctggagatgtatggcgcgccaatctatgtccgtcacgaagtggtgcataaccgttacgtggtaaacagcctgcgtgagcgcggtgccatcttcattgaagagatcagtgaagtgccggataacgcgattctgatcttctctgcgcacggtgtttctcaggcggtgcgtgccgaagccaaagcgcgcaatctgactatgctgtttgacgccacctgtccgctggtgaccaaggtgcatatggaagtggctcgcgccagccgtaaaggcgttgaggcaatactgattggtcatgcgggtcatccggaagttgaaggcaccatggggcagtacaacaaccctaatggcggcatgtatctggtggagtcaccggaagatgtcttcagactgacagtgaaagacgaaaacaatctgagcttcatgacgcagaccacgctctctgtggacgacacctctgacatcattgatgctctgcgccagcgcttcccggcgattatcgggccgcgtaaagatgatatctgctacgccaccaccaaccgtcaggaagcggtttcgtactctggctaaagatgcggaagtggtgctggtggtggggtcgaagaactcctctaactctaaccgtctggctgagctggctcagcgtgccggtaagctggcgaagctgatcgactctgcggatgatattcaggaagagtgggtaaaaggcgtggcctgcatcggcgtcaccgcaggcgcgtcagcgcccgatattctggtgcagcaggtgatccagcggctgcgtgaactgggcggcgaagcggcaattgagctgattggccgtgaagagaatattgtcttcgaagtgcccaaagagctgcgtgtcgaagtgcgtaacgtgcagtaactctgcgatattactaataaaaaggccgactctgttcggccttttttgttttttgaatctgacaaaaaaagtcgttatttgctgcggtgattgcttttactgataatcacgggcggctggcataaaattcttattatcacggattaatagtggcgtgactgttaactcatcgttaacctgatgacgctttggatgcatagttttgttttaggaatgaataaatatgaacacaatccgcattgctattgtgggcgcgccgggccgtatgggccgtaatctgattcaggcgacgcagcaggcagaaggcgcagaactgggtgcggcactggctcgcccgggctcatcgctgaccggcagcgacgctggtgaattagcgggcatcggaaaaaatggcatcatcatcgctgacgatttacgcgcggtgattaacgattttgatgtgctggtcgacttcacccgcccggaaggcacgctggagtatatggcgatctgccgtaagcagggcaaagcgatggtgatcggcactaccggttttgatgaagcaggcaaagcggccattcgtgccgcggcagaagatatccccattgtgttcgccgctaacttcagcgtgggggttaacctggtgctgaagctgctggagaaggctgccaaagtgatgggggagtacgcagatattgagatcgttgaagcgcaccaccgccataaagtggatgcgccctccggaaccgcgctggcgatgggtgaggcgattgccgatgcgatgcagtggaaactggatgagcatgcggtctatacgcgtgagggccacaccggcgaaacgccagccgcagagcatcggttttgcaacagtacgcgcgggtgacatcgtcggtgagcatactgcgatgtttgcagatatcggcgagcgcgtagagataacccacaaggcttcaagccgtatgacctttgcaaatggcgcggttaagtccgctttatggttgaaagataagaaatctggcctgtttgacatgcgtgatgtgctggatttgtcgatgttgtaagtgttgtgaaccatcgtgatgtggttgtttcaatcgataatcgcttgattgaaaaggggcaatgttttcattgcccttaattttatctgaaatatgccttccagatataaatttacctctgacttctgttttttcctgttttcttcatttatttgctctgccggatgctatttttgaccatttggtcaaaaataaaggccgcgctgcatctattttgcttttatgctgcctggcaaacgattattccgccgagttttcctctctttttgctgcttatgcccgttattttcctcagaaggcagataagggtgaaaaaatcccgccgcagggtagacaatggccagggcgatcattagaatgcgcgcaatttgccaaaaatcgacaattcaggcggtttttgcattgattcaggcggctattttgaattaatatgcagatattgtgactgtttattccctggaggatgttttgattaagtcagcgctcttggttctggaagacggaacccaattccacggtcgggccatcggggcaacagggtcggcagtgggagaagtcgttttcaatacctcaatgaccggttatcaagaaatcctcactgatccttcctattcccgccaaatcgttactctcacttatccccatatcggtaatgtcggaaccaatgccgccgacgaagaatccagccagattcatgcgcagggcctggttatccgtgacctgccgctgattgccagcaacttccgtagtgaagagggcttatccgcctacctgcagcgcaacaacatcgtggcgattgccgatatcgatacccgcaagctgacgcgcttgctgcgtgagaaaggtgcacaaaacggctgcatcattgcgggcgataatccggatgccgcgctggcgctgcaaaaagctcaggcgttcccgggactgaaagggatggatttggcgaaagaggtctgcaccactgagacctacagctggcagcagggcagctggacgctggagggagggctgccagagcaggccgacgctgaatcactgccttaccatgtggtggcttacgattacggtgccaagcgcaacattctgcggatgctggtcgatcgcggctgtcgtctgaccgtcgtttccggcacagacgcctgccgaagaagtactgaagcttaatccggatggcatcttcctctctaacggtcctggcgacccggagccgtgcgactacgccatcagcgcgattcaggccttcctgaaaacagagatcccggtgttcgggatctgtctgggtcatcagctgctggcgctggccagcggggctaagaccgtgaagatgaagctgggccaccacggcggcaaccatccggtgaaagatctcgataacaatcgcgtgatgatcaccgcgcagaaccacggttttgcggtcgatgagaacaatcttcccgctaacctgcgtgttacacacatttcgttgttcgataaaaccgtgcagggcattcaccgcaccgacaagcccgcattcagcttccagggacacccggaagccagcccgggcccaggcgatgctgcgccgctgttcgaccactttattgaattgattgacgcattccgtctgcaagcgaagtaatcaggagctaattcatgccaaaacgtacagacctaaaatccatcctgattcttggtgccggtccgattgtgatcggccaggcctgcgaatttgactattccggtgcgcaggcgtgtaaagcgctgcgtgaagagggttaccgcgtcattctggtgaactccaacccggcgacgatcatgaccgacccggaaatggctgatgcgacttacattgagccgattcactgggaagtggtgcgcaaaatcatcgaaaaagagcgcccggacgcggtactgccgaccatgggcggtcagacagcgctgaactgtgcgctggagctggaacgtcatggcgtgctggaagagtttggcgtcaccatgatcggcgcaacggctgatgcgatcgacaaagcagaagatcgtcgtcgtttcgacgtggcgatgaaaagcatcggtctggataccgcgcgctccggcattgcgcacaccatggaagaagcgctggccgtggctgaagatgtcggtttcccctgcattatccgtccctcatttactatgggcggaaccggtggcggcatcgcctacaaccgcgaagagtttgaagagatttgcgaacgcggtctggacctctcaccgaccaatgagctgctgattgatgagtcgctgattggctggaaagagtatgagatggaagtggtgcgcgataaaaacgacaactgcatcatcgtctgctcaattgaaaacttcgatgcgatggggatccacaccggtgactccatcacggtggcacctgcccagacgctgaccgacaaagagtatcagatcatgcgtaacgcctcgctggcggtactgcgtgagatcggtgttgaaaccggtggctccaacgtgcagttctcggttaacccgaaagatggccgactgattgtcattgagatgaacccgcgcgtgtcacgctcctcggcgctggcctccaaagcgaccggtttcccgattgctaaagtggcggccaaactggcggtcggctataccctcgacgagctgatgaatgatatcaccggcggtttaacgccagcctcgtttcgagccttccatcgactacgttgtcaccaagatcccgcgtttcaacttcgaaaaatttgccggtgcaaacgatcgcctgaccacgcagatgaagtcggtcggggaagtgatggcaattggtcgtactttccaggaatccatgcagaaagcgctgcgcggcctggaagtaggcgctaacggcttcgacccgaaagtccacctcgacgacccggaagcattaacccgcatccgccgtgagctgaaagatgccggttcagaccgcatctggtacatcgcggacgctttccgtgccggcatgtcagtggatggcgtgttcaacctgaccaatattgaccgctggttcctggtgcagatcgaagagctggtgcggctggaagagcaggttgcccgtgaaggggttaatagcctggatgagacattcctgcgcgccctgaagcgtaaaggctttgctgatgcacggctggcaacactggcgggtgtggcagagagcgaaatccgcaagctgcgtcagcagtttaacctgcacccggtttacaagcgcgtggatacctgcgccgcagagttcgcgacagacaccgcctacatgtactccacctatgaggaggagtgcgaagccaatccaagtccggatcgcgaaaaaatcatgattctgggcggtgggccaaaccgtatcggtcagggtatcgaattcgactattgctgcgttcacgccgccctggcgctgcgtgaagatggttaccagaccattatggtcaactgtaacccggaaacagtctcgaccgattacgacacctctgatcgcctctacttcgagccggtcacgctggaagatgtgctggagattgtgcgcattgagcagccaaaaggtgtgattgtgcagtatggcggtcagactccgctgaaactggcgcgtgcactggaagccgcaggcgtaccggtcatcggcaccagcccggattccatcgaccgtgctgaagaccgtgaacgtttccagcaggcggttgatcgcctgaacctgaagcaacccgccaacgccacggtggccacactggagcaggcggttgagaaagccgcgggcctgggttatccgctggtggtgcgtccttcttatgttctgggtggccgtgccatggagatcgtctacgacgagatcgacctcaagcgctacttccagacggcggtctcggtttccaacgatgcaccggtgctgctggatcgcttcctggatgatgcggtcgaagtggatgttgatgcgatttgcgacggtgagcgggtgctgattggcggcatcatggaacacatcgagcaggctggcgttcactccggtgactccgcctgttcactgccggcctacaccctgagtcaggagattcagaatgtgatgcgccagcaggttgagaagctggcgtttgagctgaatgttcgtggcctgatgaacgtccagttcgcggtgaaagacaacgaagtctacctgatcgaagttaaccctcgtgcggcgcgtaccgtgccgtttcgtctctaaagcgaccggtgtcccgctggcgaaagttgccgcgcgcgtgatggcaggcaaaacgctggcagagcagggcgtcactgaagaggtgattccgccttactactctgtcaaagaagtggtgctgccgtttaacaagttccagggcgttgacccgattctggggccagaaatgcgctctaccggtgaagtcatgggcgtgggccgcaccttcgctgaggcgttttccaaagcgatgctgggcgcacagagcaacatgaagaagtcgggccgtgcgctgctgtcggtgcgtgaaggcgacaagaaacgtattgtcgacctggccgctaagctgcagaagtttggtttcgaactggatgcgactcacggcacggcggttgtgctgggcgaagcgggcatcaacccgcgcctggtgaacaaggtgcatgaagggcgtccgcacattcaggaccgtctgaagaacggcgagtatagctacatcgtcaataccacggcgggtcgtcaggcgattgaagattcgaaactgattcgccgcagtgccctgcagtataaagtgcactacgacaccacgctgaacggcggcttcgccaccgcgatggcgctgaatgcagacccgacggaacaggttatctccgttcaggagatgcatgcccagatcaaggcgatgtaaggcgatgtaatgtgaaaaacggctcctgcgggagccgttttttttggccaaaatctggcccggtcagctgtgagatcgagcctgcgaagggaacacggtcagatcggaaagtcgcttaagccaatccctggccgctcggcccgcgccgtccatggcgcgggacgctttcctcttctgcccgtgttccctgcgcgttgagcctatgcattgtggaaaaaaaacctgaattgaatttgtcagctgtctgaacgactcctgcgggagccgtttttttttgaccattttattggcgataatccgaaaacagggtccagaaaaagcaaagagtttgcgttaaagtcactgatttggcttaattttttagctataggtgcgaataaggtcggttcgcacaaatttataatataaacacttcctgtgcggatttttcgtcagtactatgcctgccgctcatcactggagcgtatcaggacataaataaaaaatgaaaatgcgtactttttctctgagtgcagtggctgcactgatggcaattcttcctttcgccagccaggcggaaattaccctgttaaaacaggatccgcaggcaggcgatccgcttagccgtcttaactttacttttggcggcagcattcgtgctcagttcaatcatcagaccggcgtggatgacaaatcctacaagcgcgacggttttgacggcggcacccgtttccgtttcggcgctgactactacctgtttgatgacgtcagctggatcagctactacgagctgggcgttaacgtcccggcggtcttcagctgggatcgtcactatgcggacggtgccaataacaccacgcgtcgtcagctctacaccggtctgaaaagcaaaacctggggccagcttaccttcggtcagcagaacagcgtctattacgataccgtgggcgccaagaccgatatctgggattacgacatggtcggccaggctccgggtaacgggatcaacggcgactacgacggatcttaccgctcacgcaaacagctgaagtataaaaacagcttcggcgatgcggatctttacgcctcttatctgttcgaagataacgagtatctgccaggcaacggcctgcgctataagcgcaaaggcggcggctcgctgggtgtggactaccacatcacggacgatctgagctggggcacggcgtggaaactacacccgcgcggcgatgcgtaacccgaacaacggcgacagccgcgattacgatcagaacatctacggcaccgcgctgagctggactccaggtaactggacgttgtcagccggcggtggctggtatgagaacttcatgaccaccaaacgcaaagatgtgcatgactactttgccggcgacgcgtggggcattgaatatttcgccggttacaagattccggtggggcagtatggtctgaaagcggtacagccgtatgtcatgggcgatcgcattgagtatgcgacaggccgtaattatcagcgcatcgacaacggtctgggtgtggtgctgttcctcgactacggtttccgtgtcgattacgaacatgtgtttacctccagcaccgataacctgggtgatatgaatctggtgcgtctgcgctacgacttctgataaccctgacggctcctccgggagccgttttcttttgcgcacgacttttgtgccagcctgaggccgatcgctggcgagctgcggcaaactgacgcgattaggcggtgaaaaacgctgcacaggccgtgaaaaacgacgtcatgaaaagctttacgcaattagacctttccccctatcgacgaaagtttcacctttacgtatcatggcgccaatttttttcagtgagtagttaacatgattagtcttatcgcggcattagcagcagatcgcattattggaatggagaacgccatgccgtgggacctgcctgcagatctggcgtggttcaagcgccatacgctgaagaaaccggtaattatgggccgactgacctttgaatctattggccgtccgttacctggccgactgaatatcgtggtcagcagccagccgggcaccaccgaaggcgttacctgggtcacttcgctggatgaggcgttacaggcagccggtgacgctgaagagatcatggtgattggcggtggccgcgtctatgagcagatgctgaagcgtgccgatcgtctctatctgacgcacattgatgcggaagtcgaaggtgatacgcagtttcccggattatgagccggatgagtggcagtcaacgttcagcgaattccacgacgctgacgagcaaaattcccacagctactgctttgagatccttgaccgtcgtcgctaatcccacccctgccgggctgtaacctggctgtcatctttattcattagcattgcttcttttctgggatcgacacaaaggaagcaatcactaatgaaaatcgaactctccgcattaagcactgaccgcctgcctgatccactgcgtcgtaaattccttgccggttccggtgctatcggcctgaccggctttctcagcggcggcctgacgctctcgggcagcgcactggcgcaggagaagcctgcgggcagtccgctgctgggctttcaggcgattgccgcgtccacggccgatgagattgtggtggcccccggctatcgcgccgacgtgttgatctcctggggtgatccactggtgaatggcgcagccgcgtttgatccgcagggcaacaacagcgccgaagatcaggaaaagcagttcggtgacaacaacgacggtatgagcttcttcgcgattaatgaccatcgcggcgtgatggcgattaacaatgaatatgtgaatgagccgacgctgttcgcccacggcggcagtaaagcgaccagcctggaagatgtcaaaaagtcgcaggcggcgcacggtatctccatcgttgaagtcaaacggggtgaggacaatcgctggcaggtggtacgtccttctgactataaccgccgcattaccgccaataccccgatgcgcttctccggtccggctgcgggggataaagcgctgcagactgccgccgatccgcagggaatgaatgtcctgggcacctttggtaactgcgccaacggcaaaacgccgtggggcacctatctcacctgtgaagagaactacgacacctactttggcacccatcaggcggactttacgccgacgccacagcagaagcgctataccctgaatgccgctgagccggagcgcaactgggccgactttgatccccgcttcgatatcgctaagaatcccaacgaattcaaccgtcacggctggattgtcgaaatcgatcctttcgatcctcactccgtgccggtaaagcggaccgcgctgggccgcttcaagcacgagaatgccgctgtgacggtcgcgaaaaccggccagctggtggtttatatgggcgacgacgagcgcggcgagtatatctataaatttgtctcagatgacaaggtcactccggatgatgctaaagccaatcacggactgcttgataagggcacgctctatgtggcgcagttcaacggcgatgcgcagggcacaccgcttaaaggcaccgggcgctggctggcgctgaagtggggcgaaaatggactcactgctgaaaagggattcaatagccaggcagatgttttgatcaatgcgcgtgccgcagcagatgtggtcaacgcaacgcgaatggaccggccggagtggattgcggttaacccgcatgacggccgtgcctactgcactctgaccaacaacaacaagcgcggaaatgaaggcatgccggtcaatgcagcgaatccgcggccaaaaaatatctacggtcagattattcgctgggatgagaaaggcgatgctaccgcgcagacgtttgagtgggatatctatgcgctgtgtggcaacccgatagcgcatcctgaggggatctatcgtggcacaccgaacatcaccgcggagaatacctttaacagtccggatgggctggggtttgatgcgcaggggcggttatggatcctgaccgacggcaaatacagcaacaaagaggattatcaggggcaggggaataatcagatgctggtgggtgatcctgatagtggcgagatccgccggtttatggtcggtccaaaatcgtgcgagctgaccggtattaccttcacgcccgattacaaaacgctgttcgtgaatgtgcagcatcccggcgaagagggtgactcgcatttcccagacaacagtccgcgtccgcggtcgtcggtgattatgatcacccgtgaagatggcggcattatcggcgcataaaacaggatgctggcctgatggccagcatcgccgttatagcgcgggcggtgccagactgtcgctggaggccagggctttttcgcgattagagggctgcaccacatagcgttgtgtctcccagtgcagcagggtcagcgttccgccccagcagcagccggtatccagcccgataatgccctctggcgtgcctttgccttccagcgaggcccagtgaccaaagacgatggtgtagtcacgtgcgaccggcccctcaatgttaaaccagggtttcagcggcggaagcgccgattccggggcatctttgcagatcatgtccagctggccgttggggaagcagtagcgcatgcgggtgagggcgttggtgctgaagcgcagacgcgccaggccggtcagatcctcactccagttgttcggcatgtcgccatacatggcatccaggaaacagcggataactgtcgctggcgagaaccgcttcgacttcacgcgcgcactttttcgcggtctcaatatcccattgcggcgtgataccggcgtgtcccatcaccagctttttctcttcatcaacctgtaacagcggctgacgacgcagccagttgatcagctcatccgcatcatccgcttccagcaacggggtcaggcgatctttaggcttgttacggctgatgccggcgtagaccgccagcagatgcaaatcgtgattgcccagcaccagacgcaccgcgtcgcccagcgattttacgtagcgtaatacttccagtgagccaggaccgcgcgccactaagtcgccggtcagccacagggtatcctgctcaggattgaagtcgacctgttgcagcaatgcacgtaattcatcgtagcaaccgtgaacgtcgccaatcaggtatgtgctcataacgttttatccatcaggaaggtgcccgacttaacgggcaaaaagcgtgtgaatcaatgaatgtgggtctgaatggcgaggcggaacaccgggatctctacgtgaaaagtgtcgccctgttcgtcgaccatcacatagtgcccctgcatggtgcccatcggtgtttcgatcacggcaccgctggtatactgaaattcattgcctggcgcgataagcggctgttcaccgaccacgccttcaccctgaacttccgtttcgcggccgttaccgttggtaatcaaccagtagcgtcccagcagttgcactgaggaacggcccagattgcgtatcgtaatggtataggcgaagacgtagcgatcatcatccggtgaggattgtgaggcgacgtactggctttgcacatggacggagacgcgggccgtttcactcatgacttactcctgcgattttccctgatgattcgccagccagtttcgccagctgacaatattgcgccaccgagacgttctcggcacgcagggttggatctatggataactcttccagcgcaccggcggccaccatgtggctcaggctgttgcgcagcgttttacgacgctggccgaacgcttcagtggtaatgcggctcaggatacgcacatcgctgaccggatacggcggctcggcatacggcaccagacgcaccacggcagagtccactttcggtggtggcgtgaaagagtgcggaggcacttccagcaccggaatgatctggcagtagtactgcgccatcaccgtcagacgaccgtaggtcttgttacccggaccggcaaccagacgattaaccacctctttctgcagcatgaagtgcatatctttgatcgaaccagtatagctgaaaaggtggaacatcagcggggtcgaaatattgtacggcaggttaccgaatacccgcagcggctggcctctctcctgcgccagtgcggcgaagtcgaaggtcatggcatcctgctggaagatagtcagtttcgggccaaggaacggatgcgtttccagacgcgcagcgagatcgcggtccagctctatcaccgttaatttatcgaggcgttcgcctactggctcggttaaggcacccaggcctgggccgatctccaccagcgcttcgtcgcgctgaggatggatggcagagacaatgctgtcgataatgtactgatcgttcaggaagttctgcccgaaacgtttacgggcgtagtgcccctgatggacgcgattattcattactgctcttgatcatagtgatggcgaggttaagcgccgtgatgaagctgcccggttcagcctgacccaggccagcgagttcaagcgcggtgccgtggtcaactgaagtccggataaagggcaggcccagggtgatatttaccgcccggccaaacccctgaaatttgagtaccggcaggccctggtcgtgatacatcgccagcaccgcatcggcgtattgcagatatttgggctggaaaagggtatccgcaggcagcgggccggtcagattaatgccctgctgacgcagttcattgagtgccggcgtgatggtctcgatctcttcccgacccatgtgaccgctttcgccggcatgagggttaagaccacagacgtaaatatgcggctcggcaatcgcaaacttctgctgcagatcacgatgcagaatcgtaatcacttcatgcagacattcacggtttaccgcagcgggcacatctttcagcggcagatgggtggtggccagtgcgactcgtagctcttctgtcgccagcatcatgaccacccgatggccgcctgcgcgatcggcgaagaattcggtatggccggtaaaggcgatgccggcatcgttaatcacgcctttatgcaccgggccggtaatcagggcagcgaattcaccgtcgagacaaccgtcgcaggcgcgcgtcagcgtggccagcacatagtcgctgttggcgacgcaaagctcgccgggtgtgaccggcgctgccgtttcaattggcaggatagtcagtgtacccgcctgctgtggctcggctgccacgccaggctggtagggccgcagggtcagcggcagaccgagttgcgccgcacgctgctgcaacagggcaggcgaggcgcagaccaccagttcaaccggccacgactgctgggccagctgaacggtaagatcaggaccaatcccggcaggtttcgccgggcgtgatcaccacacgggcattactgcgcattgccatccagaatcttcacgtaggcactggcacgttgttcctgcatccaggtctgcgcttcttccgcgaacttacggttaaacagcatacggtaagcacgctctttctgggccgcatcggttttatccacctgacgggtatccagcaactgaatcagatgccagccgaaagaggagtgaaccggctggctggtctggcctttctgcaggcgcagcagcgcgtcacggaacgccgggtcaaagacttccggagaggtccagccgaggtcgccgccctggttcgccgaacccggatcgtcagaatactgtttagccgccgccgcaaaggtggttttgccactgcggatatcgttagcaatctgctccagctgtgcgcgtgcctgatcgtctgtcaggatcggcgatggcttcagcagaatgtgacgcgaatggacttcggtgaccgagacatttttgctctcgccacgcaggtcgttcactttcaggatgtggaagcccacaccagagcgcaccggcccgacgatatcgccttttttggcgctcgagagtgcctgagcaaacagggtcggtaactcttcgattttaccccagcccatgttgccgcctttcagcgcctgggagtcggcagagtaggtcacggccatcttgccgaagtcagcgccatttttcagttcgccaaccagctgtttcgccagcgtttcctgctcatcaacctgctgttgcgtcgggttttccggcagcggcagcagaatatgactgacgttcagttcggtaccctggctgttctgagagccgatctgcgtagcaagcgtatccacttcctgcggcagaatcgtgacacgacgacgcacttcgttgttgcgcacttcggcgatagtcatctctttgcggatctgagaacgatacacgctgtagttcatgccgtcataagccagacggctacgcagctgatcaaggctcatcttgttctgcgcagcgatgttctgaatagcctggtccagctgctcgtcgctgatctgaattcccgctttatcacccatctgcagaatgatgttgtccatgatctgacgttccagaatctgatggcgcaacgttttatcatccggcaactgctgaccagcctgctgggcctgagatttaacggtgctcatcatgccatccacgtcactctcaagaaccacgccgttattgaccacggctgcaactttatcaacgacttgtggtgctgcgaacgcggtgttggcactgattgccacaccaagaatcagcattctccagttcttcatactttatccattgttggttccgcactgcgggattgcctgtcaaacatcacaacatcagaaagcaggctggtaagggataatgccctgacgcagcatatcgttggtgcctaagccatagtttcggactcagaccacgcagctcaatgttgaatgagatttggttgtcatacttactgtcgttgttttcccaaccgttaattttgcgttcataaccgacccggatagcgtaacagcatgagctgtattgcaggccaaccagttgtgaagccggacgcgtgttgcgggtatcgtagtagtaagcgcctaccacagaccatgcgtcggcaatcggccagctggccgtagtacctacctgtgaaatcccatttttgtagataggattcgtgaccaggctgctatcgttcagcgcggtcgcaacatactccgggctgctgtaacggtagctcagctgcaccatgcggtcggcatcacgacggtattccagtacggtattgccctgggagacgttgtcgagtttggtgtcatattgcagcccaccacggacgccccagcgatcgctgattttccagtatgtatcgccagcccagatcaggctgccggtatcatcttctttactggtttgattcacaccagtacgagaaggggtaaacgagtagatttgacctacagaaacgttaaaacgttcaaccagatcgttatcataaatacgcgaggtgacgccggtagccacttcattggcggaagcgatgcgatccaggccgctataagtacgatcgcggaacagaccggtgtagtcggtttgcagcagcgttgagtcgtacggatagatattgctctgattacgatacgggatataaaggtactgcacgcgcggttccagcgtctgggtgtaacccaccgccgagttcatatcgcggtcaaacaccagacggccatcaactttaaattgcggcagggtgcggttgacagactcatccagatcgccacttttgccgttattgttcgcaaagttattgttgtaataatcaacgttagtttgctggtaatgggtcgccaggaacttcgcttcggtatccaggctggcccagccgtttgacagcggcaggttcagcgttggctcaacatgtaaacgggtcgcttcgggatagcggctgctgacattggtgaacttcaccgcctgggcataaacccggccatcaaacgggccgatatcgttctgatagagattgacgtccagctgcggcatggcgcggtagacgttattgctggtggtatcgccgaacacctggaaatctttggtggagagcgtggcgtcccagttggtgtccgcatagccgatgctgaatttctgcgtggcgtagttgtcggtcgagctgtagtacttcgagtcgagatcgttgaagtagtacttatcactgaccttggtgtagtccgcgctgaaacgccagttctggtcatagacaccggcatgacgccagtagaacagccagcgatcggagctgtcattttcggcaatgccgcgcaccgctttgtcgttatcgtactgtttgtccgagccgaggtagtcgaattcaaccagacctgcacccagcgtggtcagataacggaattcgttctggaactgcatgccgcgcttactcatgtagtgcggcgtgatggtcgcatcggcctgcggcgcgatgttccagtaatagggcagcatgaactcaaagccgttgttgctgccatattttgcattcgggatcaggaaaccggagcggcgacgatcgccaatcggtaattgcagataggggctgtagaacaccggaacagatccgattttgaagcgggcattccagatctccgccacttcctcttcgcgatcctggattacctctgaacccaccacgctccagctgttggagccgggcagacaggaggtaaaggtgccgttttccagaatggtgtagcggttatcgccgcgcagcttcatctgatctgcgacgccgcgtccctgacgatctaccatctggtactgaccattccagacgttggtatctttgctgttgaggtttgaccaggctttcggacctttcaggatgacctgattgtcatcgtagtgcacattacccagcgcatcgacggtacgtacgggcgcggtctggcctttctgctgacgctgatgaagctggacttcatccgcctgcatacggctgttgccctgctcaatattcacattaccggtgaataccgcatcgttgggatagttccctttggcggcgtcggagtgaatggtgacgggcatctgattcgtatcgccattcaccagcgggcggttataactcggcacgcctaacatacactgcgacatcaaatcgtcggcaaaggcttgctggctaatggctgcgccgatcagtgtggccagcagggtaggtatatgttttttcatacgcggtatcgagaattccatgaaaactggcatcatgccgacaatcgggtcagagactaacttactgcccggcgttgcgccagtgttaatcctggtcagtcagcgttgccgttaggcgctgagataaatgacaggtatgataatgcaattttcagccgcaagcatggcgaattgaggagtttatgcgctactggggaaaagttgtgggtctggcggtgggattactttccggcgcaggcttttggggtattgtgatcggtttgatcattggccatatgattgacaaagtacgcggcgcgcaaggcaaggcttacttctcaaataatcagacccgacagacgctgtttttcagcaccacctttcaggtgatgggccatctgaccaagtcaaaagggcgcgtcacggaagcggatattcagattgcttcgctgttaatggagcggatgcagctgcacggtgactctcgcacggctgcccagcgcgcgtttccgcgaaggcaagcaggcggattatccgttacgcagcaaactgcgtgaactgcgcagcgcctgttttggccggtttgatctgattcggatgttcctggagatccagattcaggccgcctttgccgacggttcactgcatcccaatgagcgacaggtgctctatgtgattgccgaagagctgggcatttcacgcggtcagttcgatcagttcctgcgcatgatggaaggtggccagcagtttggcggtggtcagcgcagttcaggcggttttcagcaggcgcaacgcgggccaacgctggaagatgcctgtagcgtgctgggtgtgaagagtagcgatgacgccaccaccatcaaacgcgcctaccgcaaactcatgagcgaacatcatcctgacaagctggtagcgaaagggttaccgccagagatgatggagatggcgaagcagaaagcgcaggaaattcaggcggcgtacgatctgattcgcaaagagaaaggctttaagtaaacaccatgttccgtggccgcttctgcaacagaggaggccacggtgacaggcgagcagtaaaccttaaaaatcggcgggctgacgaaacgtcatggcgttaccaaatgccggatgggtaatggtcagtgactccgcatgcagcagtaaacggggcgccatcgctttggcctccggatgcgcatagaagttatcccccagaatcggatggcccagcgccagcatatgcacccgcagctggtgtgagcggccggtaatcggtttcagcgaaacacgcgcactgttatccgcacgatattccagcacctgatattccgtctgcgcggctttgccggtctcgaagcagaccatctgcttcggacgatttggccagtcgcaaatcagcggcaggtcaaccaatccctcttccttcgccggatgaccccagatgcaggccacgtaagtcttggaaggctcccgctcacggaactgtcgtttcagctcgcgctcagcagccttagtcagcgccacgaccatcacgccgctggtcgccatatccagtcggtggacagattcagcctgcgggaaatcacgctgaacccgcgtcatcacgctatctttatgttcgtccagccgaccgggtaccgagagcagaccgctgggtttgttcaccaccatgatgtgcgcatcctgataaaggatgtgcagccagggttcacgcggtggattgtaaggttccatggggctttccaaaaataaggggccatgcggcccctgagcttactggtgtgtcaccacaatcaggcgcagtgcgtcgagacgccagttggcctgatcgagactttccagcacctgttcacggttgctttccagcgcctcgacttcatcgtcacggatgttcggattcaccgctttcagcgcgttgagacgggagagtttctgcgcccagcttctcgttcgcttcggcacgcgctgcatcaatcaccgcacgcgcttcgctgaccacactctcttcgccctgggtcagaatcgcatgcacatcctgctgcaccgcattcaccagtttactggcggtatgacggttaaccgcattcagctgacggttaaagctttcgaactccactttgtccgccaggttagtgcctttagtatccatcagcagacggattggcgttggcggcaggaagcgggtcagttgcagatgcttcggtgcctgcgcttcaaccacatagatcagctcgaccagcagcgtccccaccggcagcgccttgttcttcagcagtgacagtgcgctgctgccggtatcgcccgacagaatcagatccagaccgttgcggatcagcggatgttcccaggtaatgaactgggtatcttcgcgtgacagcgcctgatcgcggttgaaggtaatggtgcagccatcttccggcaggccagggaaatcgggcaccagcatgtggtcggaaggggtcagcacgatcaggttatcgctgcgatcttcctgattgataccaacgatatcaaacaggttgagcgcgaagttcaccagaccggtgtcgttatcctgctcgctgatggcattggccagtagctgagccgattcgccgccgttggagttcagctccagcaggcgatcgcgaccctgttccagctgcagtttcagcgcgtcatgctgtttacggcagtcggtgataaacgcatcaaaaccttcgctgttttccggcgcggccagatagccgatcagttgcgaatggacgctgtcatagattgtccggccggtcgggcaggtatgttcaaacgcgtccagcccttcgtgataccagcgcagcagtaccgcctgtgcggtctgctccagccacggcaccagaatctgaatgtcgtgcgcctggccaatacgatccagacgaccgatacgctgctccagcaggtccgggttaaacggcaggtcgaacatcaccagacggctggcaaactggaagttacggccttcagaaccgatctcggagcacaacagcacctgcgcgccattctcttctgaggcgaaccaggcggcagcacggtcacgttcaatgatcgacagaccttcgtggaacaccgctgcgcggataccttcgcgttcacgcagtacctgctccagctgcagcgcggtggccgctttggcgcagatcaccagcactttctctttgcggttggtggtgagatagcccatcagccattccacgcgcggatcgaagttccaccaggtgccgctgtcgccttcaaattcctgataaatctgttccggatagagcaggtcacgcgcccgctcttctgcacttttgcgcgcgcccataatgccggagactttaatcgccgtctgatactgggcaggcagcggcaggcggatctggtgcagttcgcgtttcgggaagcctttaaccccgttacgggtgttacggaacagcacgcggctggtgccgtggcggtccatcagcatggagatcagctcctgacgcgcctccagcttgccgtcacggtcgctgttggcgacctgcagcagtggctcaatatcctgctcgccgaccagatcgttgatccggttcatctcctcctgggagatcgctttatcggccagcagcgcggtgacggcatcggcaatcggacggaaatgctgctgctcttcaacaaaggcggcaaagtcatggaaacgattagggtcgagcaggcgcagacgggcgaagtgactctccatgcccaactgctcaggtgttgcagtcagcaacagaaccccggcggttttctcagccagctgttcgataacctgatattcacggctgggctcgccttctgaccaggccagatggtgcgcttcatcgaccaccagcagatcccattcggcatcggccagcatctcaagacgctgcttgttacggcgcacgaagtccagtgagcagataatcagctgctctgtttcaaacgggttatcgctgtcgtgctgcgcttcggtatagcggtcgtcatcaaacagcgcaaagcgcaggttaaagcggcgcagcatctcgaccagccactgatgctgtaaagtttcaggtaccacgatcagcacccggtcggcacggccagccagcagctgttgctgaatgatcatcccggcttcaatggttttacccaggccaacttcatcggccagcaggacgcgcggcgcatggcgacggccgacatcgtgggcgatatgcagctggtgagggatcaggttggtgcgcatgccgcgtaagccgctgattggcaggcgatattgctcactctggtatttacgggcgcggaagcgcagggcaaaacgatccatccggtcgagctggccggcaaacaggcgatcctgcggcttactgaacaccagcttgctgtcgagcatgacttcgcgcagcatcacttcgctctcttcggtatccagacgggtaccgatataggtcatcaggtcattttcgttgcgtacttcatcgacgcgcatctgccagccttcgtggctggtgatggtatcacccggattaaagatgacgcgggtaaccggcgaatcgttgcgggcgtagaggcggttttcccccgtggccggaaacagcagggtgatcatgcgggtatcgatcgccaccacggtgcccagtcccagttcactttccgtatcactaatccagcgctgacctaatgtaaaaaccatatattttttgctcgaattttaacgtttttagaggtgttcccaaagctcaggcaatagcgttaccgccagacaacaaggcctggagcgtacttaagagcggtgagtttcaggaagggcgctatggtactggatggcaggacgttcgtcacctgtcaaaaaagccccagctgtccggtaataagtgtagcaaagtccccttcgacaaaaggcagaatcccctctgcgaccggctgaagttgcttcgtcacgtagtggtcatagtccagcggcgtgctgcgcgcctccagtggctcggggcctgcggtggcgatgacataacggatccggccaccattctggtactgcaagggccggtttaatttacgattgtgctcatcggccagcctggcggcgcgcacgtgcgggggcacgtttcgttcatattctttcagcggacgccgcagccgctttttgtagatcagctgatcgtcgagttcacccgccagcaactgcgccacggttgtacggatataatcctgccacggctgacggtggaagatacggtggtagagctgctgctggaacgcttttgccagcggcgtccagtctgttcgcaccgactccagccccttaaagaccatgcgctcaccggcggcgtcacgaatcagtccggcgtagcgtttcttgctgccctgttccgcgccgcgaatggtgggcatcagaaaacggcagaagtggttttcatactccagttccagtgtgctggtcagcccctgcgtctgctgcagatggtcgcgccaccaggcgttcactttctgcaccagctgctgaccaatcgcggcggcatcttcttcactgtgcgccgacttcagccagacaaaggtggagtcggtgtcgccatagatgacgtcgtagccttccgcctcaatcagcgtgcgggtctgctgcatgatggcgtgaccgcgcagcgtaatagaggaggcgagccgcggatcaaagaagcggcaggcgctggtgccgagcacgccgtaaaaggcgttcatgatgattttcagcgcctgggacagcggctgattattctgctttttcgccgcttcgcgacccagccagatctgttcaactattgcaggcaggcagtgggtatgccgcgaaaaacgcgcttcacggaaaccttcaatcgaatcggcatcatcaggatgggccagcccttccaccagacccaccgggtcaatcaggaaggtgcggataatcgacgggtagaggcttttgtaatccagcaccagcactgagtcatacaggccggggcgcgaatccatcacataaccgccaggactggcttccggggccacatcacccatgttcggggcgacaaacccggcgcgatgcatccgcggaatatagagatgaccaaaggccgctaccgaaccgccgtggcgatccaccgccagtccattgaccgccgcgcgttccagcagaaacggcataatcgccgttttgtgaaaaatgcgcgtcaccagttcgcagtctttcaggttgtagcgcgccagcgccggtttatcgttggcaaaacgccagttgatctcctccatacgctgccagggattatcaatcgctttcccttctcccagcagttgctgcgacacggactcgaggctgaatgagggaaaatcccagaacgctgatttcagcgcgtcaatgccatcgataatcaaccggccactggcctgagcgaaaaatacgccgggtttgaagccatgttcacgccactccagcgcggcctgctggcgtcccaggcgcagcggaatgccgtaacgatcggcatgcttttgcaatacccgcaggtcaaactgcacgacgttccagccaattaagacatccggatcatgctctgcaaaccactggttcagggcttcaagtaactgcggccggctgtcgagatagatcagctcgaaatccagcgtgctggcatcaccgttggccgggccgagcataaagacctggcgctgaccgcatccctccagcccgatgcagtaaagctcgccatgctgtgtggtttcaatgtccagcgagacccatttcagcggcgggcgatagtcgggatggggtttgagccgcgcattgaccacgctgtcaccgcgctgctcgccgtcaaaccagaccggcgcggtaataaaacgctccatcaggtagcgctccggcggacggatatcggcttcatagaccggaataccctcttcgcgcagccgtttttcaatgcgctgtagctggcggttctgctggcagtagaggccgaaaaccgggcgacgccgaaaatctttcagcgccagcgactgaatccgaaactgacgttcatctttcagtaattcgctgacctgcgcctgaaattcctcaggaataaacgcgacggactcctgcaccggcagcaccacgcgctgcgcgcccgcatcggtcgcgagccagaggataatttcggtgccatgcgggctgtcgcgccagtggcgggtgagcagaaaacctgcacggggcatattcagatgttctccagactcagcatttcaggatgagaaaaccgcttcagtataacatggatatttatacagttcccgccacccgcttttgtcaacattgtcctacaattcttgccttgacgctgtgtggctggctcaggacaatccagccttctgcttttacttaggatgattatggaagcctggattcaacaactgattacgcagtccctggagtgggcgctgtttgccgttgcgctggtgacgtttctggagtcgctggcgctggtcgggctgttgctgccaggtacggtgatgatggccagtctgggcgcgctggtcggcagtggcgaacttggcctttatccggcctgggcggcgggctttgcgggctgcctgattggtgactgggtttcctacggcatcggctggaaatttcaggggccgctgcaccgctggaagtatctgcaaaagtataaaggcctgctggataaaaccgagcacgccctgcatcagcacagcatgtttacgattctggtcggacgctttgttggccccacgcgtccgctgatcccgctggcggccggtatgctggagctgccggtgcgtaaattcctgccgccaaacattatcggctgcattctctggccgccgctctatctgctgcccggtattctggcgggtgtggcgatcgatgtgcccaaagccgcgcagggcggcagctttaaatggctgttactcggcgcagcactgctgatctggctgggtgtctggttatgctggcgctggtggcgcagcggcaagagtcgcgactgggcatcggcctggctgccgcctgagcgcctgcgctgggcagggccgctggggctggtgattgccgtcgcggctttcgtcggtattcagttccatccgatgatgcccattttccgtcatctgctgtggcaggttttcttcgcctgaatcgcttaacgacgcgggatgccgagcacgtcggcctcccgcgtgtcgcccgacagtaactgtcgggtctcgccatcccagtaaacccggccatccacaatcaccacgctgcgcggcgcaatctgctgggcatcttccagactgtgcgacaccatcagcagcgtgatgctgcgcgcttcacacaccgaacgcaccagttgcagcatctctccacgcagcgcgggatccagcgcagaaaaaggctcatccagcagcagcaccggacggtcacgcagcagacagcgtgccagcgccacgcgctgtcgctgtccgcctgacagctcgcccggcagccgcgtcagcagatcgcctaatcccacctgatcggccagcgctgcaagctgctggcgctgtccggcgctcagcttcagtccggggtgcaatcccagcgccatgttctgctgcacgctgaggtgcggaaacaggttgttctcctgaaacagcatcgacacgggccgtctggccggcacgctgtgggtgtgctcctggccgtcaatcatcagggtgccctgtttcaccggcaggaaaccggcaatcaggctcagcagggtgcttttaccggccccgctggggccgaggatcgcgatgcgctcgccgcgggtggcgttgagactaaaacgcatcggcagatgctgataaaggtacgtgaggttattcagtgtcagcatggcggcctggtaatttttccatcagggtgaacagcaacaaacagagcagcagcagcagcagcgcggtcactgcaccgtcagcaccgcgataggcaccgatctgttgataaaggtagaacggcagggtgcggaaatcggcagtaccaaacagcgccaccacgccaaaatcaccgatcgacagcacgcaggcaaaggccagcgcctgggccagcggacgtttcagcgcccgcagttcaatcagccgcagccggttccagccatgaatatccagcgaatcacagagtctgccgtaacgctccgcgacgtcacgcatcgggtttctccagcactttcagcgcatagggaatggcgatcagcgcattggtgaagatcaccagcccgtccgccgacgccggcagaccaatagtggcgttaaacaacaggaaaaagccggtggcgagcacgatgcctggcatcgccagaatcagcatgccgctggtgtcgataagggttgccgccgccgggcgctgatgcaggcgcagctcgcgactgctccacagcagcatcatggtcagcaccacacagagcagaccggcgccggtggcgatgcgcagtgaggtaaacgtcgcctgccagagtgcaggctgcgccagcgcgccgcgcagtccgccgtgcagaccatcgatgatgaccgccgccagcgggggcagtagcaggatcagcgccagcaggatcagcagcgcatcaaccagctgcgccgcgcgcgaatcctgcggatcgcgccagccgttcagctggctggttccggcgggaatcgctttgctgaagcgctggctgagcagcaccagcgtcacgcagcagccaagctggatcagcgccagcagtgcagcgcgccccggatcgtagtcataactcagcgcctggaaaatcgccagctcgatggtcgtcgcctgcgggccgccgcccagcgagagcacggtggcaaagctggcgaaacagagcatgaagatcagcgcgccggtcggcagcagctgacgccgcagccatggccactccagaagacgaaaatggtgccagccgcgcaggtcgagctgtgccgccagctgacgctgttccgccggaatgctctccagcgcctgcagcatcaggcgggtcgccagcggcaggttaaagaagacgtgcgccagcaaaatgcccgacagaccgtagggagagaagtggtaatcaatccctgccagctggcacagctgcgccagccagccgacacgaccatagacggtgagcagaccaaataccgccaccagcaccggcagtaccagggtcatggcgcacagacgcagcagcagctgacggccagggaaacggcgtcgatagagcgcgcgcgccagcggcaccgctggcagcagcgacaacagcgcggagagcagcgcctgaccaaaagagaaggcgataacgtgatgcaggtaatcatcctgcagcacgctgcgccagtcattctctggcgcggcgctccagagtgcaccgaaggccagcagcgccacgctgattaacagcagcgtggcgagcgaaccggggataagccagcgcggcatcagcggctgacggcgcgttgccactggctgatccagcctgaacgctggctggcaacctcttccggcgagaactgcagggcggtggcgggcacagtgagcgcgctaaaaccggcaggcagcggcgtgtcgattaccgggtacatccagttaccggtcgggatagtgcgctggaagtcgggtgacaccataaacttcatgaattgctgtgccagcgccggctgtttgctgctggctaactgcgcggcaacttcaacctgcagatagtggccctctgcaaacggcgcggcggcatagttctcttttttctcttcgatgatgtggtaagccggtgaggtggtgtagcttagcaccagatcgccttcgcccttgaggaacaggccataggcttcactccagcctttggtcaccgtcacggttttctgcgccagcttttgccacgcctgcggtgcctgatcgccatagactttctgcatccacaacagcaggcctaagccgggggtgctggttcggggatcttcgtagatcacccgccacttctccgggctgtcgaccagctctttcaggctttttggcggattcttcagccgggttttgtcatagacaaacgcgaagtagccataatcaaacggcacgaaggtggtgttgtgccagccgccgggcagttttaatgtcgaggcatcgacctgactttcggcaaacagaccggttttctgcgccgcctgtaccagattgttatccagccccagtaccagatcggctttgctgtttttcccttccatgcgcacgcggttcagcagcgacacgccatcttccagcgtgacgaatttcagctcgcagttgcactgcgcctcgaaggcttttttaaccgccgggccagggccccagtcagcggagaaggagtcgtaggtgtagaccgtgagaaccggcttagccgccagaacgggggcggagagtaacagcagcaccggcagaactttgtttaacactttgcgctccttcaggagaataggggatgagtcgcaaaggatctgagcacagaggcctcccaaatccctacgtcggtattaaccgaatcaggttcgacgggtatctctcagctgcttgctggtggcaggcggcaccccgttgagaacgtcacattctagtcatttcagcgccggggcgaaagcctcacagcgcgggtggcgcgaaccaggcggatttaaaatcaaaccagcccagcgtattcatccgaaacgccgcgcatgctgcgctgaccttcaagcagcagccagtggtgaaacagcggatgaagacccgcttcttcgactaactgtttactccattcggccagcggcagcgttttctcgcgccagcgggccgcatcgctgtgccagtcgatcggcagacagtgatgcagcaacgggatctcataaagctgcgcaaacagagaataattcagcggcagggtaaagttcacgctgccaagccagatatcactttccgcttcgccctgataccagctttcgtagctgatctcgcgggtctccagcgtgacgccatgctctgccagcagcggacgcagcgcgttagcgatgccttcatgctccacgtgctggctgtaccaggtcagcgtcaggtgggttaagccgggcggtttttccactggcgtcaggtcgcgccggtgatgccagcgcggcagcaggccatacgccggaaaccagtagcgctggtagccgacaccggcgtgattgagcagggcgataggattaaacaggtagctgacccagcgccggaccgcctcgttgcgtccctgttctgaacgctggtcgaacagcagatagtagcagccctcttcaaggcggctctcctcctgaatctcatcggctccgtcgccctgcaggcggacaccggcatagaccagctcatcgctgatgtcgggcagtacccagatagagacatcatcaatcagggcgcgaaaaccaaaatagtcatcaaacgcttcgatcttcagctgactctcctgattgcggatcacccggtaaggaccggtgccaaccggctggcgggcaaaatcgtgcagcgtcggccattcgcgcggcaggatcatcgcactgacgctgcccagcagccagggcaacccttcatcgggctggcttaagcggatatccagcgtccagggcgcgggcgagtcgatctgctcgatatgggaaaagagcggatgggggcgctgacgctcaagcgtggccagcacatcctccatctccagctctctgccgtgatgaaagcgaatcgccggacgcagaaaaaagcgccagtgaagcggggaagtctgctgccagtggtgcgcaatatcgggctcgatttccccgttttcctcatttatccgcgtcaggccgttgaaaatctgtcgcgcaatgtgggtttcggagcgccgcagcggcgaaccgggcagcagattgagcagcggacgatagtagagcacccgcaggatatgcttgccctgacggaaactgcgccccagatgtgcggcgatcatctgccgtacctgatttttatcgcccaccagctggaccagctgatcgatgcgatcctgctccagcaaatcctcggcacgttgctgctgcaaagccagtccggtatagcagaaggtaagctgtgaacgcttgccgcgcccggcttccgcctgccagatcagccagcccgcggcctgcatccggttgagcagattgcgcatatggcggcgcgagcagtgcagcaggtcagccagttcgctaagggtaatctcctgcgtttgcccctgacagctctgccacaggcgaatgaactgctgcttcagacgtgatgaggacataaaagaggaactcccggtgaaaagcgctctgtttttcttgccctattttaagagcaaactttgcgttatgggaagagcgggaggcattcagttctgaatggcgttcgaccctgacttcgctgttcagcggagtgcttttctgagtagggtgcatttacaccgccagcagatgatctctgctggcttttttcatgttgcgcggtatcgtctacccttctttttcccctctgtttgttctgtaagggatttcggtatgaaatcgctgttaacgcggcagcgccgcatcaatccggtttacctcgcttttatggtcgcctcgttcatgctgggcatcgcgggcgcactgcaggcgccgacgctcagcctgtttctgacgcgcgaggtgcaggcgcggcccttctgggtcggactgtttttcaccatcaatgcggtggccggtatcgtggtgagcatgctggtagcaaagcgctctgacagcgtcggcgatcgtcgtcatatcattctcttctgctgcctgatggcgctggtcaatgcgctgctgtttgcttttacccgccactatctgaccttgctgacgctgggcgtgctgctgtcggcgctggccagcgtctcaatgcctcagctgtttgcgctggcgcgggaatatgccgatcagtcggcgcgtgaagcggtgatgttcagttcggtgatgcgtgcgcagctgtcgctggcgtgggtgattgggccgccgctctccttcgcgctggcgctgaactacggctttgtgacgctatttatggtggccgccgcgctgtttctgatctgtatcctgctgatctggttcaccgtgccgtcggtgccacgtttcgcagcccctgatgcaaagcggcgggctgccgctaagtggctggcgcgatcgggatgtgcgtttactgttcctggcctcagtcgcgatgtggacctgcaacactatgtatatcatcgatatgccgctctatatcagcaccacgctgggcctgcccgagaagctggccggtctgctgatggggacggcggcagggctggagatcccggtgatgctgctggccggacattacgcgcggcgtatcggcaagcgccggttaatgctgatcgcggtggcggctggcgtactgttttatctggggctggtgctgttcaattcccgcacgtcgctgatggtgttgcagctgtttaacgcggtgtttgtcgggattattgctggcatagggatgctgtggtttcaggatctgatgccaggacggcctggtgcagcgaccaccatgttcaccaactcgatctcgaccggcatgattctggctggggtgattcagggaacgctgagtgagcgactgggacatgaggcggtttactggctggcattcgggctggctattgtggcgctggtgatgtcggcacgggtgcgcgacgtataaagaagaaaggcgtaatgccagtcagttaagcgacaggtgataacgcagtctggtgccgggcaggggctggcggtcctcgcgccgctgcgcggttccttcacttcattcctctgcctgacggaccgccggggatggcacatcctgtgccgccccgcctttcgcccgcgtcctgcgggctctcctggcagactcattctgttcagcgctgcggattgcctgctcctgcccggcaccggcctgctctgaaacttcagcgtgtattgttaaaaagggcacgagagtcgaggcctgagcgcctctgctgctgaaagggttatccgcagcgctgaggcgtgacggtgggccagaagtccacgccgggaagcgtggacaggtcggggccggccagggagggccgatccccgaacggttcgtcggcacgacgtcaaagccgaaggaaccgcgtgagcggcgcgaggacggcccggcagcagcagaggtgcgctggcccgcactgcggctcgctcgcccggaaaaaaagctgccacgtttgaccgtgacagcctttacaaatctaatcttaactgatcagcattacgacccgatgtcgccctgctttaactcaatcagcgcaggaaggcgggctgattctgctcatactgcgaaatggaggcttcgtgctgcagcgtcagaccgatgctgtccaggccgttaatcatgcagtggcggcggaagctgtcgagctcgaacgaatagactttatcgccagcggtgaccgtctgcgcttccaggtctaccgtaaagctgatgccgggctggtccgcaaccagtctgaacagctcatccacttcctcttcgcttaacttcaccggcagcagctggttgttgaagctgttgccataaaagatatccgcgaagctcggcgcaatcaccacgtgaaaaccaaaatcggtcagcgcccagggcgcatgctcacgtgaagagccgcagccaaagttttcacgcgccagcaggatgctggtgcctttgaactcaggcttgttcagcacaaagccgggcgttggcacggtgcccgcgtcatcttcaaagcgccagtcgtggaacagatgctgtccaaaaccggtgcgggtgaccttttgcaaaaactgcttgggaatgattgcgtccgtatcgacgtttcgcggcatccagcggcgcaacaatgccggtgtgctgagtaaatttattcgccatgacttaagctcctgtcgtcagttcacggatgtcggcaaagtggccggttacggcagccgccgcggccatcgccgggctgaccagatgagtacgtccaccacggccctgacggccttcaaaattacggttgctggttgacgcgcaacgctcgcccggattcaggcggtcattgttcatcgccagacacatagagcagcctggcagacgccattcaaagcccgcttccaggaagattttgtccagaccttccgcttcggcctgcgctttcaccgggcctgaacccggtaccaccatggcgaccacgccaggcgcgactttgcggcctttggcgatggcggcggcggcacgcagatcttcgatgcgtgagttggtgcaggagccgataaacactttatcaatcgccacatcagtcagtttgatgcctggctgcaggttcatgtaggccagggctttttcggctgaggcgcgctcaaccggatcggcgaacgaggccggatttggtatcacctgatcaacggcaataacctgacccggattggtgccccaggtgacctgcggtgcaatctcttcagcatgcagcgttaccaccgcatcatatttcgcgccttcgtcagacttcagggtgcgccagtaatcaacggcctgctcccatttctcaccctgcggcgagaactgacgacctttcagatagttgaaggtggtctcatccggtgccaccaggcccgctttcgcacccatctcaatcgccatgttgcacagggtcatacgaccttccatgctcagcgcctgaatcgccggaccgcagaattcgaccacatagccggttccgcctgcgctgccggttttgccgatgatcgccagcacgatatctttagccgtaatgccggttgacgcctggcccagcacttcaatcttcatggtttttgcccgaccctgtttcagggtctgggtagcaaacacatgttcaacttcagaggtgccgataccaaaggccagcgagccaaacgcaccgtgcgtggcggtgtgcgagtcgccgcacacaatcgtcatgcccggcagcgtcatgccctgctcaggaccgataacgtggacgatgccctggaaacggatgattcaggtcatacagctgtacgccaaactcagcgcagttcttcatcagctcctgcatctgaatacgcgccatctctcccgacgcattgatatctttggtctgcgtagaaacgttgtgatccatggtggcaaaggttttgcccggctgacgaactttacgtccgtgcgcgcgcagaccatcaaaggcctggggcgaggtcacctcatggatcagatggcgatcaatgtagagtaacggcgtttcttctggcgtttcgtggacgacatgtgcatcaaataacttctggtataaggttttcatttttttatttttcctcggcgataaagcgggcaatgatgccgcccatctcatctgtgctgaccgctgggccatcaccggctaaatctttggtgcgatagccctgttccagcgcacggctgatggcgcgttcgatactgtcggcagcctcatcggcattcaggctgtaacgcagcagcagcgacagcgacaggatctgggcgaccgggttggcaatattctgaccggcgatatccggcgccgagccacccgcgggttcgaacaggccaaagcccgcttcattcaggctggcggaaggcagcatccccattgagccggtgatcatggcgcactcatcagagagaatgtcaccgaacaggttggagcagagcagcacgtcaaactgcgacgggtctttgatcaactgcatggtggcgttgtcgatatagatgtggctcagctgcacgtccgggtactctttggccacttcgttgacgatttcacgccacatcaccgaggtctgcagcacgttggctttatcaaccgaggtgactttgttacggcgtttgcgcgccgattcaaacgcgatgcgggcgatgcgctcaatttcgaaacggtgataaacctcggtatcaaatgcacgctcttccgggccgctgccttcacgtcctttcggctgaccaaagtagatgccgccggtcagttcacgcacgcacagaatgtcgaagcctttggcagcaatgtcggcgcgcagcgggcaaaacgcctccagtccgctgtagagtacagccggacgcaggttactgaacagcttaaaatgtttgcgcagcggcagcagcgcaccgcgctccggctgcgatgccggcggtaagtgctcccacttcgggccgccaacggaaccaaacaggatcgcgtcggcctgctcgcagcctgcaaccgttgcgggtggcaggggttcgccatgctgatcgatagcaatgccgccgaccgcatactcctgggtggtgatctgcatatcaaagcgctgacgaatggcatccagcactttcatagcctgcgccatcacttccgggccgataccatcaccgggtaaaactgcgatatgagatgagctggacatggttatacggtttccttctgatctttaaatttgcgctgcaattcttgttcaacctgacgggcacgccagatattgttcagagcgttgaccatcgctttggcggaggactccacaatatcggtcgccagaccaatgccgtggaacttgcggccgttgtagctcacgacgatatcgacctgacccagcgcattctcgccgtggcctttcgcggtcagcttgtagttaaccagctcagcgtcgaactgggtgatacggttaatcgcttggtagaccgcgtcaaccgggccattaccggtggctgcatccgatttagcgacatcgccgcagcccagattgacagaggcggtggcggtgatgctggaaccggtctggacgttaaattcgtgcagctggaaatgttccggctcttcattctgcttgttgatgaaggccagcgcttccaggtcgtaatcgaaaacctgcccttttttatcggccagtttcaggaaggcgtcatacagtgtatccagattgtaatcctgctcggcatagcccatctcttccatacgatgttttaccgccgcgcggccagaacgtgaggtcaggttcagctggattttgtgtaagccgatcgattccggcgtcaggatttcatagttctcgcggttcttcagcacgccatcctgatggatacccgaggagtgagcgaaggcgttagagccgaccactgccttgttcgccgggatcggcatgttgcagatctggctgaccatctggctggtacggtagatttcctgatgattgatattggtatgcacgttcatgatctgctggcgggttttaatagccatgatcacctcttccagcgcacagttaccggcacgttcacccaggccattcatcgttccttcaacctgacgcgcgcccgcctgtacggcagccagggcgttgcccgttgccatacccaggtcatcgtgggtgtgaacagagataattgctttgtcgatgttaggaacgcgattcatcagctcgccgatgatgtgggcatactcgcctggcagggtgtagccaacggtatccgggatgttgatggtggtggcaccggcgttaatcgtggcttctaccatccggcacaggtcatcaatcggggtacggccgccatcttcgcaggagaactcaacgtcgctggtgtaattgcgcgcacgcttcaccatatgcaccgcacgctcaatcacttccggcagcgtgctgcgcagtttggtggcgatgtgcatcggtgaggtagcgataaaggtatgaatacggaaggcttcggcaacgcgcagtgattcgtacgccgcatcaatatctttttccacacagcgtgccagaccgcaaacccgactgtttttaatggtgcgcgcaatggtctgcacagactcaaagtcgcccggtgaggagaccgggaaaccgacttccatcacatccacgcccatgcgctccagcgctaaagcaatctgcaatttttctttcacactcaggctggcctgtaatgcctgctcaccgtcgcgcagagtggtatcgaaaataatgacttgctggctcatcgtaatcatccttatgctttttctggcctggcaacgagcataaaaaaacccgcgacaggcgcgggtttttaactttcagcaggtttgaatcagtgtttgattccgcccacaagtctaccgcgcaagctgagtgcgtttagtagtagaccgagaaggcgaacagaacgaaacatggattcaaaccttataaaatgttgtgctgtacatattggtactggaatcactcagggatgtcaaccttcaatgcaggggtattcttagtggtgccagaggaagatattctgttattcaacggtcaggcagcgtaatgaacagcgccgtagtggctgcggaggcaatcgacccgggaatgagcactgattctgcgggtctttgattttattgtattgaaaattaaagactttatcgggagggtgtctcacgaggatacaggatatatcacctgctctttagcataatcgaatgcgcttcaacgatttaatggttaattacgccagaaaagaaaagtgtcaggcgattgtgggccagggcagccgggtaataagttttcgttatttcttagatcacgctgaaaataatttcttaatcagcattttcctctgcggttctgccgcgtaattagtttaatccgcgcagccaattcttatcgggcagagcctttacgcccctgccttttaatttacgtgggtttgcggtttgcctgcccggttaactgcggttatggtaatcgacctactctcagaaaaataaactcaacagatttctctgtaaccggacagcggcagttgtttccgctgtcatgcataaacataagattttgattggcaaagcaggcaccagggctttgtggtacgcgctaacgggcgtattaacagagccgggtccgcaagcctggaggcagaagatggagatgttgtcaggagccgaaatggtcgtccgttcgttaatcgatcagggcgttaagcaggtattcggttatccgggtggcgcagtgttggatatctatgatgcgctgcaaaccgtcgggggtatcgatcatattctggtgcgtcatgagcagggtgcggtgcacatggctgacggcctggcgcgcgccaccggtgaagtcggcgtggtgctcgtcacctccggacccggcgcaaccaatgcgattaccggtatcgccaccgcctatatggactcgattccgctggtgatcctctcgggtcaggttccctcgtcgctgattggctatgacgcctttcaggagtgcgacatggtcggcatctctcgtccggtagtgaagcacagcttcctggtgaaaagtaccgaagagatcccaaccgtgttgaaaaaggcgttctggctggcttccaccggacgtccggggccggtagtgatcgatctgccgaaagatattctgaatccggccaataaattgccttatcactggccggatacggtgagcatgcgctcctacaatccgactattcagggccataaaggtcagattaagcgtgcgctgaccacattgctggccgcgaagaagccggtgatctacgccggtggtggtgccattaccgcaggctgcgaagccgaactgttaaagctggccgaaagcctgaatattccggtgacgacctcgctgatgggcctgggcgcgttccccggcactcatcgtcagtgcgttggcatgctcggtatgcatggcacgtacgaagccaacatgacgatgcacaataccgacctgatttttggtattggtgtgcgcttcgatgaccgcaccaccaacaacctggcgaagtattgtcccaacgccacggtgatgcatatcgatatcgacccgacctctatttctaagacggtggcagcggatatcccgattgtcggtgatgcgaagcaggtactgcagcagatgctggagttactggcgcaaagcgaaagccagcgcgctgagagcctgcacgactggtggcaggagattgagggctggcgcagtcgtcactgcctggaatttgatcgcaccagcgacaaaatcaagccgcaggcggtgattgaaaccatcagccgtctgaccaaaggcgatgcgtatgtgacgtcggatgtgggccagcaccagatgtttgctgcgctctattatcctttcgacaaaccgcgccgctggatcaactccggcggactgggcaccatgggctttggcctgcctgctgcgctgggcgtgaagatggcgctgccggatgaaacagtcatctgcgtaacgggcgatggcagtatccagatgaacattcaggagctttccaccgcgctgcagtacgatctgccggtgctggtgctgaacctgaacaaccgggtgctgggcatggtgaagcagtggcaggatatgatctactccggtcgtcactcccagtcttatatggagtcactgcctgacttcgtgcgtctggcggaagcctacggccacgtcgggatcgcgattgagcatccggctgagctggaagagaaactggcgctggcgctggaaaccctggcgaagggacgtctggtattcgtagatgtcaccgttgacggtagcgagcatgtttacccgatgcagattcgcggtggcagcatggatgagatgtggttgagcaaaacggagaggacataattatgcgtcgtattttatcagttctgctggagaacgaatccggcgcattatcccgtgtcgtcggcctgtttctcgcagcgcggctataacattgagagcctgaccgtagcgccaacggatgatcctacgctgtcgcggatgaccattcagacggtgggcgatcagaaggtgctggagcagattgaaaagcagctgcacaagctggtagatgtgctgcgcgttaccgagctggggcagggcgcctatgttgagcgcgaaatcatgctggtgaagattcaggcgagcggctacggacgtgaagaggtgaagcgtaacgccgagatcttccgcggtcagatcatcgacgtgacgccgacgctgtacacggttcagctggcaggcaccagtgacaaactggacgcctttctgagtaccgtccgcgatgtggccgaaattgttgaagtggcacgctccggtatcgtcggcgtttcacgcggcgatcgtatcatgcgttaatcacgcagcgtcatcatcaatcctcacctaacccggcgaaatgccgggtttttttattttttatgcgccaggcgagttacattcagaaaagcggttgctccgcgcacttttctgctgttagatgatagccatgagttatccatagcttaactgcggctatttctgccgtaaaagcggatttgatggtggggttatcgtgaaactggatgaaattgcgcgtttggcaggcgtgtcgcgcaccacggccagttatgtgatcaatggcaaagcgcggcagtatcgtgtcagcgacaaaaccgttgagaaagtcatggcggtggtacgtgagcataattatcaccccaatgcggtggctgccgggctgcgcgccgggcgtacgcgctcaattgggttagtgatccccgatctggaaaataccagttatacccgtattgcgaactatcttgagcggcaggcccgtcagcgcggctatcagctgctgatcgcctgttctgaagatcagcccgataacgagatgcgctgcattgagcatctgttacagcggcaggtcgatgcgatcatcgtctctacctcgttaccgccagagcatcccttttatcagcgctggatcaacgatcccctgccgattattgcgttagatcgcgcgctggatcgtgaacatttcaccagcgtagtgggtgccgatcaggacgatgcccatatgctggcggctgaactgcgtcagcttgaggtcaaaaatgtgctgttcctcggtgcattacccgagctgtcggtaagtttcctgcgcgagctgggtttccgcgatgcatggaaagacgatccccggccgattgactatatctactgcaatagcttcgaaacgcacagccgccgcggcactgtttgaacaataccttgaagatcatccgatgcccgaggcgctttttaccacctcatttggtctgctgcagggtgtgatggatgtgacgctgaaacgagacggacggcttccgaccgagctggccatcgccacctttggcgaccacgaattactggactttcttgagtgtccggtgctggcggtgggtcagcgtcatcgcgacgtggcagagcgcgtgctggaattagttttagcctcgctggatgaacccagaaaaccaaaacccgggttaacccgcattcgccgtaatttataccgtcgcggacaattaagccgaaaagttaaatgagccacgggcagtattacgctgcccgcccattttatttaacgatttaactgattaaataaacaggtcgacgtaaaaaagcgtaaattctgctcatcaaatctaacaaagcagaaagggttatttttattatctgcttacaacttcaacaaacttactttcccgtctggccttaagccgctgggcttcctttcggaaatcccctaaaatgccgccgctgtctcagaaaccacgattaatatttagccctttacattgtttcatttttagtcgttttttcccgggtcgttttttttattcaggtattcatcggcttaatttttactttccccttttattcgtttatatcgtcgccagagattaattcttcactctgtaaagagtgatattcacctgccgctccggcttgacaaggatttcatgggatccttaaactcgtttcgtggtaaaaagtgggataaagtggcgtaaatgggtgatgaggagaagagactggcatgttccgcggagcaacgttagtcaatctcgacagcaaagggcggctcgccgtacctacgcgatatcgcgatttgctgattggggagtctcaggggcagatggtctgtaccatcgacctccaccagccatgcctgttgctttataccctgcccgaatgggaaatcattgaaaaaaagctggcacgcctttccagtatgaatccacttgagcgccgcgtgcagcgtttgctgctggggcatgccagtgaatgtcagatggataatgcaggccgcctgctgctggcgaatacgcttcggcagcacgcaaaattaaccaaagaagtgatgctggttggacagttcaataagtttgagctgtgggatgaacagacctggtatcaacaagtcagggacgatattgacgcagaaacagtcggctcaggagcctttatctgagcggttgcaggacttgtcgctatagctatgcaggaaaatttcaaacataccaccgtgctgttggatgaggcggttaacggcctcaatatcagggaagacggtatttacatcgacggcacttttggtcgtggtggccattcacgcctgattctttcgcagctgggagagaagggaaagctgatcgccatcgatcgtgatccgcaagctatcgccgctgccgcagagatcaccgacccgcgtttttcaattattcatggccctttttccgcgctggcagagtatgtctctgaacgggatctggtcggaaagattgacggcattttgttggaccttggggtttcatcaccgcagctggatgacgccgaacgtggcttctcctttatgcgtgacggaccgctggatatgcgaatggacccgtcgcgcgggcactccgccgcagaatggttgctgcacgcagaagaggcggatatcgcgtttgtcctgaagacctacggtgaagagcgattcgccaaacgcatcgcccgggccattgtcgagcgtaatcgtgaacagccgatgacccggacccgggaaactggctgaggtgatctcaattgccatgccggtaaaagataagtttaagcatccggccacgcgcagcttccaggcgattcgtatctggattaacagcgaactggaagagatcgatattgccctgaaaggcgctgttgaagtgctggctccgcagggtcgtctctctgttatcagcttccattcactggaagatcggctggtgaagcgctttatgcgcgatcagagtcgcgggccgcaggtgccgcctgggattcccatgactgaacatcagctgcgtgccctgggtgggcgtgaactgaagttgctcggcaaaatgtcgccgggtgacgctgaagtctctgaaaacccacgtgcgcgcagctcggtattacgtatcgcggagaaaaccgacgcatgatcggtaatgagcgtcacagtctgcctgccgtcatcggcggggatctgctgcgaaaaggcaagattccggtgctgttgctgatcgctgtggtggtttctgccgtgctggtggtgactaccacccataaaacacgactattaaccgcgcagcgcgaacagctggtgctggagcgtgacgcactcgatatcgagtggcgcaacctgatcctggaagagaatgcactgggcgatcacagccgtgttgaacgcatcgccaccgagaagctgcaactgcagcacgttgatccttcacaagaaaatatcgtggtgcagaaataaggacctcagatagcgaatgagcggcacaggcagaacgctgaaattgaagaaaccggaagataaagccagctttgtaagctggcgttttgcgttgctgtgcggctgtattttactggcgctgggtggattgctgtcacgtgtagcctggctgcaggtgatcaatcctggcaagctggtaaaagagggcgatctgcgctcgctgcgtgttcaggcggtgcccacctcacgcggcatgatcagcgatcgcgccggacgtccgctggcagtcagcgtgccggtcaacgctatctgggccgatcccaaagagctgcacgccggtggcggcgtgacgctggacagccgctggaaggcgctttccgatgcgctctctattccccttgatcagctggctgcccgcgtgaatgccaatcccaaaggccgctttgtctatctggcgcgccaggtcaatccggctatcggcgactacgttaaaaaactcaaacttcccggtattcatctgcgcgaagagtcgcgccgttactatcctgccgggcaggtcacctcccatctcattggctttaccaacatcgacgggcagggcattgaaggcatcgagaagagctttgataagtggctgaccggtgcacccggcgagcggacggtgcgcaaagatcggtacggtcgggtcattgaggatatctcttcggtggacagccgggccgctcataacctgacgctgagcatcgatgagcggttacaggcgctggtttaccgtgaactgaataacgccgttgcctttaacaaagcggaatcgggtacggcggtgctggtggatgtcaataccggtgaagtgctggcgatggccaacagcccggcttacaacccgaacaatctcggcaatacgccaaaagatctgatgcgtaaccgcgccatcaccgacattttcgaaccgggctctaccgtgaagccgatggtggtgatgacggcgctgcagcgtggtgtggtgagagagaacagtgtcctgaataccgtgccgtaccgcgtcaatggtcatgagatcaaagatgtggcgcgctacaacgaattgaccctgacaggggttttacagaagtcgagtaacgtcggtgtttcacgtctggcgttagcgatgccttcctcagcgctggtagaaacttacgcgcgctttggactgggcaaaccgaccaatttggggctggtcggggaaagcagtggcttataccctaaaaaacaacggtggtctgacatagagagggccaccttctctttcggctacgggctaatggtaacgccgttacagttagcgcgagtctacgcaacgattggcagctatggcattaatcgcccgctgtcgatcaccaaagtggatccgcccgtcgcgggacaacgcgtttttgatgagtcactggtgaaaaccgtgatgcacatgatggaaagcgtggcgctgcccggtggcgggggcgtcaaagcggcaatcaagggttatcgcattgcgataaaaaccggtacggcgaaaaaggtcgggccggacggacgctacgtcaataaatacattgcctacaccgcaggcgtcgcgcctgccagtcatccccgattcgcgctggtggtggtgatcaacgatccccaggccggcaagtattacggcggtgcggtctctgcaccggtatttggagccatcatgggtggcgtactgcgtaccatgaacatcgagccggacgcgttaccgaccaatgacaagaatgagctggtgactaacagaagtgaggaatcaagtgacagatcgtaacctgcgcgatttactcggcccctgggtgccaggcgcgccggcgcgcccactgcgtgacatgaccctggatagccgcattgcggcttctggcgatctgtttgtcgctgttgcaggccatcaggttgatggacgccgtttcattccgcaggcaattgcgcagggcgttgccgctgtggtggcggaagctgagggtgaagcggtcgacggcgaaatccgtgaaatgcacggcgtaccggttatctatctggcgcagctgcatcagcgcctttcggccctggcaggccgtttttatcagcagccgggcgaaaaacagaagctgattggcgtcaccggcaccaacggtaaaaccaccaccacccagttgctggcgcagtgggcgacgctactgggtgagaccagcgcggtgatgggcaccgtcggaaatgggctggtaggtcacttagcggcggcagaaaataccacgggttcagcggttgatgttcagcatctgctgcacgatctggctgaaaaaggggcgaccctgaccgcaatggaagtctcgtcacacggactggttcagcatcgcgtcgctgcgctgccgtttgccgcagcggtcttcaccaatctcagccgcgatcacctcgattaccacggtgatatgcagagctatgagtcagctaaatggctgctcttttctgagcatcaggtcgggcaggcgattcttaacgcggatgacgaagtcggtcgtcgctggctggcgcgcttacctgatgccgttgcggtcaccatggaggataacctccagccgggctgccacgggcgctggcttaaagccgatgcggtggattaccacgataacggcgcacatattcgttttagctccagctggggcaacggcgaaatcgacagtccgctgatgggtgccttcaacgtcagcaatctgatgctggcgctggcgacgctgctgtcactggattatccgctggcgacgctaatcagcgttgcaccgcagttgcagccggtcaacgggcgtatggaagtgttcagcgccgcaggaaaaccgacggttgtcgtggattatgcccacaccccggatgcgctggaaaaagcgctggaagcggcacgcctgcactgcaaaggaaaactctggtgcctgtttggctgcggcggcgaccgtgacaaaggcaaacgcccgttaatgggcgcgattgctgagcaatatgcggatgtggtggtgattacggatgacaatccgcgcagcgaagatccgcaggcgattgtaaaagatattctgaccggtttgctggacccaggccgcgcccgcgtggtctctggtcgtgcgcaggcggtcactaacaccattatgcaggcgcagcccgacgatatcgtactggtggctggcaaaggccatgaagattatcagatcattggcaatcgccgtctcgactactccgatcgtgccaccgttgcggcactgctgggaggcgttgcatgattccggtttcattaaaaaccctggcggagatcaccggcggcacgctgcacggcagcgatttaacgctgagtgacgtgaccaccgatacccgcaaagtgacggcgggcagcctgtttgttgcgctggtgggcgaacgctttgatgcgcacgacttcgccggcgatgccattgcgaatggcgcacaggcgctgctggtaagtaagcatttacctgtcgctgtgccacaggtggtggttgaagatacccgtctcgcctttggcaggctgggcgcatgggttcgtcagcagtcgaccgcccgtgtagtggcgctgaccggctcctccggcaaaacctcggttaaagagatgacggcggcgattctgcgtcagtgtggcgaaacgctctacaccgcaggcaatctcaacaacgattatggcgtaccgatgacgctgctgcggctgaccgcagaacatcagtatgcggtcatcgaaactcggtgcgaatcatcagggcgaaatcgcctacaccaccggactggttcaaccggaaagcgcgctggtgaataacctggccgcggcgcatctggaaggctttggttcgctggccggtgtcgctaaggccaagggcgagattttccagggcttaccggctcacggcattgcgattctgaacgcagagagcaatgactggcccaactggcagcgcacgctgcaggataaaaccgtgtggcgtttctcaccgcaggcggcagagtgtgaattctccgcccgtgatatccgcattgctcaggatggtactcattttgtgatgataacgccgcgtggcgaagctgagatcgtgctgccattgccgggtcggcataacatcgccaacgccctggcggcggcggcactggctctgtcagtggatgcaccgcttagcgccgttcagcaggggctgaaaaacctgcagtcggtgccaggtcgcttgttcccggttcgcctctctgcgcatcagctgctgctggatgacagctataacgctaacgtcggttcgatgactgcggccgttcaggtcctgtcagagatgccgggttaccgggtgctggtcacgggtgatatggcggaactgggtgaagagaccgaaagttgtcaccgcgaagtggggcaagcggcacgtgatgcaggcattgatcgcgtgctgagcaccggaaaattcagccatttcatcagtgaaagcagtgaagttggcgaacatttcagcgataagactgcgctgactgaacgtttgcgtcaattgttgtccgaacactcagaaattaccgtcctgataaaaggttcacgtagtgccgccatggagcaggtagtacagagcttaaaggagaaaggaacatgttagtttggctggccgagcatctggtcgctttttattcgggatttaacgtcttttcctatctgacgtttcgcgccattgtcagcctgctgaccgcgttattcatctctctctggatggggccgcgcctgatcgcctggctgcagaaattacagattggtcaggtcgtccgtaacgatggcccggaatcgcatttcagtaagcgcggcacgccgaccatgggcggcatcatgattctgacctccatcaccatttcggtgctgatgtgggcatatccgtcgaatccttatgtctggtgcgtgctgttcgtgttaatcggctttggcatcatcggctttgtcgatgactaccgcaaagtggtacgcaaagacaccaaaggcctgatcgcccgctggaaatatttctggatgtcggtaatttcgctgggcgtcgcgttcgggctctatgcggcgggcaaagatacccccgcgacccaactggtcgtgccctttttcaaagacatcatgccgcagctaggtctgttttatgtgctgctggcttactttgtgattgtcggaacgggtaatgcggtcaatctgaccgatggcctggatgggctggcgattatgccaaccgtctttgtcgccgcgggctttgcgctggttgcctgggccaccggtaacgtgaagtttgctgaatatctgcacattccctatctgcgtcacgccggtgagctggtgattgtctgtaccgccattgtcggggcagggctgggcttcctgtggttcaacacctatccggctcaggtctttatgggcgacgtgggttcgctggcactgggcggcgcgctgggcaccattgcggtgttgctgcgtcaggaatttttactagtgatcatgggcggcgtgtttgtggttgaaacgctgtcggtgatcctgcaggtgggatcgtttaagttgcgcggccagcgtattttccgcatggcgccgatccatcaccactatgaacttaagggctggccggaaccgcgcgtcattgtgcgcttctggattatttcgctaatgctggtgctgattggcctggccacgctgaaggtgcgttaatcatggctgactatcggggtagaaaagtcgtcatcatcgggctgggcctcaccgggctctcctgtgttgatttctttttagcgcagggcgtaacgcctcgcgtgatggacacccgtgtctcgccgccggggctggataaattgcccgggcaggttgaacgccatctgggcggcatcaacggcgactggctgctggcggccgatctgattgttgccagccctggcgtcgcgctggcgcatccgattctcagcgaagctgtcgaagccggcatcgaaattgtcggtgacattgagctcttttgccgcgaggcgcaggcgccgatcgtggcgatcaccggctccaacggtaaaagcacggtgactacgctggtgggtgaaatggcgaaagccgcaggctggcaggtgggcgtcggcggcaatattggtctgcccgcgctgagtctgctgcagtcaccggcgcaactctatgtactggaactttcgagttttcagctggagaccacgcacagtctgaaagccgcggcggcaaccatacttaacgtcagcgaagatcatatggatcgctatccgctgggtatgcagcagtatcgcgccgctaagctgcgggtctatgagaatgcacaggtctgcatcgttaacgccgatgatgccctgacgatgccggtacgcggcgcggacacacgctgcgtcagctttggtgtcgatttcggggactaccaccttaacaagcagcagggcagtatctggctgcgggtgaaaggcgagaaggtccttaacacggctgaaatgaagatggtgggacagcacaactacaccaatgcgctggctgcgctggcgctggccgatgcggtgggtctgccacgagcttccagtctggctgccttaacgcactttaacggtctggcgcatcgcttccagctggtccatgagcatcagggcgtgcgctggatcaatgactccaaagccaccaacgtcggcagcaccgaagcagcactgaatggcctgcaggtgaagggaaacgctgtggctgctgatgggcggtgatggcaagtcggccgattttacgccgctgatcccctggctgcagggcgacaatgtgcgcctttactgctttggtcgcgatggcgatgcgctggcggcgctgcgtcctgaaatcgccgtgcgcactgagaccatgcgccaggcgatggagcagattgcgccgcaggttaaagcaggcgatatggttctgctgtcgccagcctgcgccagccttgaccagttccgtaactttgagcagcgcggtgagcagttcgcgcaactggcgaaggagctgagctgatgcgtattcctggcgccggactggcgggatatttctcaggacgcctgaaagactgggtcatgggcgcacgcgaaagtgatgactcttcgctggtgctctatgaccgcacactgctatggctgacgctgggcctggcggtgattggtttcgtgatggtgacgtcggcttcaatgccggtgggtcagcgtctgaatgacgatctcttttatttcgccaagcgcgatgccttctacatcgtgctggctgtatgtatggcgctggtcacgctgcgggtgccgatggatttctggcagcgctacagcaacgtgatgctgatggtcacggtcgcgatgttgctgattgttctggtggtcggtagctcggttaacggtgcatcgcgctggatcgcgctgggtccgctgcgtattcagcctgcagagctgtcgaagctctctctgttctgctatctcgccagttatctggtgcgcaaagtggaagaggtgcgtaacaacttctggggcttctgtaagccgatgggcgtgatggtggtgctggctgtgttactgctggcgcagccggatctcggtacggtggttgtgctgtttgtgacgaccctggcgatgctgttcctggcgggcgccaaactgtggcagttcctggcaatcatcggttccggcatctttgcggtgatcctgctgatcattgcagaaccctaccgtatgcgccgtgtgacctcgttctggaacccgtgggaagatccctttggtagcggctaccagctgacccagtcactgatggcatttggtcgcggggaattctggggccaggggctcggtaactccgtgcaaaagctggaatatctgcccgaagcgcataccgactttattttcgccatcatcggggaagaactcggctacgtcggtgtggtaatggcacttttaatggtattcttcgtcgcttttcgtgcgatgtcgattggccgtcgtgctctggaactggatcagcgtttttccggctttttagcctgttcaatcggagtctggttcagcttccaggcgctggttaacgtcggtgcagcagccggtatgttaccgaccaaaggtctgaccttaccgctgatcagttacggtgggtcaagtctgatcattatgtcgactgccatcgtctttttattacgcatagattatgaaacgcgcctggcgaaagcgcaggcgtttacccgaggtggtcgatgagcggtaagcgattgatggtgatggcaggcggaaccggcggacatgtctttcccggtctggctgtcgcccatcatctgatggaacagggctggcaggtccgctggttaggcactgccgaccgtatggaagccgatctggtgccaaagcacggcatcgacatcgacttcatccgcatcagcggattacgtggtaaaggcatgaaggcgttgctgctggcaccgctgcgcatctttaatgcatggcgtcaggcccgtcgcatcatgaaggcctggcagccggatgtggtgctgggcatgggtggctacgtttccggtcctggcggcttagcggcctggagttgcggtattccggtggtgctgcatgagcagaacggtattgccgggctgaccaataaatggctggcgaaaatcgctacgaaagtattgcaggcgtttccgggcgcgtttcccgccgccgatgtggtgggaaatccggttcgcactgatgtactggcactgcctttacccgcgcaacgtctggcagatcgtcatggcccgatacgggtgctggtgatcggtggcagtcagggggcgcggatactgaaccagacgctgccgcaggttgccgcgctggtgggtgatgagatcaccctgtggcatcagaccggtaaagggtcgttgcccgaaacagagaaagcttatcagcaggtcgggcagacgcagcacaaggtgaccgagtttattgatgacatggctgccgcctacgcctgggctgatgtggtggtgtgccgctccggcgcgttaaccgtgagcgaagtcgctgccgctggcttaccggcgattttcgtgccatttcagcacaaagatcgccagcagtactggaacgcgctgccgctggagaaagcgggcgccgccagaatttttgagcagccgcaatttactgcggaggctgtagcggatcagctacgccactgggatcgcgcaacactgctgacgatggctgagcaggcccgtcaggtggcgatccccgatgcgactgaaacgggtcgctcaggaagtggctcgcgccgcaaagtaatcattccggtcagcgcgtctgacctgtacccggactgggtacaaactgaaatagcaggtaactgagagcgatgaatacacaacaattggcaaaactgcgttctatcgtgcccgagatgcgtcgcgtccggcacatccactttgtcggcatcggcggtgctggcatgggcggtattgccgaagtgttagcaaatgaaggctaccatatcagcggttcagatctggcccctaacccggtgacgcagaacctgattgcgctgggtgccaccatttattttaaccatcgccccgaaaacgtgaccgatgccagcgtcgtggtggtttccagcgccgtttcgcaggataaccccgaactggtggcggcacgtgaacagcgtatcccggtgatccgtcgcgcggagatgctggctgagctgatgcgttttcgtcacggcatcgccgttgcgggtacccatggcaaaacgaccaccacggcgatggtgtcgagtatttatgcggaagcgggtctcgatccgacttttgttaacggtggactggtcaaagcagcaggcacccatgcccgtctgggtcacagccggtatctgattgctgaagcggatgagagtgatgcgtcgttcctgcatctgcaaccgatggtggcgattgtgaccaacatcgaagctgaccatatggacacctatcagggcgattttgagaacctgaagcagacgtttattaacttcctgcacaacctgccgttttacggtcgtgcggtgatgtgtgtggatgatgcggttattcgtgatctgatcccacgcgtgggacgccatatcaccacgtacggtttcagtgatgatgctgacctgcgcattgaaaattatgaacagagtggcgcgcaggggcatttcaccttgatccgtcaggataaagcaccgctgcagattacgctgaacgcgccgggtcgccacaacgccctgaatgcggcagccgccgtcgccgtcgccagtgaagagggcattgaagacaatgctatcctggctgcgctggagagtttccagggcacgggccgtcgctttgatctgctgggtgaattcccgacagagccggtcaacggacagccgggcaccgcgatgctggttgatgattacggtcatcatcccaccgaagtggacgcgacaattaaagccgcgcgcgcaggctggccggataaaaaactggtgatggtgtttcagccgcaccgttacagccgaacccgcgatctgtttgatgatttcgccaacgtactgtcgcatgtggatgtgttgctgatgctggatgtttactctgccggtgaaaccgctattccgggtgctgacagccgttcgctgtgccgtgcgattcgtaatcgcggcaaggtggatccgattctggtgccggaacatgacgcgctgccagagatgctggcaccgctactgtcaggcaatgacctgattctggtgcagggagccggtaacgtcggcaaggttgcccgcaagctggctgacactaagctccagccggaacgcaaagcggaggatcgtcatggcggataaagttgcagtattaatgggtggcacctcggcagagcgcgaggtttcgctgaactcaggtcaggccgtcctcgccggattacgggaaatgggcattgatgcgcatggcatcgatacccgtgatgtctctgtgctgacgctgaaagagcagggctttaccaaagcctttatcgcactgcatggccggggcggagaagatggcacgctgcaggcggtgctggagttcctgcaactgccgtacaccggcagcggcgtgatggcatcggccgtgactatggataagctgcgcaccaagctgctgtggcagggacgtggtttaccgtcaggaaagtttgtctggctgacgcgtcagcagtttgatgccggtctggacgcagaaaacaacgcggcaattgcggcacttggcctgccgttgttcgtcaagccagcctgtgaaggctccagcgtgggcatcagtcgggttaacgatctgagcgcgctgccggcggcactggacatggcgtttaagcatgacaatgacgtgctggtcgaagcgtttctcagcggcgcggagtacaccgtcgcgattgtgggcgatcgtattctgccctcgattgaaataaagagcgccagcgagttctatgactatgaagctaaatacatttctgacgatactcagtacgtctgtccggccgatttaagcgctgaacgtgaagcggaattacaacagctggtactggcggcctggcgtgcgctgggatgtcgcggctggggacgggttgatgtgatgaccgacggggaggggcgctttcagttactggaagccaatacctcaccgggcatgaccagccacagtctggtgccaatggcagcgaaacaggcgggcatgagcttcccgcagctggttgcccatattctggagctggccgactgatatgtcacaggcggcgatgagagttcgaaaccgtgaaccgcaggagcgtattcgcaccgggcgcagtaacggtgcccgactgttcggcattatttttctgctgatcgtcatcgggattatggttgccggcgggctggtggtactgaagtggatgaacgatgcgtcccggctgcccttgtcaaaactggtggtgacaggacagacgcactacaccacacacgatgatattcgtcaggcgattttgtcgctgggtccgcctggtacgtttatgtctcaggacgtggacatcctgcagcagcagattgagcggctgccctggattaagcaggtcagcgtacgtaagcagtggccggacgaactgaagatccaccttgtggagtacacaccggtggcgcgctggaacgatttgcacatggtggatgctgagggtgtctccttcagcgtacccgccagtcatgtcggcaaagagacaatgccgatgttgtacgggccggaagggagtgagaaagaggtcctggcgggctatcacagcatggatgatgtgctgaaagcccggaagtttactctgaaggtggcgtcgatgacggcgcggcgttcatggcagctggtcaccagcgacgatgttcgtatcgaactgggccgcagcgacaccatgaaacgactgaatcgctttattgagctctacccggtgctgcaacagcaaggtcagaacgagagcaaacgtatcagctacgtggatttacgatacgactctggcgcttctgttggctggacaccgatcgtgatggagccacaggacagtaatcagcaacagaaccaggcacaggctaaacaacaatgatcaaggcaacggacagaaaactggtagttggactcgaaatcggcactgcgaaggttgccgccctggttggggaagttctgcccgatggtatggtcaacattattggggtgggcagctgcccttcccgcggtatggataaaggtggcgtaaacgaccttgagtcggtggtgaaatgcgttcagcgcgccatcgatcaggctgagctgatggcagactgccagatctcctccgtctaccttgctttatcgggcaaacatattagttgtcagaacgaaatcgggatggttccgatttccgaagaggaagtgactcaggatgatgtagagaacgtcgtacataccgccaaatcggtgagagtacgtgacgagcatcgcatcctgcacgtcattcctcaggagtacgccattgactatcaggaagggattaaaaatccggtcgggctttctggcgtgcgtatgcaggcgaaagtgcatctgatcacctgccacaacgacatggcgaagaacatcgttaaagccgttgaacgttgcgggctgaaagtggatcagctgatttttgccggtctcgcctccagttttgccgttctgactgaagacgaaacgtgagctgggcgtgtgtgttgtcgatattggtggcggtacaatggacatagccgtatataccggcggcgctttacggcacactaaggttattccgtatgcaggcaacgtcgttaccagcgacatcgcctatgcgtttggtacaccaccaacggatgctgaggcgatcaaagtgcgccatggttgcgcgctgggctcgattgtcggcaaagatgagaacgttgaggtgccgagtgtgggcggacgtccaccacgtagcctgcaacgtcagacgctggctgaagtgattgagccgcgttataccgaacttttgaatctggtcaatgacgagattctgcagttacaggaacaactgcgtcagcagggcgtgaagcatcacttagccgcaggcattgtcctgaccggtggtgcagcgcaaatcgaaggactggcggcctgtgcgcaacgcgtattccatacgcaggtgcgtatcggacagccgctgaatattaccggcctgactgactatgcgcaggaatcgtactactccactgccgtgggactgttgcattacggcaaagagtcgcacatgaacggtgatgcagagaccgaaaaacgggtctcagtaggtaactggttcaagcgtattaacagttggttaaaaaaagagttttaatttttgtgaaaggggatcatgctgttttctttagtgatctccaggcgacaggcacataacggagagaaatcatgtttgaacctatggaattaaccaacgacgcggtgattaaagtcatcggcgtcggtggcggcggcggtaacgccgtagagcacatggtacgcgagcgtatcgaaggtgtggaattctttgctgtgaataccgacgcgcaagcgctgcgtaaaacagctgtcggccagaccattcagatcggtaataacattaccaaaggtctgggtgcgggtgcgaacccggaagtgggccgtaactctgcagaagaagatcgcgaagcactgcgttctgcgctggaaggggcagacatggtcttcatcgcagcaggtatgggcggcggtaccggcaccggtgcagcgcctgtcgtggctgaagtggctaaggagctgggtatcctgacggtggcggttgtcaccaagccgttcaacttcgaaggcaaaaagcgcatggcgtttgccgagcaggggatcgccgaactctctaagcatgtcgattcactgatcaccattccaaacgacaagctgctgaaagtgctgggccgtggtatctctctgctggatgcgtttggtgcagctaatgacgtgctgaaaggcgccgttcagggtatcgctgagctgatcacccgtcctggcctgatgaacgtcgactttgctgacgtgcgtaccgtcatgtccgaaatgggctatgcgatgatgggttcaggcgtcgcgtgcggtgaagatcgtgcggaagaagcggctgaaatggcgatctccagcccactgctggaagatatcgacctttctggtgcgcgtggcgtgctggtcaacattacggcgggcttcgacctgcgtctggatgagttcgagaccgtgggtaacactatccgcgccttcgcctctgacaacgcgaccgtcgtgatcggtacttcactggatccggaaatgaatgacgaactgcgcgtcaccgtggtggcaaccggtatcggcatggacaagcgtcctgaaatcaccctggtaaccaacaagccagccagtcagccagtgatggatcatcgctatcagcagcacggtatgtcaccgctgccgcaggagcagaaacctgctgccaaagtcgttaacgaccaggctgcgcagtcgaacaaagagcccgattatcttgatattccggcatttttacgtaagcaggccgattaggattaaccctataattgggattctccgctctttgtgctaaagtctctgtccgctggtaaagtatactggcggtcggacaggtgatattgcgagataatacgatgatcaaacaaaggacattaaaacgtattgttcaggcgactggtgtcggtttacataccggcaaaaaagtcaccctgacattacgccctgcgtcggctaataccggggtcatctatcgtcgcaccgacttgaatccaccggtagattttccggctgatgcaaaatacgtgcgcgacaccatgctgagtacctgcctggtgaatgatgaaggcgtgcgtatttcaacggttgaacacctcaatgccgccctggcgggtctgggtatcgacaacattattgttgaagtcgatgcgccagaaatcccgatcatggatggcagcgcagcaccgtttatctatctgctgatggatgcgggcatcgagcagctcaacagcgcgaagaaatttgtgcgtgttaagcagaccgtgcgtgtggaagagggtgacaaatgggccgagatcaaaccgtttaacggcttctcgcttgatttcaccatcgacttcaaacacccggctatcgattccagctcacagcgttatgcgatgaacttctctgctgacgcctttgttcgtcaaatcagccgggcgcgtacatttggctttatgcgtgaaatcgaatatctgcagtctaaaggcctgtgcctgggcggtagcttagattgtgcgataggtctggatgatttccgcgtactgaatgaagaaggcctgcgttttgaggacgagtttgtgcgtcacaaaatgctggacgcgattggcgacttgtttatgtgtggtcacaacatcattggcgcattcactgcgttcaaatcgggccacgcgctgaacaacaagctgctgcaagcggttctggctaagcaggaagcctgggaatgggcaaccttcgaagacgaagctgaactgccgctggcattcaaagcaccgaatctggttctggcttaattaccccggaacgtgaaacggctggttatgctgacaccctctccggtcagcggcgccagccgttttttattgcctcttatcacacgcctgatgactgcgacctcgctcgcaaagcgttgtctgttctgctgatttgctgaacaatcacacgcgttttctctcgccatcactttaatcccaggtgtggatgccccacattaatgatactatctgtggcgcttttacaggccgaaatccgttgcggctcgcggcgggtaccagaaaacaagagcgcaacagagcatgcgcgatggaaaggttgtgatcgggattcttctgcgctggcgacaattaggtagacgctacttctggcctcatctcctgttagggatggtagcggccagctttggcctgccagcctgtgcgcaaagctccgaaactcaacgcgtcgtctgaatctccggccagcagtctctttcttggcaatgccacacgctttgatcatctgatccggctgcaggaagcgtcccgacgcccgagcttcagcgtggattactggcatcagcacgccatccgcaccgttattcgtcatctctctttcacgctggcgccccaggcgcaggcggagcaacagacattaccgctggcggcacaaaagctggcgctgatcgactcactgcatagtttactgacatcacattctgcgctgcacactgcaccgcagcagatctctacgccgcctcttttcacggccgttacccgttcatgggtagagtggcatgccagcgtgcatggcattcgcgccggacctgcccgattgttctgctaatatttttggttttattcactctgttaagatttcgcagtccggaatgctccggctgaattgagaatatatttactatgttaagcaaaattttaaccaaggtttttggtagcagtaacgatcgtaccctgcgtcgtatgcgtaaagtggtggatgtcatcaataagatggagcccgattttgagaagctctctgaggatgaactgaaagcgaaaactgatctgttccgcgaacgcctgaaaaaaggtgaatcgctggaaagcctgatcccggaagcgttcgcaaccgtgcgtgaagcgagtaaacgcgtgttcgggatgcgtcacttcgacgtgcagctgatcggcggcatggtgctgaacgatcgctgcattgctgagatgcgaaccggtgaaggtaaaacgctgaccgcaacgctgccagcctacctgaatgcgctgtccggcaaaggcgttcacgtggttaccgtcaacgactatctggcacagcgtgatgcggaaaacaaccgtccgctgtttgagttcctgggtttaaccattggtatcaacatgtcgggcctgccggcggtggcaaagcgtgaagcttacgcagcagacatcacctacggcaccaacaacgaatatggcttcgactacctgcgcgacaacatggctttcagcccggaagagcgtgtacagcgtaaactgcactatgcgctggtggatgaggtcgactccatcctgatcgatgaagcgcgtacgccgctgatcatctctggtccggcagaagacagttctgagctttacaccaaagtgaacaagatcatccctcatctggttcgccaggataaagaagataccgaaacccatcagggtgaaggcgacttctgggtcgatgaaaaagcgcgtcaggctcacatgtctgagcgcggtctggtcaaagtggaagagctgctggtcagcgagggcatcatggaagcgggcgagtcactctactctccgaccaacatcatgctgatgcaccacgtcactgcggcgctgcgtgcgcacgcactctttacccgcgatgtggattacatcgtgaaagatggtgaagtggtgattgttgatgaacacaccggccgtaccatgcagggtcgtcgctggtctgatggtctgcatcaggcgattgaagcgaaagaaggcgttgagattcagaacgagaaccagacgctggcctctatcaccttccagaactacttccgtatttacgagaagctggccggtatgaccggtaccgctgataccgaagcatttgaattcagctccatttataagctcgacaccattgtcgtgccgactaaccgtccgatggtgcgtaaagatctggctgacctggtctacatgaccgagaaagagaagatcgatgccattatcgaagatatccgtgagcgtactgcaaatggtcagccggtgctggtgggaaccatctcgattgagaaatcagaagtggtctctaacgaactgacccgtgccggtatcaaacataacgttctgaacgccaaattccacgcccgcgaagcggatatcgtggcgcaggctggtcagccgggtgcggtcactatcgccaccaacatggccggacgtggtacagatattatgctgggcggcagctggcacgctgaagtggccgaactggaagagccaactgaagcgcaaatcgaagaaattaaagcggcatggcagattcgtcatgatgcggttctggcgtcaggtggtttacacatcgtcggtactgagcgtcacgaatcgcgtcgtatcgacaaccagctgcgtggtcgtgcaggtcgtcagggtgacgccggttcttctcgcttctacctgtcgatggaagatgcgctgatgcgtatttttgcctcagaccgcgtctcgaatatgatgcgtaaactgggcatgaagccaggcgaagcgattgagcatccgtgggtcaccaaagcgattgccaatgcccagcgcaaagttgaaagccgtaacttcgatattcgtaagcagctgctggaatatgatgatgtggctaatgaccagcgtcgcgcgatctacagtcagcgtaatgagctgctggatgtgtctgacgttagcgaaaccatcaacagtattcgccacgacgtctacaaagtcaccatcgatacttacattccgccgcagtcgctggaggagatgtgggacgtgccaggcctggaagagcgtctgcgtactgactttgatctaaacctgccgattgcagagtggctggataaagagcccgatctgcatgaagaagtgctgcgtgagcgcatcatgacccatgctatggaaagctacgctgagaaagaagagatcgttggcgcagagatgatgcgcaacttcgaaaaaggcgtgatgcttcagacgctggattcgctgtggaaagagcatctggccgcgatggactatctgcgtcagggcatccatctgcgcggctatgcgcagaaagacccgaagcaggagtacaagcgtgaatccttcgccatgtttgccgcgatgcttgaatcactgaaatatgaagtgatcagcacactgagcaaagtccaggtgcgcatgccagaagaagttgaagcgatggagcaacaacgtcgcgaagaagctgaacgtctggcacagcaacagcagctgagccatgttgaagaggatctgctggcagccgcagagcctgtggcggagcagagtggcgaacgcaaagtcggccgcaacgatccctgcccatgtggttccggtaaaaagtacaagcagtgtcatggccgcatcgcctgagactgaatgctaataaaaaaggagccgctggctcctttttttatggtctctgccacccaggcaacagcgactccgctgagctaaagcggttaacatccgctacggcatgctctaaaatcaggcttcattcacccattactaccggatagtctccatgaagcacctgcaggttgcagttggcatcattcgcaatgccagtaaacaaattttccttgcccagcgcgcggcgacctcttacatggcgaacaagtgggagtttcctggcggtaaaattgaagcgggcgaaagcgccgaacagggattgataagggaacttcaggaagagaccgggattgaggtcaccgaggcacgcccgattggtcatgcagaccacagttatgacgatctgcgcgtgacgttgcatttctttctggttgaagggtggaaaggagagccgtggggcaaagagggtcagccgcagcgttgggttgatcagcatgcgttggtcgcggaggagtttccgcccgcgaatcatcagctgattgcgcgtctgatcgccggcgaaactctgagcggatggggcagcgcgccccatccggttcggctgtcagcgatcttcttcactccagttgtcactgtcgttcatatcgtcgcggctgggaatgcgtttctcttctgcggcccactcacctaaatcaatgagctggcagcgcttactgcaaaaggggcgccacgggctgagttcatcccagatcacatctttgccgcactgcggacaggcaacggtcatcacttcttgctgcatttttacctctaacaacaggccagttgaaaattaaggcgggccggaacttcaccacgctcactatcaagcggcataaaacgaatggcgtagcggcttttatgtccggacacctgtggatagagcgcatcctccagcgacaactgcagtcgcaacagatcggcgccttcggcattatcctgataaaaaccattaaggctggtctgcacatgaaacgcgccggactggcggatcagatccagtatcatcgccagcgcatgatgcagtggctccagcgtcagcatccaggcttcgacctgcgcatcgcgtgctttctgtggcagatggagccagatgtgcaggcctggcaaatcaaagctgcagcatccaccagggatgctcaggcgctgccgcaccagggcaatcagacggtcctcgcggagttgctggcccatacgtggggcattcattaactgcgtcgactgaattttgagtttatcgcgcagggcattaaccagcgtcatatcaacacctggcacatcagcccatgcacgtaacttttgctgctgacgctccagctcttttaacaattcagtacgcatatcgccacgctcaaaaatgtcgagcagttcgctaatcaggcgaaaaaaggtcagcgcattaacggttttatccagtgggacaatttcatctaactgattgatcaaaaactcaacccgtaaccaggttcgcattttttcattcagagggtgttcaaacagaacgggtgtgctcatggtattaatcctgtttcgttgccgccagcctgagatagcgctgatggagttcggcaacctgcggcaaggcgtcgtcgggctcgccactgttatcaataatgtcatcggcacaggcgaggcgctgctggcgcgtcgcctgtgcggcaagaatgcgtttcgcctgcgcgacggaaagatgatcacgctgccgggtgcgcgctaactgcgttgcctcatcaacatccaccaccagtacccgatcagcctggtgctgtaactgattttccaccagtagcggcaccacccagagcacataaggtgtggtggcttcggcgatcaattgacgcgtccgggcattaatcagtggatgcagcagcgcgtttaaccagcttttctcttccggctgctgaaaaataatgtcgcgaagccggctacgatcaagcttcccctcatcagtgactatcgacgtgccatagcgcgcctgaatggcctgcaaagcgggtgtgccgggttcgacaacttcacgtgctatcaggtcagcatcaataatttccacgccagacgctgcgaatgcctgggcaatcgtacttttaccactgccgatcccccctgtaagcgcgacgatatagggcatgtttctcacctgacttctctgttcgacagggcttcagggtaatgatctgaataaaaaacgcaaaaatgcgcgtcagatcacaccgataaaccacaattaaatttaacggattgtagcgtaaataaagtgaaattcgcagtcttgtcgcgcagcgagaggcgcgtatcataacgtcactggagctgtgcttacttcgtgaacgacgattcattgccacttaccaggacactgtttatgcgtattgaagaagatttaaaactgggctttaaagatgtcttaatccgccccaaacgctccacgctgcaaagtcgctcacaggttgagctggaacgcagctttaccttcagacattcgggcctgagctggagcggcgtaccgattatcgccgccaacatggataccgtcggcacattttcaatggctgaggcgctggccagcttcaatatccttacagcagtccataagcattacagcgtagatgagtggcgcgcgtttattcagcgcgtccccgcgacggtattgaaacatgtgatggtttcaaccggcacctcggaggccgatctcaataaactggttgcgattatggcgctgtcagacgatctgcagtttatctgcatcgacgtggccaacggctattctcagcattttgttgattttctgcagcgcgcccgtgaaaccttcccggctaaaaccatctgtgccggtaacgtggtaacgggcgaaatggtggaagagctgattctctctggcgcggatatcgtcaaagtcggcattggcccgggttcggtctgtacaacccgggtgaagaccggcgtgggctatccgcagctttccgctgtcattgaatgtgccgatgcggcgcatggcttaagcggacagattgtcagtgatggcggctgttcagtgcctggcgatattgcgaaagcgtttggcggcggtgccgactttgtgatgctgggtggcatgctggcggcacatgatgagtgtgaagggcaggtggtcgaagagaatggcgaaagctttatgctgttttacggcatgagttccgaatcggcgatgaagcgtcacgttggcggtgtcgcgcaatatcgcgcagcagaaggtaaaacggtgaagctgccattacgtggcccggttgctgacaccgcgcgcgatatcctgggtggactgcgttccgcctgcacttatgtgggggcggagcggctgaaagagctgaccaagcgcaccacctttattcgggttaatgagcaggaaaaccgcgttttcaaccgatagttatccggggcgcagcctgcgccccttaatgcatcgcatcacccagcccgaacaccggcagatacatcgcaatcaccagcgtgccgacaatgccgccaatcaccaccatcatcatcggttccagcgaagcagccagtgtgtcagcgcgctcacgggtttctgcctcatgccattccgccagacgagccagcattaaatccagcgcgcccgcctcttcgccgacgcgaaccagctgaccgcataatggtgtgaacagcggatgatgcatcagcgcctgatgcagaggattcccctgagcaatgtgctgctgcagtccggccattgcttcccgccatagcaatgatgagagcgtcacttcaacggcagccagtccctgtagcaaagttaacccggcgcgctgtgtcagattcagaatggtgtagatctgcgtcagctgcgtgccacgccataacccggaaagcagcgggatgcgcaggaaaatcgcctgctcacggcgctgccagcccgcagagcgtcgtcgtaactgatgccaggctaccagcatcagcgatacgccgatggctaacaccgctccccactcctgaagcgcggcagataactgcattaccgctgccgtaaaagctggcaggggggcgtcaaaggagccataaacggcaacgaaactctggcagcacgaacagcagcatgccgcaggtgaccgcaatcgccaccagcagaatgaacagaggataacgcagcgccttcgccacctgatgccataactgctgctgccggatctgctgccgggccagttcactgcagcaggtatccagctgaccggtcagttcgcccacctccatcagggccggatagagtgccggaaaaatctgcggccattcgcgtaaagcctgagaaaaaggagcaccgctgagtacccgatgatgcaggacaagcatcagagcacgccagcctgcatgcggatggccctcagccagcaaagccagactctctgccagcggcagtcccgctttgagcagggttgccagctgacgaatcagatcggttttgtgctgccacttccactccctctgacgccacactttttctcgcttccagctcaccggcagaagatcgcgctgcgccagcatcagcagcaggttatcactgtcgatagccagtagctggccactgactaactggccctggctatcgaccgcctgccagcgaaataaagacgcatcagccatcgtccagcccaatcacccgttgcatctcttccagcgaggtatcgccccggcttactgcctccaggccagaaaccagcagggtgcgtaatccctgctgtttcgccaggctgagcaaattctccagcggcatttcggcggcgatcgcattttgcagcctggcattgatcggcagcagttcaaacagcgccagccggccaaaatagccggaaaaacagtggtcgcagccgggagctcgccaggtttgcaaggtaccgggccagagttccgcaggatagtgcgccaccgcctgagcgggctgacggcagtggggacagaggcgtcgaaccaggcgctgagcaacaatcagtttcagcgccgaccccagaagataaccgggaatacccatctgtcgcagccgggtcagggtctcggcggtggagttggtgtgcagcgtcgacagcaccagatgcccggtctgtgccgctttaaccgcaatctccgccgtttcagcatcgcggatctccccgaccatgatcacgtctggatcctgtctcagcagcgcccgcagcacgcggttaaaatcgaggccgtttttagcatggatctgcgtctggttaatgccgggcagcgggatctcaattggatcttcaacgctgcacagatttttttccggggtattcagggcactgagtccgctatagagcgtaaacgtcttgccgctgccggttggcccggtgaccagaatcagcccctgcggctgcgccagcgcggcgcagaacaggcgcaactgcgcggcgggtaagccgagcttatccagcgacagcgccgcgctttcagtctgcaacagccggaccaccgctttctcaccaccgtagatgggtaaggtggccaggcgaaaagaggcgggtttaccggcgatctccagactgaactgaccatcctgcggtaaccggcgttcggcgatatccagtccgccgaggatcttcagtcgcgccagtagcgcagcaggctgggtgacgggcagggaagatagagggtgcaatacgccatcgatacgcaaacgcacccgcaggccatcacggccgggttcgatatggacatcagaggcgcgacgctccagcgcctgacgcaggatcagctgtgtcgcttcgatcgctgattctgtgggcgcctcttcgcgcgccaccagcggtgtgtcagcgtgctgaagctggtcgagccgggcctgcggccagcattcaatttcaatctgacactggctggcaaaatggagggcttcagccagccctggcggcacgctttccgcgacggcaacacgcagctggctggcatcatggtgcaaaaccagggcacgatagcgctgacataatgccgcgatcgcctcatcaggcttgctcatcgctggctcctttatccgcaaagcggaactgctgcaggcaattgtcgcgcaggctattgttgctgctggtgcagctgcgttgccagctgatgccgccctcggtgctgtcccagagcggcagcatttcaacgctcaggccattcaggctctcctggccggtcagcgtaatgaccccgttggtcacgctcagtgccgagacatagcgcgatcccctggcagcaggaatacccgcttctccggcctgacactgcgtcgggccgccgcgctccatggcgcaaagctcaacagcggttttatagggcaccatggtttgcagcatatcggtaagggcagcacgctgcagataattttgataagcgggcaggccgatggcacttaagattgccacaatacccaccacaatcatcagttcaacaagcgtaaatccacgttgataattcatcacatcgtctccgtattaagaaggcgacaggttaaaaatcgggagcagtgaaagacaggcagagatgggcaaactggaaagcgtgatgtgaacagatttcagacttacagcgcagtcgaaactgcgccggaagcaggctcgcaaaatcgccgtgctgagtgacggcgaggcaggctatttttgtttaaagcgcatcgagagatccagcgcccgcacatgcttggtcagcgcgccaaccgaaacatagtccacgccggtcagggcgatctgtggcagggtagtttcggtgacgttaccggagacctccagcaacgcccgaccctgattaagttcgacggcggcacgcatcgcttccaggctgaagttatccagcatcacgatatcggcttccgcttccagcgcctgacgtaactcctccagcgattccacctcaacttcaaccggcacatcgggctgcagccattgcgctctttccactgcctgccgaatcgagccgctggcaataatatggttctctttgatgagataagcgtcagagaggcccagccgatggttgctgccaccgccgcacaacacggcatatttcagcgcagtccgcagtccgggcagggttttacgcgtgtccagcagttgcgtctggcttcccgccagcagcgcgacatagcggctgacttcggtagcaacgcctgagagcgtctgcacaaaattaagcgccgttcgctcggcggtcagcagcagccgggcaggcccctcgatttcaaacagcagctggtcagcctcgatctgatcaccatcttcgacatgccagatcagggtcgcgtttgagccgagctgaatgaacacctcttcaacccagcgtttaccacagaaaacaccggcttcgcgggtgatgacctgcgcatcggcctgggtatcggcgggtaacagctgcgcggtgatatcgcggtcagcgtcgatctcgcctccgagatcctcttttaacgccagcgcaacactatccggaatgtcactttcaatgcgtttaatcagagcctgacgacggctgtcgggatcataaccacgggatgacataggcgttttactccagaaagggaaatgacagaggcggtcacaatagcctgaaccgccattcggttccagcaactgataccattttgtttagtatccttaacacgtagtgcgtgaatgtcatcagaccggcacactaagaagcaagaatcctttattattcatgctattctcagccaggtgaaataaggaaaaccgctatgaaaatcaaacagggctggctgacccgcgtgcgtcatgtgccgtcgccgcattgcaacgaaacgccctgataatgaggcaccttcactgctggtgatccacaatatcagcctgccacccggtgaatttggcgggccatggatcgataaactgttcaccggcaccttaccgcccgatgcccatccctattttgcggatatcgccgcgctgaaagtggcggcacactgcctgattcgccgtgacggggagatcgtgcagtatgtcccctttgataaacgcgcctggcatgcaggcatttcgcagttcgaaggacgtgagaactgcaacgacttctccataggcatcgaactggaagggacagacagtgagccttatagcgaggcgcaatatcgggccttgcagcaggtgacgcaattactgctgcaacactatccgttaacgccggcacgtatcacggggcacagtgacatcgcaccggtacgcaaaaccgatcccggacctgcttttgactgggactactacaaacagctgttaacgcagcaaaaatcctgatttttgcggagtcagtatgacgttgtttaccttgttgttggttttaggctgggagcgcctgtttaaactgggcgagcactggcaactcgaacaccggctggagccgatctttcgccagcgccaccatttctcaatgatgcgtaccctgctgatgaccgtgctggcgatggcgctgaccgcgctggtgatctggagtctgaaagggctgctgtttggcgtgctgcaactgctcttctggattgttgccggactgctctgtatcggtgcggggtcggtgcgacagcactaccacagctacctgaaagcggccagtcatgatgacgacgctgcgcatcaggcgatggcggctgaactgacgctgattcatggcgtgccggtggaatgcagcgagcgcgagttcctgcgtgagctgcagaatgccctgatctggataaacttccgtttctaccttgcgccaatgttctggctggtggtaggcggtccgtgggggccggtgctgctggtgggttacgcttttctgcgggcctggcaaggctggctggcaaagcacggaacaccgatggcgcgttcacaatctggcgtggatgccattctgcatcttctcgactggatcccggtgcggctggcgggtgtggcttacgccctgctgggtcatggcgaaaaagcgctgcccgcctggtttgcttcgctgaccgatcggcatcgttctcagtatcaggtgctgacgactctggcgcagttctcactgtcacgcgatccgcacaccgataaagtcgaaacgccacgggttgccgtggcgttagcgaaacgtacctcactggtactggtggtcgctgtcgcgttgctgacgatttacggcacgctggtgtaatcggcaggcggcacgccgaaatcaggcgtgccatcttcccgccagctgaaatatttcagtcgggtatggcggttcggatcccataacggatcgccttcaatttcagtgtagttacgcgcgtggtataccagcacgtcgcgtcccgcctcatcctgggtaaaactgttgtgacccggtccatactgatggttgtcccagctggagacaaataccggccgtgcagatttctgccaggcggcaacatcgagtgggtcggcatcagcagcaatcgacagtatccccagacagtaattctcatcggtggcgctggcagagtaggtcacaaacagccgatccccgtgacgaataaccgccggtccttcattaacgctaaagcctgcgcactcccactcatattctggccggctcagcatcaccggcgtgcctttcagcgtccagggattaagcagctcagccagatagaggttagagttgccgggaatcaatggatctttctgcgcccagagataccagtttttaccctgatgcacgaagtgggtggcatccagtgagaagctgtcaaactggctgaacacccggcgacagggctgccattccccctgcagcggattttccgcctcacacaccagcgcatacatccggtgctgaaacagtccctctttgatttcacgcgtcggtgctgccgcgaaatagatgacccactgtccgtcaatgtagtgcagctcaggtgcccagattaactcgctaaaggggccgctctcgggcttgcgccagacgactaccggctcggcgctgcgcaggccagccagcgtcgtggcgcgacggatctccagccggtcatactctggcaccgatgccacaaagtaatagaactgttcatggcgcaggataaaggggtcggcacgctgctcgataaaaggattcggcaagattgcggtcatttaacatctccggttggcgtgataacaccgtcgcgcaggcgaacggtgtgtaactcatggaagttttcgcggcgcagcgcgagatcctgctggatggtaatcatcattttgcggtcgaccttcatcagtcgtaccacgcctgcggtaatcagatagccgacgcccgggataatggtgaacagcagcatgatgccgttaattgcctcaggtgactgctgcttagcgcccgcattgtagccatagatcgacagcagaaagccgaccatcgcaccggcaaccgccagtcccaccttgaggaagaacaggttgccggagaagctgatgccggtgatgcgtttgccggttttccattcgccgtagtcatccacatcggccatcagtgaccagtgcagcggagaggggatctgatgcaggatattcagcacaaagtaggcgatcacgaccatcacggtggcgtggggatcgatccagtagaaaccgctggagaagagtgccagcgcgatattggtccagaagaagactttgagtttgcaccagcgatcggtgagcaatttcgccagcgtgctgccgaccatcatgccaatcacacccaggctgataaacagcgtggcgaagtgcgtcgactggcccatgacccaggtcacgtaatacatggtggccgccatacggatgaagccgggacagacgttacagaaggtcagcagcagaatgcgtacccactggtcattcttccagacgtcacgcagatcttttttcaggtcatcattgctcggcacggcagggcggatacgttcacgtaccgtggcaaagcagaacagaaacatcgccaggccaatggttgccagtaccgccatcgccatctgatagccgcgcgctttgtcttcgccaccgaaccactctgccatcggcagcagggacagggagagtatcagcgtagcgatgccgaccatgacaaagcgataagactggcaggagacgcgctcaccgggatcgttggtaatcacgccgcccagagagcagtaaggaatgttaatcgccgtataggtcagcgacatcaggaagtaggtgacgaaggcccagatcaccttgttgtgataggtccagtctggcgtggtgaacatcaaaacgctgaacaccacataaggtacggaaacccacagcagccagggacgaaaacgaccccagcgactctgggtgcgatcggcaatcgcgcccataataggatcggttaccgcatcgagcactctgaccgagagcagcagggtccccaccagcgccggggccaggccgaaaacgtcggtatagaagtagttcaggaacagcatgatggcaccgccaatcatgttgcatccggcatcgcccatgccatatcccagtttttcccgaaacgggagggctgtacctttcatggttttctcctgcgcatccagtgtgaacaggaattattggcaggaaatcagcgagatgaacgggagtaattcgttatgaagatggacaaaacagttgcggggagagaagtgtgaactggatcggggcagttgagacggacagagaggcgcgggtgacgtgctgcaaccccgcaggaggtcgcagcacgaggtaaagcatcaggctttctgtgtctggttcttgataaagtaacccacgcccagaatgaccagccagaccggaatcagccagacagagatcgccatgcccggcgtggtcgccatcagtaccagaatcgccgccaggaaaatcaggcaaatccagttaccggccggatagagcagcgctttaaagcgcgtggttacgccctgcttatctttcttacgacggaacttaaggtgcgccaggctgatcatcgcccagttgatcaccagcgcagagacgaccagcgacatcagcaggccaaacgcttcacccggcatcagatagttgatcagcacacacagcgcagtggcgacagcagagaccagaatcgttaataccggcacaccgcgacggtcgaccttcagcagcgcttttggcgcattaccctgctgtgccagaccaaacagcatacggctgttacagtaaacgcagctgttatagaccgacagcgccgctgtcaggatgaccacgttgagcgcattcgccaccatggcatcgcccagctcgtggaagataaagacaaacgggctgacttctgacgtgacacgcgtccacggcatcagtgacagcagcaccgccagcgaaccaatgtagaaaatcagaatacgccacagcacctggttggtcgcttttggaatgctcacttccgggttatccgcttcagcggcggtgatacctaccagctccagcccaccaaacgagaacatgataatcgccatgaccatcaccagaccgccgatgccatgcgggaaaaatccgccctgttcccacaggttgcgcacggtagcctgcggacccgcgtgtccgctgaacagcaaccagcctccgaacaggatcatgccaatcaccgcaaccactttaacgatggcgaaccagaactccatctcaccaaacactttcacgttggtcaggttgatagcgttaatcatcacgaagaagatggcagccgaagcccaggtcggaaagtctggccaccagaaactggacatatttgccaacggcggtgagttccgccatggcgaccagcacatagagcacccagtagttccagcctgaggcgaagcctgcaaagttgccccagtatttatacgcgaagtggctgaagctgccggcgaccggctcttccacgaccatttcgcctaactgacgcatgattaaaaaggcaataaaaccggcaatcgcatagcccagaattacggccggtccggcggattcaatgaccgatgcactgcccagaaacaggccggttcccactgcaccacccagcgcgatgagctgaatatggcggttcttgagaccacgtttcagcgcttcgccttgctgttgttccatacaaacctcgtgatgtttttattcttcgttcgcagcgcaggacgctgtaatgaagtagttacaataacgtattgattattttacggtatctggcgtgctgaatagtgccatctgctaccctggcgacaagaatagtgataagcgaatcgctttgcacctgctttcgcctttcgtgctgagagttgactgaaaaaacgccgtcctggtcacgtctgcccacagcaacttctgccatgaaattccgttaatgacgaatagctttcacttatgtctgccgctgcgctaacgcgctaagcgggtgtaaggtttggtaaaagtgaaattatttaacatttgcggtaacgcgaatttttcatttttttaaccgcaagttagcgccagcacaggctttgcgggcaggtgaatgtcgcagacaccatatagacacaaggtgaatactttgttactttaccggcacctctttgcaattggtattaccaatttactccggacgattggcttaataagaagggacgatggcttacagtaagattcgccaacctaaactctccgacgctatcgagcaacagctcgaatcgctgattatggaagggaccctgcgtccgggagagaagctgctgcctgagcgcgaactcgccaaacaattcgatgtctcacgtccgtctctccgcgaagcgatccagcgcttagaagccaaaggattattgctgcgccgacagggtggcggaacgtttcgtgcaggagaatctctggcaaagcttaagcgatccactcgttgagcttctcgccgaccatccggaatcacagtttgatctgctggaaacgcgccatgccttagaaggcatcgccgcctattacgcggcgctgcgcggcacagaggaagacctgctgcgcattcgcgactgccatgtgaatatccagcaggcgcaggacagcggcgatttagacgccgaagcggacgcagtgatgcagtatcagatcgctgtcacagaagcggcccataatgttgtgcttttacatttgctacgctcaatgggccctatgctggaacaaaacgttcgccagaatttcgaattgctctactcgcgccgggaaatgctggcaaaagtgagcggtcaccgcgccagaatctttgaggcgattgtggctcgtgagccagaaaaagcgcgcgaggcttcacaccgtcacctggcgttcatagaggaaatcttgctggacagaagtcgggagcagagccgtcgagaacgctccctgcgtcgtttacagcaacgtaaggaataacgtgcgacaaagatcgtacggacatgtgcgacgagcctgcctgcatctgctttaacaggctcccgattattcaacgtattagacacagataaggaacacacccatgtcagaacgtttacacaatgacgtggatccgattgaaactcgtgactggctacaggcgatcgaatcggtcatccgtgaagaaggtgttgaacgtgcacagtatctgattgatcaggtactgggtgcagcccgcaaaggcggcgtaaacgtggctgcaggatcttctgcaatcagcaactacatcaactctattgccgttgaagatgaacccgattatccgggcaatacctctcttgaacgtcgtatccgttccgcaattcgctggaacgccatcatgtcggtgctgcgcgcatcgaagaaagatctggaactcggcggccacatgtcctccttccagtcttctgcgacgatttatgaagtgtgcttcaaccacttcttccgcgcgcgcagtgagaaggatggcggcgatctggtctatttccagggccacatctctcccggcatctatgcccgtgcgttccttgaaggccgcctgaccgaagaccagatgaataacttccgtcaggaagttgacggtaaaggcctctcttcttatccgcacccgaaattaatgccggaattctggcagtttcccgaccgtatcaatggggctgggtccgctgtcggctatctaccaggcgaagttcctgaagtatctggaacaccgtggactgaaagatacttctgctcagaccgtttacgccttcctgggtgacggtgagatggatgagccagaatctaaaggcgcgatcaccatcgcgacccgtgaaaaactggataacctggtcttcatcatcaactgcaacctgcagcgtctggatggtccggttaccggtaatggcaagatcatcaacgagctggaaggcatctttgccggcgctggctgggaagtgatcaaggtcatctggggcggtcgctgggatgagctgctgcgcaaagataccagcggcaagctgattcagctgatgaacgaaaccgtcgacggcgattaccagaccttcaaatcccgtgatggtgcctatgtgcgtgagcacttctttggtaaatatccggaaaccgccgcgctggttaaagatctgtccgatgatgaaatctgggcattgaaccgtggcggccacgatccgaagaaaatctacgcggcactgaaaaaagcgcaggacaccaaaggcaagccagtactgatcctggcgcataccatcaaaggttatggtatgggcgacaccgcggaaggcaaaaacattgcccaccaggtgaagaagatgaacatggatggcgtgcgctatatccgtgatcgcttcaacgtgccagttgcagatgacaaaattgaatcactgccgtacgtgacctttgaaaagggctctgaagagcacacgtatctgcacggtcagcgtgagaagttaggcggctatctgccaacacgtcagccgaagttcactgaaaagctggaaatgccagcactcgaagagttcagtgcgctgctggatgagcagaacaaagagatctcaaccaccatcgcctttgtacgtgccctgaacgtgatgctgaagaacaagtcgatcaaagatcgcctggttccgatccttgctgatgaagcgcgtacctttggtatggaaggtctgttccgtcagattggtatctacagcccgaacggtcagcagtacaccccgcaggaccgcgagcaggttgcttactacaaagaagacgagaaaggccagattctgcaggaagggatcaacgagctgggcgcaggttcctcctggctggctgcggcgacctcttacagcaccaacaacctgccgatgatcccgttctacatctattactcgatgttcggcttccagcgtatcggcgatctgatgtggctggcgggcgaccaacaggcgcgcggcttcctggtcggcggcacctcaggtcgtactaccctgaacggtgaaggtttgcagcatgaagatggtcacagccacattcagtcgctgactatcccgaactgtatctcctacgatccttcttacgcctatgaagtcgctgtcatcatgcatgacggtctggtgcgtatgtatggcgaagcgcaggagaaacgtttactactacatcaccacgctgaacgaaaactaccatatgccagcaatgcccgctggtgcagaagagggtatccgtaagggtatctacaaactggaaacggtagacggcagcaaaggcaaagtgcagctgctgggctcaggttctatcctgcgtcatgtgcgtgaagctgcgcagatcctggcgaaagattacggtatcggctctgatgtctacagcgtcacctcgttcactgaactggcacgtgatggccaggattgtgagcgctggaacatgctgcatccgacagaagaagcgcgcgtaccttacatcgctcaggtgatgaacgacgcacctgctgtcgcctcaaccgactacatgaaactgttcgctgagcaggttcgtagctatgtcccggccagcgattatcgcgtactgggtaccgatggctttggtcgctctgacagccgtgagaacctgcgtcatcactttgaagttgatgcatcttatgtggtggttgccgcgctgggtgagctggctaaacgcggcgagatcgagaagaaagtggtggccgacgcgatcacccgattcaatatcgatgccgataaagttaacccgcgtctggcttaagaggtaatagagtaatggctatcgaaattaaggtaccggatatcgggtctgacgaagttgaagtcaccgagattctggtgaaagttggcgacaaggtggaagccgagcagtcgctgatcaccgtggaaggcgacaaagcctcaatggaagtgccgtcgccgcaggctggcgtagtgaaagagatcaaaatctctaccggtgacaaagttgagaccggctcactgatcatggtgtttgatgctgaaggcgctgcggaagcagcacctgccgccgccgaagagaaaaaagcggacgcggcgccagcgccagccgctgctgcggccacggccagcaaagaagtggctgtgccggatatcggcggtgacgaagttgaagtcactgagattctggttaaggttggcgacaaagtcgaagccgagcagtcactgattgtggtggaaggcgataaagcgtcgatggaagtcccggctccgttcgcgggtgtggtcaaagagatcactatttccaccggcgacaaggtcagcaccggttcagccatcatggtctttgaagcagaaggcgcagcaccggcctctgacgcgaagccagaagtgaaagaagaagcggcatcggcacctgccgcggctgcaggcgcaaaagacgttaacgttccggatatcggcggtgatgaagttgaagttaccgagatcctggtcaaagtcggcgacaaagttgaagctgagcagtcactgattgtggttgaaggcgacaaagcctctatggaagtgcctgcgccgtttgcaggtaccgtcaaagagctgaaagtggcgaccggcgataaagtcagcaccggctcactgatcatggtgttcgaagtcgaaggtgctgctccggctgcccctgcggccgcgaaacaggaagctgcaccggctcctgctgccaaatctgaagctaaagccgcggcacccgctccagctaaagcggatagcaaaggtgagttcgcagagaacgacgcttacgttcacgctaccccggtgatccgtcgcctggcgcgcgagttcggtgttaacctggcgaaagtcaaaggcaccggccgtaaaggtcgcattctgaaagaagacgtgcagacttacgtgaaagaggccgtgaaacgcgctgaagcggcaccagctgcagccagcggcggcggtctgccaggcatgctgccatggccgaaagttgatttcagtaagtttggcgaaatcgaagaagttgaactgggtcgtatccagaaaatttctggcgcgaacctgagccgtaactgggtaatgatcccgcacgttacgcatttcgacaaaaccgatatcaccgatctggaagccttccgtaagcagcagaatgctgaagcagagaagcgtaagctggatgtgaagtacaccccggtggtgttcatcatgaaagcggtcgcggcggcgcttgagcagatgccacgcttcaacagctcgctgtctgaagatgcgcagaaactgacgctgaaaaaatatatcaacatcggtgtggcggttgatacgccaaatggcctggtggttccggtctttaaagacgtgaacaagaaaggcatcaccgagctgtctcgtgaactgatggcgatttcgaagaaagcgcgtgacggtaagctgacagcgggcgacatgcagggcggatgtttcaccatctccagcctgggcggcctgggcaccacgcacttcgcgccgatcgtgaacgcgccggaagtcgctatcctgggtgtctctaaatcggcgatggagccggtgtggaacggtaaagagtttactccgcgtctgatgatgccgatttctctctccttcgaccaccgcgtaatcgacggtgctgatggtgcgcgattcatcaccatcatcggcaatatgttgtctgacattcgtcgtttagttatgtaaatgtaaagaaggccggcgtaagccggccttcctgtaacgattcgtcgcgccgcggttggcagtttgttaacaattctgtaaactcttgcggtgaaagtcccggtggaacaagggcattataagaaagtctgacccgccggatatcaattaagaggtcatgatgagtacagagattaaaacccaggtcgtagtacttggggcaggtcctgcaggttactctgcagccttccgttgtgcggatttaggtctggaaaccgtactggtagagcgttacagcaccctgggtggtgtttgtctgaacgtcggttgtatcccatctaaagcgctgctgcacgttgctaaagtgattgaagaggcgaaagcccttgaagagcacggcattgtgtttggccagccatctactgatatcaacaagattcgcagctggaaagagaaggttatcaaccagttgactggcggcctgtcaggaatggcaaaaggtcgtaaagtcaccgtggttaacggccttggcaaattcaccggtgctaacaccctggtggttgaaggagaaggcggcgcgaccaccatcaacttcgataatgccattatcgctgcgggttcacgtccaatcgaactgccattcattccacatgaagatccacgcgtctgggactctaccgatgcgctggaactgaaagaagtgccgaagcgcttgctcgtcatgggcggcggcatcatcggtctggaaatggcgacggtttatcatgcgctgggttcagagattgatgtggttgagatgttcgaccaggttatcccggctgcggataaagacgtggtgaaagtctttaccaagaaaatcagcaagaaatttaacctgatgctggaaaccaaagtgaccgccgttgaagcaaaagacgatggcatttacgtttcaatggaaggtaaaaaagcaccaggcgaagcgcagcgttatgacgcggtgctggtggccatcggtcgtgtgccgaacggtaaaggtctggatgccggtaaagcgggcgtggaagtggacgatcgcggcttcattcgcgtcgacaagcagatgcgcaccaacgtgccacacatctatgctatcggcgacatcgtcggtcagccaatgctggcgcacaaaggcgtgcacgaaggccacgtggcggcagaagtgatctccggtctgaagcactacttcgatccgaaagtgatcccttcaattgcctatactgagccagaagttgcctgggtcggtctgaccgagaaagaagcgaaagagaagggcatcagctacgagacctccaccttcccgtgggcagcctcaggccgtgctatcgcttctgattgtgcagacggtatgaccaaactgattttcgacaaagagacgcaccggattattggtggcgcgattgtcggtactaacggcggcgagctgttaggcgaaatcggtctggcgattgagatgggttgtgatgcggaagatattgcgctgaccatccacgctcacccgaccctgcatgagtcagtcggtctggcggcagaaatcttcgaaggcagcatcaccgatctgcctaacgcgaaagcgaagaagaaataactttctgctactaaagaagaaagctcccgttatgggggcttttttttcgcctggagtttggtgctgtatggcaagaatcgatttgggttaagactaaagttaaccccaataaccctgaaaacgttgcctgtgagagttattagagttatcgtgctttcatcgggacgcgacatgacacagggatggatcgcagcacgttaatttccgaaatgaaggctgatggctgggttttctgacaaggataaacggtagccatcaccatttcacacatccgacaaaaccggggctggttacagtaccccatcctaaaaaagacttaccgatcggtacggtaaagagcatcaggaaacaagcgagaatttaatcccgcttgcccgtagaggtatgaatatgttttatccaatcgcgattgaagcgggtgatcacgaacacgcatacggcgtaatcgttcccgatttaccagggtgtttctctgccggggatactcttgatgaagccattaaaaacgccaaagaggctatcacagggcatatcgaattatgtgtagagctcggtcatgagatccctgccgtgtccaccattgagactctggccacgaatcctgactatcagggttatatctgggcattggttgatgtagatgtcattcgtttgctgggcggctctgaaaaaatcaatgtcactttacccaggtcgttaattgatcggattgatcgttgtgtggcttcacacccggaatacaaaagtcgctcgggctttctggctcaggtagcgcttgagcgtattactgctccgattaacaggcctcaaaagtaagtctgcgcgatagctaaatttattggtggcagaggaatcaaaaggcaccgtttatgagtttttaccccttaagccgttgctatgatctttctcccgtatggtcaggttgatgtctttgatgatgcttttatccagattgataaaaccggcgtaagaatgcatattccggtgaatctggatggactgctgctgattctcttcctgactcttacaaatcagtgagttactgatctttaaatacgtgaatttagtggtgattttttatgagggtaaaatcatcatattttacagccacatacattaagagtgttccccgctttagcggggataaaccacattgatgatggaggtggccagacatctggcctgtgatcccctacgaatgtgaatatcagagtcaggcccgatgaaaaaaaagaacagcactcccacacctcacgatgccactttccggcagtttctctcacagccggacattgcccgcgacttcatggaactgcatctgcccgccgaaactgcgcgctatatgcgacctcagcaccctgaaacttgaatccggttcgttcgttgaagacgatcttcgccagtattttagcgatatcctctacagcctgaagaccagtaacggggatgggtacatacacgtcctggttgagcatcagtctacgccggacaggcatatggcattcaggctgatgcgatacgctgtggcggctatgcaccgccaccttgaagcgggccataagcagctgccgctggttataccggtactgttctataccggcaaacgcagcccttatccgtattcaacacgctggctcgacgaatttgaagacccttcgctggcggaaaacctctatggcagcgcctttccattggtggatgtcacggtgatcccggatgaggaaatcatggggcaccgcagcatggcggcgctgacgctgttacagaagcacatacatcagcgtgacatcgcgactctcaccgatcggctggccacgttactgatggccgattatctttcttcaccccaggtaacagcgctgatacactatttactgcaggcaggcgagtcggctgactccgaagccttcgtgcgcgaactggcacagcgagtgccgcaacacggagacgcacttatgaccatcgcacagcagctggagcagaagggtatcgagaaaggtattcagcttggtgaacagcgtggaatcgagaaaggccgaaatgaaggcaaactcgaggttgcccgcactatgctgcagaacggcatcgaccgtaacaccgtcatgaaaatgaccggtctctcagaagatgaactttcacagatccgtcactgattttgatgtcagaaaacggctcggcaacgtaaagccctgcactacagggcttaacaaatttaatgaaacgcaggcgctgctcatcagtcagtgcgctgacacagtctcccgggttaactgactataattacgagcgtgcttttctgccattcccgaaactcatcacaaagcaattcgactgttatgacaaaattaccggggctcctggcttaaacatcaggataggtggcgctcttgggaggaagcgaagagggctgcagatcagcagggcataaccttcctggatgctaaaattcaggggccggctaaggtctggcttatccctttcactgtttccagtaaacccgataaaacacaatatgggatgctggacggtggcagtctgacattcgaattctcagaagattaggcagcaagctaaccttcatctaaccacgcatctcccatgcagccactcgttcaataaacatctgtgccagggcagtaatggcgctgttgccgggcagtctttcttcattgatatacatcaccagcgaactactgcgtcggcggccctgtaacagcggcagaggacggagctcaccgctttctaactgcgcggtgatattctgttccggcagccagccataacctaactgatgctggaccgcttcaatggctgccgacagcgtcgtgaatgaccagttttctccgcctgatcgccattgacctccgactgctgctgttgctgacgatccagaatggtaatgcagggccagcgtgccagcgtagcagcattaagcggggcggattcgcggtgcagcgggtggtcgcgatgggcgacggcgacgaaatcgacactcatcaggctttcgcctgctaacggcgtgtcaccatattgcgctaccagccagagatcagcctgatgctccgccagtctgtcaggcgtttcgcttcggacgatttcgctaaaccagatgcggacatgcggatagcgttgctgaaaggtctgaagcacatcgaatagcaagggtttgggtagagtcgcatcgaccatcagatcgatgcgcgaacgctcgccgcgttgcagtgcactggcctgcgcctcaagcgcgccgaatccctccagcagcggacgcacctgtgccagcaactgatgtccctctgcactcaggacagcgcggcggccctcctgctgtaatagggtcaaacccagccgctgctgtaacaggctcagctgataactcagtgaggactggctgcgattgttcttctccgctgccagcgcaaaactcccctcattcactactgcgtcgagcagataccactgttcgagtgttgtcttgtacatgataactcatctaaaaattaaatgatttagtgctaaaaatagcgttattaatcggttttgtaacgcgcaataatctcctcaaggaaaacaaatgaggaattaaccatgagcactttcgataaacatgacctgtctggcatcgtcggcaaacatctggtttacacctatgacaacggctggaattacgagctctacattaaaaatgccagcaccatagactatcgcattcacagcggtatggtcggtaatcgctgggttaaaaatcagcatgtctatgtcgtccgtctggcgcaggatgtctataaagtttcctggactgaaccaaccggtaccgatgtcagcctggccgttaatctggctgataaaattttccacggcaccatattcttcccgcgctgggtaatgaataatccggagaaaaccgtctgcttccagaatgatcatctggaagagatggcaaaattccgcgaagcgggtccggcttatccaaccgaagtgattgatgagtttcgcgacgctgaccgtaatccgtgatgtgggcgaaaataacgaaagcgtgatcgactgtccgcctgaccagttgccagcgaattttccggaaaatctgaaaaattaagcatatgcagaagaggtcatgacgacctcttctgaatagcagtttctgtcttgtagcttctgacgtgtaacttgcgagaatgaaaaagagatttaccgaccagggttttatcagtagtaatcagcaggacgaattcggtttcagttgcatcaggctgatttccggcctggtgttgttatcctcctgagctcacctccgctgtaccccataaacacgccggcttctattcctgccagttatctatttccctgaatcacttcgctaaagccacggcaaaactgacataaacctgcagccatttgtgtggaatgcggtacgctgcagagagacccattcagccgactcagctggctgatgcagggagttaagcgggcagagtggccgtagtggattatgttgtatttttgtaaacagattaacaaacagacgaaatactgctattctgccctccgcgaaaccgggcacctcaacctggacgagaaggggaagattgttctccataagtgagcaaggtggtcggaaagccctacataatgagagcgaggataacgtcgtgctagaagaataccgtaagcacgttgccgagcgtgctgcccagggaattgtacctaagcctttagaggcttcccaaatggccgcgctggttgaactgctaaaaaatccacctgcgggtgaagaagaatttttgatcgatttattggtcaaccgcgtcccacctggcgtcgatgaagcggcgtatgtcaaagccggtttcctggcggctgtcgccaaaggcgaagcaacctctcctctgatatctcctgaaaaagcggttgaactgcttggcaccatgcagggcggttacaatattcatccgctgattgaggcgctggacaatagcaaactggctccgattgccgcgaaagccctttcacacacgctgctgatgttcgacaacttctatgatgtcgaagagaaagcgaaagcgggtaatgaatacgcgaagcaggtgatgcaatcctgggcagatgcggaatggtatctgtcacggcctgaactggcagagaagatcacggttacagtgtttaaagtcactggcgaaaccaacaccgacgatctctctccggcccaggatgcctggtcacgtccagacattcctctgcacgccctggcgatgctgaaaaatgcccgtgaaggcattgagcctgatgaagtgggcaatatcggcccgatcaaacagatcgaagctctgaagaccaaaggcttcccgctggcgtatgtcggtgatgttgtcggaaccggttcttcacgtaaatccgccaccaactcggtgctgtggtttatgggcgacgacatcccgaacgtgccaaataaaaaaggcggcggcgtggtgctgggcagcaaaattgcacccatcttcttcaacaccatggaagatgcgggcgcactgcccattgaagtagacgtaaacaacctgaacatgggcgatgtgatcgacatctatccattcaaaggcgaagtccgcaaccacgaaaccaatgaactgctggccagcttcgagctcaaaaccgaagtagtaattgacgaagtgcgcgccggtggccgtattccgctgatcatcggtcgcggcctgaccaccaaagcgcgcgagtcgctgggtctgccacacagcaccgtattccgtcaggcgaaagatgtcgcggagagcacccgtggtttctcgctggcgcagaaaatggttggccgcgcctgtggcgtaaccggtgttcgtccgggtgcctattgcgaacctaagatgacctcggttggctcgcaggataccaccggcccgatgacccgtgacgagctgaaagatctggcttgcctgggcttctcgaccgatctggtgatgcagtcgtttctgtcacaccgccgcgtatcctaagccggtggatgtgagcacgcaccatacgctgccagacttcatcatgaaccgcggtggtgtgtcactgcgtccgggtgacggcattatccacagctggctgaaccgtatgctgctgccggataccgtcggtaccggtggtgactcgcacacccgtttccctatcggcatctctttcccggcgggttcaggcctggtggcgtttgccgccgcgactggcgtaatgccgctcgacatgccggaatcggttctggtgcgctttaaaggtaagatggagccgggcattaccctgcgcgatctggttcacgccattccgctgtatgccatcaaacagggtctgctgaccgttgagaagaaaggtaagaaaaacatcttctctggtcgcatcctggagattgaaggtctgccggatctgaaagtcgagcaggcgtttgagctgtccgatgcgtcagcagaacgttccgctgcgggctgtaccatcaagctggataaagcgccgattatcgaatacctcagctccaacatcgtgctgctgaagtggatgatcgcagaaggctacggcgatcgtcgtacgctggagcgtcgcattgaaggtatggagaaatggctggccgatcctcagttgcttgagccggatgccgatgctgaatatgccgccgtgatcgaaatcgatctggctgaaatcaaagagccaatcctctgtgcgccaaacgatccggacgatgcacgtctgctttctgacgttcagggtgagaagatcgacgaagtgtttatcggctcatgcatgaccaacattggtcacttccgtgctgcgggtaaactgctggatagccacaaaggccagctgccaacccgtctgtgggtggcaccgccaaccaagatggatgcggcacagctgaccgaagaaggctactacagcgtattcggcaaaagcggtgcgcgtatcgagatcccaggctgttcactctgcatgggtaaccaggcacgtgttgcagatggttcgacggtggtttcgacttcgacccgtaacttcccgaaccgtctgggtaacggcgctaacgtctacctggcgtcagcggagctggctgcggtcgcgtctctgcttggcaaactgccaacgccagatgagtatcagcaattcatggcgcaggtcgataaaacggccagcgacacgtatcgctatctcaacttcgaccagctgacgcagtacaccgacaaagctgatggcgtgattttccagactgcggtctgattcttcaccttgcaggcatgaataaggggcgatgattcgcccctttttttcgtctcagcatggggtagagagacgatcaaaagctggctttcggcagacagcctgtaataatgcgcgacgtgtcacactttgccgcgagagcagcacggacacttaccaggtgagacgacgacgttgagaggaacgggcgatggaatatgaatttttacgcgatgtgaccggacagattaaggttcgcatgtcgatggatcatgaagcggtcggccactggttcaacgaagaggtcaaaaacgatccgggattgctggatgaagttgaagccgccattgaagatgtcaaaggcagcgtacgtcagtggcagcggatcggcagcgagtacaccattctgctggatgaagaggaggtgatgatccgcgccaacctgctggctctggaagatgacggtatggaagaggggatgaactactacgacgaagagagcctctcgttctgcggcattgaagattttcagctggtgatcgctgcttatcgccagtttatgaaccagtacggcaaacccgtacggtaatacagaaaggcaatcttttacggttataaggccgggcgaactcagcagcccggcctgttaactaactcagtgatgcaccaccgcacattaccagctgctggccggtgatcgccgccgccgcaggggagagcaggaaatcgaccagcccggccacttcctgcggctgaatatagcggccaatgggtggcagacggggcggtgaactggcacggcccggctgttgcagcatcggcgtttcggtggcgcctggcgccacaatattggcggtaatgccgcgcggagcgagttccgccgcccagctgcgcaccataccgatcatcgccgatttggtggcgacatactgactgcggcccgccgcaccgcctgatgtccggctgcccagcagcacaattctgccgcccacacgcatccgcggtgcaaaatgattcgccagctgctcagcagcggcaacgtgcagttgccataagcgtgcgctggcgttcagatccagctccccaagcggcgcggcctgcatcataccggctgcatggattaccgcctgcggcaccggtagcgcgtccagtaaagcctgcagtgccgcgctgtcgctgatatcgatttgatggctctgccagcccgcttctgcccggcttatcgccgagcgactcaggccgataacctgccagccctcatcgagtaaacggtcagcaatcgcctgaccgatgccggagctggccccggtcaccagcgccatccgttcaatcacgcatcacctcccttcacccatgactccgcgacccgcacatacttaatcgcctgacgataccaggtgtaggcgatatgcagttcgccatccaggccctgtttaatgctgggataagagaactcacggtttaatttctgctgggagttattggtcatgcagtagccatcgccctcgtccagattgcgctgcagcggccagcttttaccgccatccgtggagatagccagcgtcatcggcgcacgaggcgcaccccagaaagcggtgcgaccactgtgcaccaccggctcagcggcgacggcaacatcactttcctcttcatcgtcttcaatttcgtcatacagcgacaaccggcgtttcgctggcaccttcggcgctcatggcattgaacaccagcgccagatgaccattgcgcagcgtcgtgacctgaattgaggagttattgttgggcagcgacaacggctgtggcgcgctccagctttcaccctgatcaagtgagcggctctgatagatgtggtcggcccagcggctgcggtagagcgccagcagcgagccatcatccagcagggttacgttcatatggacgcagccggtgctgtcaggcacgctgacgtcgcgccagctctggcctttatcttctgagatttttaccgcgctcacgtcatagctgccgacccacttttcgccaggctgcgtcaggcagtaaaacaccggcagcaaccagttaccgttgggcagcaccacaatcggctggcgaataaaggtgccaggcttatccagcagcgttttgatctccccccagctctggcccagatcgtgagactggcgatagcgaacaatcgcggtgtcctgattgcccgatttctgcgccgtccacagcagccacagtacctggtcgggatcgagaaacagcaccggattctgttctgaacggcccggatcgtcagagagtttttgtgcttcactccagcgatcgctgccttttcgcagccgtgaacaccagacagagatatcggcaatcccttcctgcgtgccgccaaaccagacgcaaagcagatcgccatcgggcagcggcagcaggttagccgcgtggttttgcgggcaggaggagggcagcatcgcaacctgctgcgcgctatcctgcgggtgaggcgcaagcaggccggtgcgttctgcggtgacggtttcctgagtcattttaggctccactgttttgtgcattgtgttgcgattgaggctgagactggcgtgacgggatacagcggtcaatcaccataataattgccggggtgatcagcgccacgtacatattgtcgataccaaacgggttacccatcaggaaccagacggaagtgacaacgcaggcgccaatcagaccggcattggcgccgcgtgtgctcttaaaccacggcaggtagaacgccatgatcgccacaacggtaatcgacagacgaatcgcacgggtaaagaacgagagcttcagcacttccgggaagaacagaacaaacagcagcgggaagaagccgatgccaatcgagatccagcgtgtcattttaaattcgcgctctggcgtaggattacgataaggcacgtaaaagtctttcaccaccagcgaggcgatggccagcgccacggtaccgacgctgacgaaaatcgaggccaccagcgaggtggtgacaatgcccgccagccacggtgacatatcctgcagaaacaccggcagcgcatagaggctcttgatatccgggtgagcaaacttcgctgccacgccaatcagcgccatcgccagaccaatcggcaggcagaagaagaaggcgacccaggtggcgcgcttcgctgacttcacatctttggtggaggagatcgcctgaatcacaaactgggtacagaagatcgaacctacggtcccgatcagccaggccacaatggtactggcaccgacgtgaccatcccatgtccagtagaaacgccggcattttttccatcatcggggcgacgccgccggtcatcttcagcgccacatagaggataatcaggatccccatatacttgatggcgctgtgcagcagcgtgacccaggccacgcctttcatgccgccaaatgcaaagtagaaggtgctgaccaccgcagtgataaaagccgcctgggtcaggtcgatcttgagtacggtggagatcgccgccgcgccgctgatgtagttaccgacgttcaccagcaacagcgcatagatcatgatcagcgaaataatatttttggtcgaactgccatatttctcggcgatagcaccggaaatagtgatctttccggtgttgtagatgcgtttgaccagtatcaggccaaacagcgggaagccaattgccgcgccaatcaccgaccatgaggcggcgaagccatcttcaaaggccgcctgcgcggtgccgatggtggattttgccccgatatattcagacatcagcataatgccgacgataaaagcaggcatggcgcgcgagccttccataaagtcgccgctggttttactgcgcagccgccaggtgagccaggtggtgaacaggatataggcgaccaccatgccgacgatcagtaaggtgctctcagttgaaaatgctttcatcatgacctcgattgttctggcagatggcgaccatcaggttcgttctcatctgaccggtagggtgcaaaggtgatggacgttattgcaggtagtggttcacgatttgacggatctgctgctgctcttcggcgctgaactgcaccgcatagcggctttcacccacctcaaagccctgcaggctgaccgcttttttcacggcggccggtgagaaaccgatgctgtacagtgcggtgcgcaggccggtgacgttctcctgtgcctgatgcgaaccggcaatatctcccgcatggaagcgcgcccagatggcgttaatcgcctccggtgccacgtttgccagcccggaaattgaggcggagcagccatccacaaaaccctggtggatcagcgaatccgggccgttcagcacagcaaagtcctgacagtcggcggtagcctgcagaaagccgctcagactttcatagctgcctgctgaatctttaatgccgatgatgttcgggtgcgcggccagcgtacgaacggtctctggctgcaaggtattgccggtacgcgccgggatgttgtagaggaacagcggcaccgtaagcgcatcagccacgcgctgatagtggtcgatcagctcctgctgcttaagcggaacaaaccacggcgtgatcgcggaaacagcatctacgccaaggcgggcaatctgtttgccgagccggatagtttcacgggtcgaaatctccccgatatgcgccaccaccgatgcccggccgttaacttcatcgacgcaggtggtggtaaccgcgatcttctcctgctcgttcagcacaaagaattcgccgttggttccgccacagaagatgccgttaccggcgttgatctggcgtctgacctgttcgcgctgcctttctggatcaaaggcaccttcccggtcaaaagtggtgacgatggcggtcagtacgccgtttattttcttattcatgacaatcctcattacgcctggcaggaagggaaaagcgtcaggtagacggcgcgcacatcgtcggcggtgaccgccatcggcacgttgttcatcagacgctggacgtcgagcgcggcttccactaaccagggcaggtgatccgggctgatgcccagtgcttccaggctggcaggcagttgcagccgcgccaccagcgcggtgaagtagtcgaccagcgcgtgtgatttctcttcatcgcttaaacggacgtcggcgtcgggcagcagatcataggcctgagcgaatttgctcaccgccgccggacggacaaagcgcatgcagggagccagcaggatggcgttggcaacgccgtgtggcagatgatatctgccgccgagcgggtaagagagggcatgcaccagatgtgtcccggcatgggcaatcgatgcaccgccataataagaggcccagagcatctccaggcgtgcctgcaaattttctggctcgcgcagggtggtttcgagattagcgaacagtttcttcatcccaatcagcgcatagttgtcgctgaccgggttggcgacattggcggtaaagcactcaatcagatggcagagggcgtcaataccggttgaagaggcaatatgtggcggcatgctggtggtcagtttccggcaccagggccaccacatcgggcagcatcaccggtgaaataatgccgactttggtctctttctccgggatcgccaggatcgcattgggcgtcgcctcagaacccgtgcctgcggtggtagggatcagtattgaacgggtacggcgctgcggtttttcgcctgccagcagggcgtccagcgaaggcgcggcgtcgatgcacagcactgagagtagcttcgtcacatccagcacgctgccgccgccgatgccaatcaccatatcgacctggagccgggagagcgtcgcgataatcgctgccacatcatgctggcttggttcaggcggaacgctgttgaccacgctgatacccggaatctgatcccgaagttgacccatcagcgcctgcactgccggaatcgcctcaatgttccggtcagtgaccacgactgctgtcgatatccccttcagcagatagcgcatgtcgtttaacgcctgataaccgctaatcaccgtgctgttaatgttcatttcatacccttatttctgtcctgtctgagcagatgattaatcttgctcagcgcaatgcgaagtcagtcactctcagtggctaattttataaggcatatcgatttcgattaatttgaacttgctcacatataatcaatcatgattgaatataatcaaatgcggtggcaatcgcctgacaggagtgaggatgggctcatcattatggaaaaccccggtgctggtcatcgccgatgactttaccggtgccaacgatgcgggtagcggactggcacaggctggcgcccgcgtacatgtgctgtttggcacggaggcgccgttgccagaggacgctgcggatgtgctggttatcagcaccgacagccgggcagtcagcgccagccaggccgcagagcgcgtcgctcaggtggtgcagcacttcgccgcacagcttcggcagggctggctgtttaaaaagatcgactccacgctgcgcggcaacgtcggtgctgaaaccgcggctgcgctgcgagccagcggcaaaaggctggcgctggttgcgccggccgtgccacgactgggccgcaccacacgcgaaggtaaagtgtgggtcaatcagcggttactgacagacaccgaatttgccagcgatcctaaaaccccgatcctcagcgcccgcgtactcgatcagatgcagatcgacggcacggagatcgatctcccgacgctgcgcagcgatcggcttgatgcggtgttagcggcggcgcacggcgtggtggtggtggatgccgaaaatgaagccgatctggcgcgactgataatcgctgcggcgcggctgacagagaagccgctgctggtgggcgccgccggattaagcgatgcgctgggcacagcgctctctgttcgcccgtcgcggcccgtgctggcggtagtgggatcgatgagcagcagcgcgcagcagcagatcgccacgctgcttaaccagcgggcagttgagatcgtggatgtcgatatccgtcagctgtttcagcagcccgcctggcctgaccgggatcgctggatcgaacaggctgccgccgcactgcgtgccggtcgccatacggtgatccgcacctgccagcatgaatcccagcgtcacgacattgagcatctcagccagcagcacagcgtgacccgccagcagctgggcgaagcgatcagtctgttgctgggcgaaatgactcacagcctgtgccggacacagctgccgcatgcgctctatctgtcgggaggcgacgtggcgattgccgttgcccaggcactgggggccagcggctttaaaattcagggtctggtggcgggctgtgtgccgcacggggttctgcttaacagtgaatttactctgccggtgatgaccaaagcgggtggctttggtgatgaaaataccctggtagcagccattggttttattgaggagaagtcgagtgagtaaaattattgcgatcaccatgggcgatccggcgggcatcagcccggaaatcatcattaagtcactctctgaaggtgagctgaatggcatcccggcggtggtgattggctgtgccagtacgctgcgccgcattatggcaatgaacattacgccacaggccgagctgcgggtgctggatcgggtgcaggatgcccggtttgcgcccggcattatcaacgtcatcgatgagcctctggccgatcccgacgcgctgaaacctggcgtggtgcagaaagaggcgggagatctggcgtggcgttgcgtgaagcgtgctacagagctggcactggcgggcgacgtgcatgccatagccaccgcgccgctgaacaaagaggcgctgcatgcggcgggccatctctatcctggtcacaccgaattgctggcgcatcttaccgggaccaaagattacgccatggtcctctacaccgataagctgaaagtgattcatgtcacgacccacattgcgctgcgtaagttcctggacacgctgaaccagacgcgcatcaaaaccgtgattggtatggcggacactttcctgcgtcgtgtcggttacagcgccccgcgtatcgccgtggcgggcgtaaatccgcacgccggagagaacggcctgtttggcgatgaggagatcaccaccgtggcacccgctattgaggcgatgaaagcgcaggggattgatgtctacgggccttgtccgccggacacggtgttcctgcagtgccaggatggacggtatgacatggtggtggcgatgtaccacgatcaggggcatattccgcttaaactgctgggcttttatgatggcgtcaacatcaccgcaggcctgccgtttatccgtacctctgctgaccatggcaccgcatttgatatcgcctggacaggtaaagcgaagtctgacagcatggcgatctctattaaactcgcgatgcagctcgcatagggatatatgaagggacagagccgtcttgaccagattatggattacctgaaaagccataatctggtgactgttgagcaactggtcagtgcgatttccgcctcacccgccacgattcgccgtgatttgattaagctggataaagagggcgtgatcagccgcagtcatggcggcgttaccctgaatcgttttattcctgcccagccgaccacgctggagaagatgcagcgtaacctggccgagaagcaggccattgcagaatgtgccgccagctttgtccgggcgggcgatgcggtcgtgctggatgcgggcaccaccatgctggagctggcgcggcagctcacgcatctgccgctgcgggtgatcactgccgatctgcacattgcactgtttttgtctgagtttaagcagatcgaagtgacgattatcggcggacgtatcgacgactccagtcagtcctgtgtaggcgaacatggacggcggttgctgcgcagcatcaatcctgatatcgcctttgtcagctgtaactcctggagccttgagcgcggcattaccacgccgactgaggagaaagcggggctgaaacacgatcttctggccaatgcggctcgccgggtcttgctggcggacagcagtaaatatggctcctggtcgctattctgcgcttctccggtggatgacctgacggatgtggtgaccgatagccggttagaggaggctgtctgccgcacgctgcgcgagcgcgggattacgctggcgctgacctccgcctgaacagaatgcgccgtgttgctctgacctgatcagcaggacgagagcagcaccgcgcgtttatctttatctctcgccgttaaaacgcgccgttaacgcgcgtacgcatcattctcttcgcgcgtagtcacgggtgcgtccaccgaaacccgttcaaacctcagtcaggcggttgccgtgatgaaaaagcagaagtaacaagagggaaggagacgcgcaggttatgatctataacgctgcgcgcctgataatcagagggtcttcaggcccactgaggggatatttctgccgtagtagatctcgcgcatctctttccagagcagatcggtaatgcgcttgtgctcctgcggagtgagatcttccgggcgggtgttaaacaggtagtgtttaaggtcgaactctttcagcaacatcttggtatggaagatgttttcctgatagacattcacatccaccatgtcatacatcgctttcatatcttcagacatgaagttctgaatcgaattgatctcgtgatcgatgaagtgcttcatccctttcacgtcacgggtaaaaccgcgcacccggtaatcgacggtgacaatatctgactccagctggtggatcagatagttcagcgcttttagtggcgaaatgacgccacaggtggagacttcaatgtccgcacggaaggtgcacaggccgcctgccggatggctctccggataggtgtgcacgcagatatgacttttatcgagatgagccaccaccgagttgggcagcggaccggggtgctctgagttatcgatatctttcggatcgatcggctcttcgctgaccagaatcgtgacgctggccccctgcggctcataatcctggcgcgcaatgttgagcacgttagccccgataatggagcaggtctcagtcagaatttccgtcagacggttagcgttatattgttcgtcaatgtaggcgatgtaaccatcgcgttcagcttcagtattcgcatagcaaatatcgtaaatacaaaaactcaggcttttcgtcaggttgttgaagccatgtagttttagcttttgcaatttcgttcacccccttagaaatgcactatcagcacgcggcggataacgcattcaacagatattgcggcagggcaaagctgccggtatggattgctggcgtgtaataacggcaggtcaggccagcggcctcgaaacgcgcctttaaagtcgcggtgtcgagctggcgcagcgccggattatcactcgcccaggcaaaggtcataatgccgccgtagtaggtcggaatcgccgcctgatagaaactgacgtccgcaaagtaatgtcccagcttgcgatggctgttaacggcctcatcctgctgcaggaagcagacgccattctgcgccacaaagatgccattttcattaagggccgctttgcacccggcataaaattccgaggtaaacagactctcgcccggaccaatcggatcggtgcagtcggagataatgacatcaaacttttcctgcgtctgattaacgaagttcaccccgtcatcaatcaccagcgtaaagcgcggatcgtcataggcacccgcgctgtggttcggcagatactggcggcaaaaggtcaccacgcccgcatcgatctccaccatggtaatcttttcgatcccgggatgacgtgacacttcacgcagcattgcgccgtcaccgccaccgataatcagaacgctcttcgccgcgccgtgcgccagcagcggaacgtgggtcatcatttcatggtagataaattcgtcgcgtttcggtggtctgaacgacgccgtccagcgccattacgcggcccatcgcggcattttcgaaaatgattaaatcctgatgcgcagtcttctcacggtacagctctttatcgaccgtgaaatactggccaaaaccggcatgaagggtttcataccacgtttcattgtgggccatggtgctctcctctgatgacatcgccatgaagatgggcggcatatgatagctaacactgaccgtggttgcacggtcaatgtccggctgcagagggaagaatcgttacctgacgtaggccagcaggctcagcgaatcgcgggccagtgacttgcactttttgtcgttggtgatggcgatgccgctgagatcgcgatagctatcttcacccagcgctttcatgttgtagttgctgtagttgcttaaatcccagcggttctgctgagcaaaaaagaccagcgctttgcgaatctgcgcgtccggtaaatcctgatagccacaatcatttttcagatagacgaaaaccgccgtgagatcggccagatcttccgcttcggattcgctcagggcaaaactggtggaggagaagccaaggagtcccgtcagcagcaggatcctgatactttgcttcatagtcattctcttcaatggatattgctaatgacgttagcacagttgctctcaggttttcgattaatttgccgctgtgggctgctgcaccgccttttttcgtcagattcgcacgggtaagacttgaccttcccataaggtcagggtttaggctgtgcgctctgatgccacaaggatgatcaccatgcaacgtcgccatttcctgaaactcactgccgcactgagtgcagccggagcattaccgctctggagccgttcgctgatggcagccagccgtccgctgctgccgattccgtctctgctggaacccgatgccaggggcagctacagcctcaccgcgatgcagggtaccacccagtggaacggcaaagcggtgccgacctggggctataacggcagcctgctggggccggtgctgaagatgcagagtggcaaaccggtgacggtgaacattcataaccggctcagcgaagcgaccacactgcactggcacgggctggaaatccccggtgcagtggatggcggcccgcaggcggtgattgcgcctggcggctcgcgtcaggtctcttttacgcccgatcaacccgccgcaacctgctggtatcacccgcatctgcatggcaaaaccgggcatcaggtggctcaggggctggcgggactgatcctgctggaagataaagagagcggaacgctgcgattgccctcgcagtggggtgtggatgatgtgccgctgatttttcaggataagcaactgaccaaagatggcagccgcattgattatcagctcgacgtgatgcgcgccgcggtgggctggtttggcgacatgatgctgaccaacggcatgcactatccgcagcatgcggtgccgcgcggctggctgcgtctgcgcctgctcaacggctgcaatgcccgttcgctgcatgttgccgccagtgataaacgtcctctctacgtgatcgccagcgatggtggcctgctggccgagccggtaaagctcgactcgctgccgatcctgccgggcgagcgttttgaggtgatgatcgatacttctgacggtaacagcttcgatctggtgacgctgccgacagagcagatgggcatgacgctgccgccgtttgaccagccgctgccgctggtgcagatcctgccgctgcgggtgatggccagcgccacgctgccggatcagctggcgacgctgccagcgctaccctcaaccgacggcctgacgacacgctggctgcagttgatgatggacccgcagctggaccagcagggcatgcaggcgctgatgcagcgctacggcgagaaagcgatgggcaagggcggtcatcacacgatgtcgcagacgccggaggagaaaacgacggcagagccgatgccgcctatggaaagcatggatcacagcatgcacggcaatacgccgcccgccggttacgatttccgcaacggcaataagattaatggccaggcctttgatatgacgaagccgtcgtttgcggtgaagctgggtgattacgagaagtggacgatttcaggtgaaggcgatgcgatgctgcacccgttccacattcacggcacccagttccgtattctttcagaaaacggcaaaccgccagccccgcaccggcagggctggaaagatatggtgaatgtcgacggctggcgcagtgaagtgctggtacgcttcaactatgtcgccgccgcagaaacacgcttacatggcccactgccatctgctggagcatgaagacaccggcatgatgctgggttttaccgtcagctgattacgcctgctccagcgccagcttcacatcttcaatcaggtcgccggcgttttcgatgccaatcgacagccgcaccgtggcgtcagtgatcccaatacgctgacgcaccgcctgcggtacgccggagtgggtggtgctgccaggatggctggccagcgactcggtcccgcccaggcttaccgcctgcttaaacagcgacagcgcattaagaaaacggaacgcagcgggctgatcgccgacgatatcaaatgagaaggtcgaaccggcaccgctgcactgctcgcgataggttttcccttcggcgctctccgcatccagatagggcagccagtgcagcttcgccactttcgggtgatcgcgcagaaacgccgcgaccgcttccgcattctgccaggctttctccatgcgtagcgacagcgtttccagcgagcggctgagcatccagctggagtgtggatccagctgcgtgccgattgcgctgcgcagggcgcgcactttcgccatcagcgctttactgcccatcgccgcgcctgcaatcaggtcagagtgaccgcccacatacttggtcagcgagtagagcgacaggtcagcgcccagcgttagcggctgctggaacagcgggccgagcagcgtgttgtcacaggcgataatcggtcgtgaaccctgctgctgatcaatctcatcagcgatacgcgccatcagacggatattgaccaggctgttggtgggattcgctggcgtttcaatcaggatcaccgctacccggccctgggccatcgcctgctgagcggcttcacgcactttgacttcatcattgccgtcgctgaaacccaccgctttgatgtccagattgtgcagcgtcttgctaagcagggtttcggtgccgccatacagcggctgggaatgcaggatcacctcgcccggacgggcaaacgtcagcagggcagtggagatggcggccataccggaagagaagagcgaacagctctccgcctgctcatagaccgccagccgatcttctacaatttcgctgttagggtggttaaagcgggaatagaccagcccacccgatttgccttccggcggctcacgtcggccagagacgtaatcaaagaaatcccgtccctcttcggcgctgtcaaagacaaaggttgatgtcagaaacaccggcggcttcaccgcaccctcagagaggcggggatcatagccatagttcagcatctgggtttcagggtgcagcggcctgtcgccgatatgcgtttttttgcttgaagatgaagtcattgtgatctccggccagcggcgcgagtagggtaacgatctgttggataaaggctaccatgcagcgaatcatgctggtaaatgccagaatgttctaaggtaatgcgcatttcagcgagccgcaggcggcgggtaataattttcgcgacgtaatcgtttgcttatggggccgcgcagccgtcgctgctgcgtctgtgatagactccggggcttttctgacgtaaccgggctgaacgcaatgaaacacactgttgaagtgatgatccctgaacaggcaatcgccacgcgcatcgctgaactgggcaaagagattaacgaccactaccgcgacagcggcagcgatatggtgctggtggggctgctgcgcggctcctttatgttcatggctgatctctgtcgcgccatcgatgtgccgcatgaagtcgactttatgacggcttccagttacggcagcgggatgtccagcacgcgtgatgtgaaaatcctgaaagatctggatgaagacattcgtggcaaggatgtgctaatcgtcgaagatatcatcgactccggcaacaccctgagcaaagtgcgtgagattctgcagctgcgtcagccaaaatctctggcgatctgtaccctgctggataagccagagcgccgtgaagttgaagtgaacgtcgaatatgtcggctttgcgattccggatgagttcgtggtgggctttggtatcgactatgctcagcactatcgccatctgccttatattggcaaagtggtgccgctggaatcctgataccgctctaccgcacattcttccaaggcctgcacctgttgcctggtgtaggctatgccgcgctttacgctgcgatcggctcaggcctcgccgttcttccgcagattagcaatgccgtggcggtagcgctgttcgaggatctcccggctgtttgccgtcacatcaaggttacgcagacagccgtcctgaatgccgtatacccagccgtgcagggagacatcctttccgcgtttccaggcagattgcagtacggtggagtgccccaggttatagacttgttcaataacgttgatttcgcacagtttgtccaggcgcttatccggcgggagttcccccagcaacacgctatgcttgtaccagaggtcgcggatgtgcagcagccagttgtcgattaatcccagtttccgggttatccatcgccgcctgcacgccgccgcagccgtaatggccgcagacgataacgtgttccacttccagcacttcgatagcgtactgcaccacggacagacagttcaggtcggtgtggatcaccagattggccacgttgcggtgaacaaagagttcgccgggttccagtccggtcagacgttcggcaggaacacggctgtcagaacagccaatccacaggaagcgcggtttttgtgcctgggcgagccgctcaaaaaagctgggatcttcttcaaccagtaattttgaccattcgcggttgtttctgatcagggtgttgatgtctgtcatggtgttgagcgaccggttactgcgcagagtgcgcgcgcgtactatatgacagggcctgataaatttaaacggcattgcaatgccatcaaaacagggtatggatgcagaatgacttatgcactggaactttcccggctgaccaagacctatcccggcggcgtgcaggcgctgaagggcatcgatcttaacgttgaagcgggtgacttttatgcgctgctggggccaaacggtgccggtaaatcgaccaccatcggaattatcagttcgctggttaacaaatccgagggcagcgtgcgggtgtttggctacgatctcgaaaaagatgtggtgaatgccaagcgccagctcggcctggtgccgcaggagtttaacttcaacccgtttgagacggtgatgcaaatcgtcgttaatcaggcgggttactatggcgttgagcgtcgtgaagccaatgagcgggcagaaaagtatctgaagcagctcgatctgtggggaaaacgcgctgaacgtgcacgcatgctttccggcggaatgaagcgtcgcctgatgatcgcccgtgcgctgatgcatgagcctaagctgctgattctggatgaacccactgctggcgtggatatcgaactgcgacgctcgatgtgggtgttcctgaaagatctcaatgccaaaggcacgaccattattctcactacccactatctggaagaggcggagatgctgtgccgcaacatcggtatcatccagagcggtgagctggtggagaacacctcaatgaaagggctgctctccaagctcaaatcagaaacctttatcctggatctggcaccccgcagtccgctgcccacgctggaagggttccagtaccggctgaccgatacctcaacgctcgaagtggaagtgctgcgtgagcaggggctcaacagcgtcttcagccagcttagcgcgcagggtgtgcaggtgctgagtatgcgcaataaagccaaccgtcttgaagagctgtttgtgggtctgacgacgcagggaaaaacaggagcaaaagcatgacacatctctactgggtggcgctgaagagcatctgggccaaagaggttaaccgtttcgcccgcatctggatccagacgctggtgccgccggtcatcaccatgacgctctatttcatcatttttggtaacctgatcgggtcgcgcatcggtgaaatgcacggcttcagctatatgcagttcatcgtgccgggattgatcatgatggcggtcatcactaacgcctatgccaacgtggcgtcgtcgttcttcagcgccaagttccagcgcaacattgaagagctgctggtcgcgccggtgccgacccacatcattattgccggctatgttggcggcggcgtggcgcgtggtgtctgcgtgggtattctggtgacggccatctcgctgttctttgtgccgttccacgtgcattcctggacgatggtggcggtcacgctgctgctgaccgcgattctgttttcactggcaggtctgctgaacgctgtttttgcgcgcacctttgacgatatcagcctgatcccgacctttgtgctgacgccactgacttatctgggcggcgtattctattcactgagtttgctgccgccgatctggcaggctgtctctaaacttaatccaatcgtttatatgattagcggattccgttatggcttcctcggcattaatgatgtgccgctggtgtttaccctttcggtgctggtggcctttattctggtgttctactggctggtctatgcgctgatacagcgcggacgcggattacgcacctgacgttaagctgaatggtaagggccacgctgcgataagggcgtggcttttttttgggcggagagcaaatcacgctgactacggttctgcctggccttaaaaatcaccttaaaacccgcctcattcgttatattttgcctctgaagccgcctgacgcctcgcttacatccttactcacaaaaaataaccctaagtattatctgataatactctgacatctttcgctatctgaatgattcttaactattaaatattttttaagaatagccttaaagtctggctgttgtttatttgattatgaattatcagaatagcgccggaataaggttattcctctgctcagggacgaatgagtaggctaagagtcttcttaataagaaaaatggcaaccgaatcagggccagtttttaatcaaaggcaggaaaagatgaatcgtataacgtggatcgataatctgcggggattgagtattctcgcaatcatttttttgcacagcactattgccgtacataataacgccggacattttaccgccttcagcggcctgttaaatgagatgctggcaccggtaaggctggggctgatgttctttgtttcaggtttatttgtcgatgccgggttaagaaaaggcctgggtcctttttttaataacaaggtgcgcagtattctctatccatttgtggtctgggttgcagtctacggcgggttgaaaatcctgttcagctcgatggctaatacgccgcaatcaccgatgaatattattctctcccacctgaccggtggcggtgatatgacctggttcctgcattcgctgtttatcttctttattgcgattatctttgcccgtcacttgccgttcctgctggtgtttgccatctgtatgacgctgagctgggcgctgccagcgattgaggcggatggggtgtttgccagcttcgacaatacccacatcaataaatcgctttatctgtttgtattcttctatctcggcgattacgtcgtgaggaagcaggtggatatcgcggagaaagtgcagcatggcccgacgctgtttatctcagtaattagttttgtgctgctctcctgcctgaatatctttgtgctggaacgtcattcccaggcgttattgtcaccgctggcactattatcggttccgttctttgtctggattgcgctgaaactgaagtctgaactggtctactacattggcgtcaattctatcgtcttctacctgtcgcattatctggcgattcagttcttcagtaagattgtgaagtttgaaagcccgtcagcctgggtaaatgacctgaagtttatttcggcattcctggtggcgctggcgttaccgtggacattatgtctgatgagaaaacgcggctggtttaatttcctctttacgatgaaaaagtcatcgaagccgatgacaaccaaaccggtttaattactgcagcagaaataaaaagggccacccgttttaccggcggcccttttttaatcaggttttaatcaggcaatctgcaccggcagcgctttcgccagacgcttcatctggttgtcaccttcaaaataggcgaccttaggctgccactgacgcgcctcggcatcgtctacctgcacataggagcagataattaaaatatcgccttcgcaggcgcagcgggcggccgcaccgttgactgagatgattttcgagccacgctcagccgcgatagcgtaagtggaaaagcgctgaccgttggtgacgttataaatatcgatcgcttcatattgcagaatgccggaagcatccaggaaatcctgatcgatagcgcaggaaaccttcataattgaggtccgcctgcgtcaccttcacgcggtgcaatttgccttgcagaactgtgcgaatcatagccagaaaccttgtcagagaaataaaataacctgcagcgggatgaattactgcgtcaggtcaacggtttgattatcaatcaggcgggccttgcccagccaggcggccatcagcaccaccgcgcgctggctgtccaccgtcagcggttgcagcgtttccgcatcacagatcgccaggccatcaggacgcaatccctgcgccagcagtgcctcactggcaacctcaatgatctcgtcaatatgacgctcgccattctccagccgcgtcgccatctgatgcatcacctggctcaggaccggagccagcttacgctcatctgccgtcaggtagccgttacgcgaactcagcgccaggccatctttagcgcgcaccgtaggcacaccaacaatctcaatgtcgaagcccatatcggccaccatcttacgaatgatagccagctgctgaaaatccttttcaccgaaacaggcaatatcgggctgtaccagattaaacagtttgctgacgatagtggccacaccgcgaaaatggcctggacgtgtggccccttccagcagggaagagagcaccggcacctcaacaaaggtctgattctgcgcgccctgcggatagacttcagcaggtgagggggcgaagaccacgtcaacctggtggcgattcagcttttcacaatcttcctgcagcgtgcgcgggtagcgcgctaaatcatcggcgcgatcgaactgcatcggattgacaaagatcgagacaatcacgatgtcgccgcgcgcccgtgcttcatccaccagcgtcaggtgaccttcatgcaggttgcccatggtcggcaccagcgcaatgcgtttaccctgctggcgccagcgtcggacttcctggcgcagcatcagcagcgtttcaatgatcaacacggtgactctcctggattactggaaactgtgctctgccgccggataggttccggcctcgacttcggcgatatagtggcgaatcgccgcgcgaacatcgccggtctccgccaggaaatttttggcaaatttgggaatgtggccgccggtcacgcccagagcgtcatgcatcaccagaatctgaccatcggtgacattgccggcaccgataccgatcaccgggatggtgagcgcgtcggtaatccgctgcgctaccgacaccggcacacactccagcaccatcagctgtgcacctgcggcttccagcgccagcgcatcggccagcaactgctctgcaccggcttcatcccggccctgtactttatagccgccaaagatattgaccgactgcggtgtcaggcccagatgaccacataccggaaacggcccgctcggtcagcatctgcacggtctcagccagccagctgccgccttccagcttcaccatgttagcaccggcacgcatcagctgcgcggcgttgtcaaaggtctgctgtggcgtggcataactcataaacggcaggtcggcgagcagcagtgcctgtggtgcgccacggcgcacggcggcggtgtgataggcgatgtcgctgaccgtgaccggcagggtggaatcatgcccctgcaccgtcatccctaaagaatcaccaaccagcagcacctgaataccttcatcggcaaacaagcgggcaaaactgaaatcgtaggcggtcagggtcgcgaattttttaccgctggctttcgcctgacgcagatgtgaaatcgtggtgggtttcatggcgctctcaactcaggaattctgatgggcgcagtttactggatagcgtgaaagagcggaatcagagatgtgcgtttgtctgctcagccgtgccacagcacgatgctgctactgtcgaggttagccaggattgtgctgagtgcgcgaccgtcgggcaggcgggcgtctggcgcaatcgccagcaggggcaccagcataaacgcacgattcagcagatcatagtgcggcacaatcagccgctccgtgttgatttgcatctcgccaaacagcatcagatcgatatccagcgtgcgcggaccccagcgttctgccttgcgcacccggccatgctcccgctcgatccgctgggtatggtcaagcagcgcttcggcactgagatcggtctccagcgccacggcggcattgagaaaatcgggctgatcgggcgggccataaggcggcgtgcggtagaatggcgaggtagcgatgcgttgcgtctgcggcaacgcatccagtgcggtcagcgctgcatcaacctgatgcagcggatcggccagattactgcctaacgcgaggtaaacccgtgtcatgagacgttctggttgtcacgacgcggtgcggaaggacggcggcgcggacgacgcgatttattacgcggcaccggatcgtcacccaggttattgagcatgtttttctgatgcggcggcgcagccacctggaattcaccccaccactggctcaggcgcagcagttccgggttattttccacttccgcccgcagcgccagcagatcgtaagcggcgcggaatttcggatgctccatcagtttccaggcgcgtttaccgtgacggcgggacatgcgtaactgcagcagccagatatcgcgaattagcgacgtaatacgtttcggaatcgccagcgcacggcaggcttcgtccagcgtatcgttcatcgccatcgcaaaagcttcgaagtaggtcaggccactctcctgcgcaatgcgttctgccgtttcaagctgcggataccagaacatcgcggcaaacaggaacgccgggttaacgcgcatgtcgttgtgaatgcggttatcggtgtttttcagcacctgcgccagcatccgctccatgtggctatcgctgttttcggtgaagttgcgcgccagcgtcgggaacaggggctggaacagctgatattcacacagcttgagatatgtgctgtagccgtagccagcctgcaacatcttcagcgactcttcaaacaggcgagcaggcggaatatcacgcaacagcgaggccagacgtggaatcggctcggcggtttccggcgcaatgctcatattgagtttggcagcaaagcgtgcgacgcgcagcatgcggaccggatcttcgcggtagcgggtttccggatcgccaatcaggcgaatgatgccctgttcgagatcgctgatgccgccgacatagtcacgcacgctgaaatcagccacgctgtagtagaggctgttgatggtgagatcgcgtcgctgggcatcatcttcgattgagccgaagatgttgtcgcgcagcagcatgccgctctgggcacgctgcgagctgttgcgatcctcttccggctcttccgcctgatgatgtccacggaaggtggcgacttcgatcacttccgggccaaacatcacgtgcgccagacggaaacgacggccaaccaggcgacagttgcggaacaacttacgcatctgctcaggcgtggcattggtggtcacgtcgaaatctttgggtttttgccccagtagcaaatcgcgcacgccaccgcctaccagataggcttcataaccggctttgttcaggcgatagagcactttgagggcattttcgctgatgtctttacgtgagatggtatggctttcacgaggaatgatggtcatcagacgctctggttcaacctctgctggggcttcctcttcatcacgcttcaggactttccggcaaaaattagctactcgggtaaaaatgggacacctcgacagtggcaattagggtgtaggtaaaatcagcggctaatcatagcctgttgagaaccgtttgagaatgctgttgtctatgcatccggtttcagggcgttctcttgcggcatcaaagcgatattccactgcgacaccgcatcagacagcagtttgtcctgcgttaagtcctgccagccgcctgaaaccggctgtccgaggaagcgtaacgccgccaccaacaggggtctggcatcgccatccggcagcgcaggtgcatgattctgcttcgacaacttatgaccatcgtggttaagcgccagcggcagatgcagccagtcaggcactggccagccaaattgctggcagagcgcaatctgtcgcaccgtcggctcaatcaaatctgcgccgcgaaccacttcggtaatgccctgaaaatgatcatcgacaacgaccgccaggttataggcaaacaggccatcacggcggtgaataataaaatcttcctgtgccagacgcctgtccgcctccacacggccacgcagacgatcgtcaaacgcaaagaccggcgcatgctggcgtaaacgcagcgcggcattctccggtccgcgttgccgttcacggcagtaaccatcatagaaaccgccaatctgctgaatgcgacgccgggggcaggtgcagtaatagctttgacgatgctgctgcagccaggccagcgcgtcacggtaggcctcatgacgttgtgactgccacagaaacctcgccatcccactctaaaccgtagtgctccagctgatgcaggatacggctggcggcacccggtacttcccgtggcggatcgatatcttcaattctcacccgccagacgccgttttgcgcacgcgcgctcaggtaactgcccagggcagcaatcagcgatccgaagtggagttcaccagagggagaaggggcgaagcgaccgatacaggaggatgacataggtttcagaagtgaccacgcagcggacaaaacagcagttgttccactgcgtggtaacaggctggacgcggcatcagccggccatttgtttctcacgaatttctgctaacgtcttacagtcgatgcagagatcggcagtaggacgggcttcgagacggcggataccaatctcaacgccacaggaatcgcaatagccgaagtcgtcatcttcaactttcttcagcgtcttctcgatctttttgatcagtttacgttcgcgatcgcggttacgcagctccaggctgaactcctcttcctgcgcggcacggtcaaccgggtccgggaagttagcggcttcatcctgcatatgagaaacggtacgatcgacttcgtcccgtaattgattacgccaggcttccagaatcttgcgaaaatgggtcagctgcgcatcattcatatactcttcgccaggcttcacctgataaggttcgacgccagcaatagagagaatactcagggacgatgttttacggttttgaccttcttgcatgttgcttctcctggataacacgcactatacccttcgaatttcgtctcgcaggggccttgctgccagcctgcatttgacgtctgcggggtacatcgatcccccattggggaaaaaaacaggccgctataaataacagaagcagtcagggttggcaattcttcatgaacacaccttgacaagcctgtgaggaacagcgtaattggcccttagctcagaacattcttaacacataaaattgcaaaagatattacaaggttacgttgatcggcgatttaagaaacattccctccgccgataagtctgcctgatacgctaaaacctctacgccctcctgctgcgcctgagccagttgttctgcatacgccacatcaatgtgccgtgccggggaaacgtcctcaatccccgagtgcaaaacggcaaacaacaaaacggcccgatgaccctctgccgcaactgttgccagttcacgcaggtgtttctgtcctcgaatcgtcaccgcatccggaaaatacccttttccatcatgtagaagggttacggatttcacctcaatatagcagttgcgccgggcctctgctttgagcaggaaatcaattctgcttttttcagtgccatatctcacttccgcctgacgatgcgtataaccggccagcgccggcagccgttcctgctccagcgcctcagccaccagttggttggcgcgcagcgtattcacgcagatccagtggccctgttgtgtttcggtcagctcccagctgtgggggtatttgcgcgtcaggctgtcggacgtcgagtaccagacgcgatcgcccggcgtggcgcagccggtcatggcgccggtattggcgcagtgaatcgtcagaaacgtcgccctctggcgtcaccacatcggccaaaaaacgtttgtaacgggcaatcagacgggcgggtttaaggggcggagagaagtgcatgtggatcctgagaatgtaatggccagctagccagggcgcgatagcgggtgcggccccgggcatattcagaggcgaacagagaaaaggtggagacgcgaaaacgccagtgaaagccgcgcggcggtaacgtcaccggctgcgtggcgtggcgtaacagcgtgatgtgcggatgaaacggctgggggctctggtaacagccatgccgggcggcctgggcccgcagcaggctggcgagctgcaacagaccgcgtggcgcgcgctggcagccgagccagaccacgccggggcgcggccagtgtccggcatcatccaggtcgagatcaaaaccgggctgcacaatacgggaggccagcgtctgcaggcgctgtgaggtttccggcgcaacttcacccagaaacgccagcgtcaggtgcagattcgccgcgaccaccggctggcccgcctccgcaggaaaggtatcggcccgccagcgcaccagctcttgctgcatctcgtcaggcaggctgatggcaaaaaataagcgttgtgtcgccatggcgctctccggcaaatatcacggatggatgctacaatgcgcgccatcttagcacaggcagaagcggagtttgctgtgagcgatttaccggtcagcgcggtgctgcctgacatcctggcggcgctgagtgacgccccacaaatcctgctggccgcgcccacgggggcaggcaaatcaacctggctgccgctgcagttgttacagcaggcggcgctgccgggacggatcatcatgctggagccacgtcggctggcggcgcgtaatgtggcgcagcggctggcggagcaactcggcgagcagccgggtggcacggtgggattccggatgcgtggcgaaagctgcgtcgggccgcagacccggctggaagtggtgaccgaaggcatgctcacgcgcatgcttcagcacgacccgatgctggaaggcgtgtcgctggtgatcctcgatgaatttcacgagcgcagcctgcaggccgatctggcgctggcgctgctgcttgatgtgcagcaggggctgcgcgacgaccttaaaatcatgctgatgtccgccacgctggacaatgcccggctggcggcgctgctgccggatgcgccactgatcgtctcagaagggcgcagctatccggttgagcgacgttacgcgtcactgaatcagaatgtgcgttttgaagaggcggtcgcgcgtgaagtcgcccagctgctgcgggatgagagcggttcgctgctgctgtttctgccgggtgtggcggagatcgaacgggtgaagcgcgagctggaatcacgcatcagtgacgacgttgatctgacgccgctctatggcgcactgccgctggcggcgcagcgccgggcaattctgcctgctgccgacggccgccgcaaagtggtgcttgccaccaatatcgccgaaaccagcctgaccattgaggggattcggctggtggtcgacagtgcgctggaacgcagcgctctgtttgacgcccgcagcggcgtgacgcgtctgcagacccagcgaatcagccaggcatcgatgatccagcgagcgggtcgcgccgggcgactgatgccggggctctgcctgcatctggtgccgcaggagcaggcatcacgagcggcggcgcagagtgaaccggaaatcgttaacagcgatctctcgtcactgtggctggatctgctgcagtggggctgtacccagccgcaacagctgcagtggctggatcagccgcccgccagaaatctggatgcggcgcagcagcagctgacccgactgggagcactggacaacaacggcctgctcaacacgctgggacggcgcatggcgcagctgggatgcgatccccgactcgccgccatactgtgtgccgcaggcgatgagccggatgcggtcgccagcgccacgctgctggtggcgattctggaagatcctccccgcagcggcagcgccgacctgcgtgatgcgctgcatcggccgcaggcgcaatggcagcggcgggcgcagcagtggcagcagcggcttaaaatccgtggcgggcgcatcgatgaagatcgtttcgccggattgctggcggtgggctttggcgatcggctggcgcggcgacgcgatcagagtggtcgctatcagctggccaacgggctgggcgccagactcgatgagcaggatggcctgacgcgtaatgaatggctgattgcgcctgctctgttgcagggcagtgccacaccggatgcccggatgttgctggcactgccggtcgatattgaaacgctgtgccagcagcagcccgccctgattgagcgccggaccgaagtagagtgggacgaagagaaaggcacgctgcgtgctttcagacgtgagcagattggcgcgctgatactgaaaacccagccgatggcgcgcccggaaccggaggtgctgcacgcggccatgctgcgctggatcgtcgaaaaaggtctgtcggtactgggctggacaccggaggccgaacagctgcgtctgcgaatccagtgtgcggcccggtggctgccggaagagagctggcccgcgaccgacgatgaaacgctgcttgagagcctgtcgcagtggctgttgccgcagatgtcagcggtacgcgatctccgcagcctgcaggcggtgaacctgaccacggcactcttacatttactcacatggtcacagcgtcagcggctggatactgtgctgccaactcattacactgtgcccaccggaagccggctgccaatccgctacgatgcggagaagccgcccgcgctggcggtaaggattcaggagatgtttggcgaagcgcagaatcccaccgtggcggaaggacgcattccgctggtgctggagctgttatcgcccgcccagcgcccgttgcagatcacccgcgatctggcggcgttctggcgcggtgcctggccggaggtcaggaaagagatgaagggacgttatcctaaacatccctggcccgaggatccggccaccgccttgccaacaaggcgaaccaaaaaaatgtccccgcagggttgagtccgctggatcgaattcagagggttctgccatgcggcacgcgagaaagcagttagagtagcggcgctgccgtaagcactgcctggagaagaaaagtaatgtctgggaacgatcgcgaaccaatagggcgcaaaggtaaaccgttgccgccgcgcagcagtgcgggccggggacgacgcagggatatcgaacaggatatcgatcaggacgattttaatgatgacgaggaggaagcgccggtgccacgtaaaggtaaaggtggaaaaccgccgcgcggcaaacgccgttggctgggatgggtaatcaaactgttcctggtgtttgtggtggtcatggccgcgtggggcatctacctcgactcggaaattcgcagccggattgacggtaaagtgtggcaactgcccgccaccgtctatggccgcatggtcagcctggaacccggcatggcctacaacaaaagtgaaatggtggcgctgctggaaggtactcagtatcgcgaagtctcccgtattacccgccctggcgagttttcggtgaagggcaacaccatcgatctgctgcgtcgcccgtttgatttccccgacagtaaagaggggcagatccacgcgcgcatgagcttcagtaaagatgagctgagcgagattaaaaacctcgaaaccggtcgtgattttggctttttccgcctcgatcctcgcctgatcaccatgctgcagtcgccgaacggtgaacagcgactcttcgtaccgcgcgccggtttcccggatctgctggtcgatacgctgatcgccaccgaagatcgccatttctatgagcatgatggcatcagcccttactccattggccgcgccttcctggcgaacatcacggccgggaaagcggtgcagggcggcagtacgctgacgcagcagctggtgaagaacctgttcctcaccaacgagcgtttcgctgtggcgtaaagcgcgtgaagcctacatggcggtgatcatggatgcgcgctacagcaaagatcgcatcctggagctctacctgaacgaggtctatctcggtcaggctggcagcgatcagatccgcggtttcccgctggccagcctctactactttggccgtccggttgatgagctgagtctggatcagcaggcgatgctggtcggcatggtgaaaggcgcgtcgctctataatccgtggcgtaacccgaaactggcgctggaacgacgcaacctcgtgctgcgcctgttgcagcagcagaaagtgatcgaccaggagctgtatgacatgctgtcggcccgtccgctgggcgtgcagccgaaaggcggcgtgattacgccgcagccggcctttatgcagatggtgcgtaacgagcttcaggcaaaactgggcgacaaggtgaaagatctctccggggtgaaaatcttcaccacgctggatccggtgtcgcaggatgcggccgaaaaggcggtgatcgatggcattccgacgctgaaaaaacagcgtggtctgaaagatctggaaaccgcgatggtggtggttgaccgtttcagcggcgaagtccgcgctatggtcggcggtgccgatccacagtatgccggttacaaccgcgcgctgcaggcacgtcgctctatcggctcactggcgaaaccggcgacttacctgaccgcgctgagtcagccaaacagctaccggctgaacagctggatcgccgatgaaccgattgcgctgaaacagccaaacggcagcatctggaaaccgatgaacgacgatcgtcgcttcagcggcaaagtgatgctggtagatgcgctgaccaactcaatgaacgtgccgaccgtaaacctcggcatgacgctggggctggatgcggtagtggatacctggaataagctgggcgtgccgaaagagcagctgcatccggtgccatcgatgctgctgggtgccttaaacctgacgccggttgaagtggctcaggcgttccagtcgattgccagcggcggcaaccgcgcgtcgctgtcagcggtgcgtttcggtgattgcggaagatggcagcgtgctctatcagagctatccgcaggcgcagcgtgttgagccggcgcaggccgcttatctgacgctctacaccatgcaacaggtggctgaccacggtaccgcccgtgcactgggcgcgcgtttcccgaatgcgcatctggcgggcaaaaccggtaccaccaacgatctggtggacagctggtttgccggtattgatggtaaagaagtggcgatcacctgggtgggacgcgataacaaccagccgaccaaactctatggtgccagcggcgcgatgcagctctaccgtcgctacctggacattcaggccccgatgccgttacagctgacgccgccggaagatgtgtcgctgatgaatgtggattctgccggtaactttgtctgcggcacgggcagcagcacctggcgttctctgccagtgtgggcgctggatccgaatgcgctgtgtcagcaacagcagcagcaggttcagcagcaacaacagctcttcgatcagcagcagcaacaacagcaacagcagcagccgcaacaaccggcccagcaacagcaggagcagaaagatagcgacggcgtagcagggtggataaaagatatgtttggcaaataaatcagtcagacaagttaaaaagggcgcttcggcgccctttttttgttcctgatcaatacgcgtcaatcggcctgcaaacggcgtcactactgggatttcttcttgcagtgcctgctgaatttcgcatattatctaagcgttataataatcattatcgtttcgattcgcctgcctgagcctattgttaagagacacttttatgaatgcgcgaacgactttttctgacaacaccaaaaaaacattttcccgaccgcttctgggcatcatgatctcactgagcctgagctcctctctttacgccgcgcagacggagacgatggtcgtctcggctgatggcggcagcggcgtcgaggcggaaagcgcctggggaccagcacccaccgtggcagcgaaacgcagcgccaccgggaccaaaactgatacccccattgaaaaaaatccgcagtccatctccgtggtcacccgtgaagagatggagatgcgtaacgtaaccagcgtgaaaggggcgtttaactacacgcctggcgtgctgaccggtaaccggggcagctcagacgtgattgatgcgctgtcgattcgcggtttcagcgaaaccaacaccaatcagtatctggatggtctgaaactgcagggtgataactactctgagtttgccatcgatccttacttcctggaacgcgctgaactgctgcgcggcccggtttcggtgctctacggtaagagcaatcccggcggcgtggtctcgctggtgagtaagcgtccgacccaggaaaccctgcgcgaagtgcagttccagatgggcaacgataacctcttctcgaccggctttgactttggcggcgcgctggacgacgacggcgtctacagctatcgcctgaccggccaggcgcgcagtcaggatgcgcagcaggcgatgaacaaagagaagcgctacaccatcgcaccggctttcagctggcgtcccgacgatcgcacccgcattgacctgctgacctatttccagaacgagccagaaaccggttattacggctggctgccgcgtcagggcacggtggtaccgatcacccgcgccgatggcagccagtacaaactgccgaccaactttgatgaaggcgagcagagcaacaagatttcacgcaacaccaaaatggtcggttataacgccgagcacagctttaacgacacctggacgctgcgccagaaaacctgcgttatgccgacctgcgcaccgattaccgcagcatttacggcaatggtttcctgccggcgactcaggaaatcacgcgcggttcggcggtttcagaagagaagctcaaccaactggcggtcgatacccaggcgcaggcgaaattcgccaccggccaggttgatcatacgctgctgctgggcgtggacttccagcgtacccgcaatgatatcgacgcacagtttggcactgcctccagcctgaatgcggttaatccgcaatatggtgataacagcgtaacgccatttggtccttatcagcatctcaacaagcagcgtcagaccggcctctatgctcaggatcagatggagtggaaccgctgggtgctgacgctgggtggccgctacgactatgccatgaactcggtttacgatcgggtagcggatagcgttgatcgtcagaacgatcaggcctttacctggcgcggcggcctgaactatgtgtttgataacggcatcgcgccttacttcagctacagcgaagcttttattccgaatgcgggttcgacctatgacggtcaggcatttgatccgtcacgcgctaagcagtatgaagcgggcgtgaaatatgtaccgaaagatcgtccggtggtgctcaccgcagcgctttatcagctgaccaaaaccaaaaacctgaccgcggaccctgatacgtttaatcatccgtttgccagcgtgcagagcggtgaaatccggtcacggggcgtagagctggaagctaaagcggcgctgaatgccaacgttaacctgacggcgtcctacacctacaccgatgcggaatataccgaagacacccagctcaaaggcaaaacaccggtgcaggtgccgaaacatatggcctcactgtggagcgactacaccttccacgaaaccgctttgtcaggcgtgacgatcggcgcgggtgtgcgttatgtcggtgagagtcagggcctttacagcactggcactgagcagaaccagaactttaaagttgccggttacaccacggtggatgcggcgctgaaatatgatctgggtcgtttcggtttgccgggttcgactgtgggcgtcaacgtcaacaatctgtttgaccgcgactacgtcgccagctgctatcgtgaatacgcctgctactggggtgcggagcgccagattgtcggcaccgcaaccttcagattctgatttaaccgggcacttcggcgcccgtttcacagggataaccatgccgtatccgcacgcagaagaggcgacctttacgctgaaaaacgccagttttgaagtgccgggccggacgctccttcagccactgtcgctgacctttccgccgggaaaagtgaccgggctgatcggtcacaacggctcgggcaaatcaacactgttaaaaatgctgggtcgtcaccacgcggccagcagcggagaggtgctgttgaatcagcagcccgtcggacgctggaacagcaaagcctttgcccgtcaggtggcctatctgccgcagcaattaccggcagccgaagggatgacggtgcgtgaactggtggcgattggccgctatccctggcacggcgcgctggggcgctttggtcaggaagatcgcgaccgggtagaggatgcgattgcccaggtcgggcttaatgcctttgccggacggctggtagatagcctgtcgggcggcgagcgtcagcgcgcctggctggcgatgatggtggcgcagaacagccgctgtctgctgctggatgaaccgacgtcggcactggatattgcccatcaggttgaggtgctggcgttgataaaagcgctgagccagcagcgcggcttaaccgtgattgcggtgctgcacgatattaatatggcagcacgctactgcgatcatctggtggcgctgcgtcagggcgcgatgattgccgaaggtgacgcagaggcgattatgcaggctgaggtgctcggtgcgatttatggcattccgatgggcattttaccgcacccgcagggcggcgcgccggtcagttttgtctgttaaggagaggatgatgcccgatcttaatcgccgccgactgatgctggcgctggcagtctctccgctgttttgtgcgcttcccctgcgtgccgccacgccaaatccgggtcggattattgcactggagtggttacccaccgaactgctgatagcactaggcgtcacgccctggggcgtggccgatctgcacaactacaatatctgggtaggggagccgccgcttcctcagggtgtgatcgatgtaggtctgcgcaccgaacccaatcttgagctgatggcgcaaatgcagccgtcgctgatcctctgctccaacggctacggcccgcctaaagagaaactgacgcgcatcgcgcccatcatgggcttcgacctccacagcggcgacgggaaacctctcactgccgcgcgcgcatcgctgcgtcagctggcggcgcgccttggattaagcgcgcgagcggaacagcatttgcgcgaggtcgatgatcagctggcggcggcgcgccagcggctggcgccctatgccggacgcactatcctgctgatgtcgctgctcgacagccgtcacgccattaccttctgcaaaaatagtctgtttctggaagtgatgactctgctgggcctgaaaaatggctggcagggcgaaacaaatttctggggcagcgcggtgatcggcattgaaaagctggcgcaggtcggggatgtggatgtcatctgctttgatcatgataacgatgcggagatgcagcaactgatgcgcagcccgctatggcagtcgctgccgtttgtacgcaccggacgctttcagcgcgtcccggccgtctggtattacggtgcgacgctctcggcgctgcactttgttcgcgtgctggaacgcgcgctggagacgcactgatgcgccatgctctgtttcccgtaggcctcctcagtctgctgtttctgctggcgctcagcctgacgctggtcaatctgcatcaggcgttaccacaggctgaatggtggcaggcactctggtcaccggcggtcgatagcctgccgcagatggtgtttcaccacagcctgctgccgcgtatcgtgctggcgctgctggtggggagtggactggggttagccggtctgctgtttcagcagatattgcgtaatccgctggcggagccaaccacgctgggcgtctcttccggcgcacagctgggcattaccgtggcgacgctgtggcatctgccgggcggggcgctgacacagcagtttgccgcgctcagtggcgcgctgctggtgggcgcgctggtgtttggtgtggcctggggcaaacgtctgtcgccggtaacgctgattctggccgggctggtgctgagcctctacagcggcgcggtgaatcaaatcttcgctatcttcaatcacgatcagctgcagaacatgtttctgtggagcaccggcgcgctgaatcagatgagctgggaaaatgtgcagcaactctggccgcgcctgctgctggcgtttgtgctggcgctggcgctgctgcgtccgctgacgctgatggggctggatgatggcgtagcgaaaaaccttggccttgcgctttccgtggcgcgtgtcggtggcctcgggctggcgatcctgctcagcgcacagctggtcaacgtcgccggtatcatcggctttatcgggctgtttgcgccgctgctggcgaagatgctgggtggacgacggctcatcacccggatgctgctggctccgctgactggcgcgctgctgctgtggctggcggacagttgcgtgttgtggctcagcacccactggcgcgatatcccgaccggcaccgccacggcgctgctcggcgtcccgattctgctgtggctgctgccgcgactgcgcaccggttcggtgccgcccgcgctgaatcagggtgataaggtgcccgtcgagcgacagaacctgctgcgctgggcgctgaccgggcttgccatcctggcactgctggggtggggcggtctggcgtttgggcgagatgcgcagggctgggtctggtcagcgggtgagatgctgcaatcgctgctgccgtggcgcgcaccgcgcgtgctggccgcgctggtgaccggcctgatgctgggcgtggcggggagtctgattcagcggctaaccggcaatcccatggccagcccggaagtgctgggcatcagttcgggtgccgcttttggcgtggtgatgatgatgttctttgtaccgggcgatgcgctggcctggctgctgcccgccggtgcgctgggcgcggcgctgacgctgctggtgatcatggcggtagccagtcggggcggcttctcgccggaacgaatgctgctggcgggcatggcgcttaacagcgcctttgtcaccctgctgatgctactgctggcgagtggcgatccgcgtatgggcgggctgctgagctggatctccggctcgacctataacatcagcggcactcatgcggttcagagcgcaatctgcgcgctggtgctggtgtcgctggcaccgctggccagtcgctggctgacgttgctgccgctgggaagcgctaccgcacgctcggccggtatggcgttgacgcctgcgcggctgagtctgctgctgctggcggccgcgctgaccgccagcgcgacactgactatcggtccgctgagttttgtcggactaatggcgccccatatggcgcgcatgctgggattccggcgggcgttaccgcaactgctgctgtcaggattactgggggcgggattgatggtgctggctgactggtgcggacggatgctggcattcccggatcagatcccagccgggctgatggcgacctttttaggcgcgccttactttatctggctgctgcggcgttcaggttaagaggaaaaagcaggctggtttcagacgccggccagatccaaagtagggtgaatctgacaacaacgaagaagctcaatgcgcaggaaattgggtcagaggaggaaagcgtcccgcgccagggacggcgcgggccgagcgagtcatggatgacggctttcgcgcctttccgatctgaccctgtttcctgtgcgtgcaccctctcacaacagagcggggcaagcctcatcaataacaaaagaccggctgctgccggtcttcatctttaacgctgccgcaattacagcttcgcgaaacaacgacgcgcggcgtcgacagtgcgctgaatatcctcttcgctgtgcgccagcgacataaagcccgcttcataggctgaaggcgcaaagtaaacgccctcctcaagcatcaggtggaagaaggttttaaagcgctccacatcgcagcgggttacatcggcgtaacaggtcacactgtcagcatcggtgaagaacaggccgaacatcccgccaacatggttaatcaccagcgggatattttgctgttgtgctgcttcacgcagaccctctgccagcttgcgggtcagggcatccagcttctcatgggtacccggctgcgcgatctgcgtcaggcaggcgaaacccgccgccatggcgattgggttaccagagagcgttcccgcctgataaaccggaccggtcggggccagcgctgccatcacttcgcgacgcccaccgaatgcaccgactggcatgccgccaccaatgattttcccgagacaggtcaaatcagggcgcacattgtaatgagcctgcgcgccacccagcgcgacacggaaaccggtcatcacttcatcaataatcagcagtgcgccgaactcatcacacagtgaacgcagacccggcaggaactccggctgcggtgggatgcagttcatgttgccagccaccggctcaacgatgatggccgcaatcgactcgggatattgctcaaaagcgctgcgcactgagtcgagatcgttaaaggtgcaggtcagggtatgtttagcgaaatcggccggtacgcccggcgagtttcggctgacccagtgttaacgcaccggagccggctttcaccagcagatgatcggcgtggccgtggtagcagccttcaaacttgatgattttatcgcggccggtaaagccacgcgccagacggatagcgctcatagtcgcttcggtgccggagttgaccatccgcaccatctccatgctcggcaccagctcacacaccagctgtgccatggtcacttccatttcggtcggtgcgccaaaacttaagccgcgctgtgccgcttcaatcacggcgttacggatcgccgcgttgttatgacccagcaccatcggaccccatgagccgacatagtcgatataggctttgccgtcagcgtcatagagataggcgccatcagcgtgttcaataaacagcggaacgccgcccacaccggtaaatgcgcgtactggcgagtttacgccacccgggatcaggcgttgtgcctcggcaaacagttgttcggacttactcattttcggctccagcggttcataaaaatattgcgccattctacggaagaggagcagcagacgaaaggtggattcaccccctgtgcccttaacaggagtgaaagcggcacagagtgcgaagggcagagcttgattgcgctgaggtgctggctgataatagcgtaattaaggtcgttttctgacctgggcgtttaccggagtaaaacatgagtgatgaagtagtagcactgccgttgcagtttaccgacgccgcagccaccaaggtgaagaacctgattgccgacgaagagaacccggcgctgaaacttcgcgtctatatcaccggtggcggttgcagtggtttccagtacggcttcacctttgatgaccagatgaatgatggcgacatgacgattgaaaagcagggcgtctcactggtggttgatccgatgagcctgcaatatctggtgggcggttcagtggattacacggaaggtctggaaggctcacgctttatcgtgaccaacccgaatgccaaaaccacctgtggctgtggctcttccttcagtatctgataatgcaggccgtcatacagacggcctcgtttaccattctattgtgaccagccggttactttgcttcacacttccctgcgattgaatctggccgtttgttacgcgcggctgcgcgcttgcctgtctgccgcagttgatctgcggcgcgggctgaccgttagccgtgttgatttcacagcgtgaatagatgacaagtctggcgccaatagagccatttatcgatcctgcaaaggcagaaccggcgatcgacagccctatggccagcagcagtgctctggtcatataaggttcctggtgttttaaaaaagcgccggagcgctaaaaggacggcgagcatacgtggcgcgttcgtctctggtattgatcaacggcaaaaatcgcagtgactttaatcaattcgccgatttattcatcgggatgcagggccgcacagagttgctgcgcggccagcagcagtcgcgggcctggccggctaagccagtcctcgttgatggcaatcaccggtacatccagctgcggtcgccagaacacccggatgttttccgcctgctgcgcactgccacccgtcacaacggcctgaggatggcgcatcagcacctgctcacggctgacctgcggccagctgacgcggctgtcagcaaagatgttcctgccgccacataacgtaataatttcattctgcagcgtggctctggcggcggtaaacaggggctgctgaccaaactgcaaaaaaagcggaaccgcagtcagatgagcatagcgctgacgcagcgcggcttcctgctgacgtaactggcgggcagcgcgagttgcctgctccggtctgggactccagtggcccagaccggccagcgctgtgaacatctcatccagcgtcagcggatcaatccatttaaccggcacgccgagctgctgtaactggtcaatctgccgctgcggattaccgcctcgccaggctaacaccagatccggcttaagttgcagaatacgttcagccttgatgccctgccagtttgcgacctgctcaatctgtttcgcctgcggcggatagtcggaccaggcgctgaccgcaatcggggtaatcccggcagcaaaggcgagtttcggtaaggtgaggggagagggtaatcacgcgtggcggtgaagccagcaggctgccgctcagcagcagccagcagaggagtagcgttttagccacgcgccagatgcgccagcaggttctccaccatcagcgaagattgcttcgccgcaacgcttaagaactcatcaaagctgaggtgagattgcttatcggccacgtcggaaatggcgcggactactacaaaaggcacctggaattgatgacagacatggccgatagcggtggcttccatctcaacggcaatcgcctgtgggaacagattacgaatgcgcgccagcggttcggcaccattgataaaggcatcaccgctgaccaccagaccgcgtacggcattcagatccagctgctgaatacaggcttctgcagcggcgataagcttgctgtctgccacaaacgcggccggacaacccgccatctgacccggctcataaccaaaagcggtgacgtcagcatcgtgataacgcacttcttctgacaccacgatatcaccgacgctgagcgacggcgctaaaccgccagccgaaccggtgttgatcaccacatccggcttgcagagctgcagcagcagcgtggtacccagcgcggcagaggttttaccaatgcccgatttcagcagagccacctcaacgccctgcagggtgccggtataaatttcacaacccgccagcgacagcgtttgacggttttcaattttgtcgcgcagcagtgtgacttcctgctccatcgcgccaataatgcctgctttcatagtgagttccgctaatgtaaagaatcaaaatttagggcatagtctaccatggcattcaggggattaattcacgaaaaaataaggggtaatccatgtcagcgatcaatttcaggaagaagatcagcttctcgcgcccttataacagccgcaaggaaccggaaggcgaatattacattacgcgccattttgagagcgatcgcggacggattataaactccgccgctatccggcgtttgcagcaaaaaacgcaggtgtttccgctggagcgtaacgctgccgtttcgttcccgcctgacgcattcgctggaggtgcagcagaccgggcgttacatcaccaaagagatcctgcaaaccctgaagatgcagggcgggctggcgcagtatggtcttgatgagctggaaggcgcgtttgaaagtctgattgagatggcctgtctgatgcatgatgtcggtaatccaccttttggccattttggcgaggcggcgattaacgactggtttgaagagaacctctctgccgagctggtggatccgctggtggccggcgtggaaggagaagcacagcgtaaagcctttgatcaactcaacgccatgatccgccaggatctctgtcactttgaaggcaatgcgcaggcgatccggatggtgcatacgctgctgcaactgaatctcagttattctcaggtcgcctgcatcctgaaatataccgcgcctgcctggtggcagggggaaaagcccgccgaatttagcgtactcatgaagaagcctgggttttatctctctgagcaggattatattgccgacctgcgtgctgccaccaatatggaagaacaccaccgttttccgctgacttatataatggaagctgcggatgatatctcctattgtattgccgatttggacgacgctgtagaaaaagatatctttaatgttgaaagtttgtatgagtttctcaataaagcctgggggccggttaaaaataatgacgctttcagccggactattggcgaagcctggcgtgaagcctgcagtaaaaaacgccgaagccgcagcgatcaattttttatgtcactccgcgtaaatgttcagagcgtgctggtaagctatgcggtgaaacgttttgttgataatcttcctgctatattcgatggaagttttaaccatgcgctactggaagatgagggtgaagagggccgcttactgcaattgtttaaaaccgttgcgcgccagcaggtctttaatcattctgaagtagagcagctggagttgcagggttaccgggtgattaaagggctgctggagatctatcagccgctgatgcgccttaattacgaagcctttaccacgctgataaatgaagatttcctgcgtcagcatccgatcgaaacccggctttttcataagctctcgggtaaacaccgtaaagcctatttgcataagatgcgtaatctggttgtcgaacataaatatcagcgtctgttgtgggaacgttattatcgcttccggctcattcaggattatatcagtggtatgaccgatctctatgcctgggatgagtaccgacgactgatggcggtagaataagccgccaattgtaaagagcgcgaataaatttttacttttgccttaaacttttaaaggaacttcgcgctaaaacatttatctcacttttcgaccacagcaatggtctgaacagtaatcttattgagaaacgaaaaatgaaaaaaaagaccttaatgttaagtgcgctggcgttgagcctgagcatggcgctcgcccctgttactgtttctgctgcgcaaacggcctcttccgatagcctgcaacagccaagtctggcaccgatgctggagaaggtgatgccgtctgtggtcagtatcagcgtcgaggggaccaccacggtgaaaaccccgcgtatgccgcagcaatttcagcaattctttggcgacaattcgccattctgccaggatggttccccgttccagggttcaccgatgtgccagaacggcgacggtgcaggcggtaacggcggcgcgccagtgcctgatacacagcaggaaaaattccgtgctctgggatcgggtgtcatcattaacgctgacaaaggctatgtggtaactaataaccacgtcgtgaataatgccaccaaaattcaggtacagctcagcgacggtcgtcgctatgacgccaaagtcatcggtaaagatcccagctctgacattgccctgattcagctgcaggaagccaaaaatcttaccgcagtcaaaatcgctgactctgacaacctgcgcgtcggcgattataccgtggcgatcggcaacccttatggtctgggtgaaacggtcacctcaggtatcgtctccgcgctgggacgcagtggcctgaacgtggaaaactacgaaaactttatccagacagatgcggccattaaccggggcaactccggtggtgcgctggttaacctcaacggtgaactgattgggattaacaccgccattctggcgcccgatggcggcaacatcggtatcggctttgctatccccagcaacatggtgaaaaacctgacggcacagatggtcgagtttggtcaggtgaaacgcggcgagctgggcgtgcaggggactgagctgaactccgagctggcaaaagcgatgaaggtcgacgcacaacgtggtgcctttgtcagccaggtgctgccagactcggctgccgccaaagccggtattaaggcgggcgacgtcattgtctcgatgaacggtaaaccgctgagcagctttgcttcgctgcgtgcggaagtgggctcactgccggttggcaccaccctgaaactggggctgctgcgtgacggcaaaccggtcgatgtctctgttaagttgcagcagagcagccagtcaaaagtgcagtccgcgaccatctacactggcattgaaggcgccgatctcagcaatatcgaagcgggtaccaaaggtgtccgggttgataacgtgaaaccgggcagtgctgcggcgcgtatcggcctgaaaaagggcgatgtgatccagggcgttaaccagcaggtggtaaccaacctgggtgagctgcgcaaagttctcgacagcaagccgtccgtttctggcgctgaatgtgaaacgcggcgacagcagtatctatctgctgatgcagtaagcgaacagcaacggatgaagaggcggactgcggtccgccttttttatgtccactttctgcctcgtcagagtgtgatgctcaccgcaaattcggcaaatgacggcctggctctgtgcaattgcacaatgttctgcgtgctgtgcatgcgtattctgtttctcccccctcttttcaggagtaatggatggctacctatcaccttgatgcccggctggcacaggatatcgtggcgcgcaccatgaaaattattgacagcaatgtcaacgtgatggatgcgcggggccggattatcggcagcggtgaccgggaacgtattggggagttgcacgaaggtgcactgctggtgctctctcaggggcgcgttgtcgacatcgatgaggccgtggctaaacatcttcatggcgtgcggcctggcattaacctgccgctgcgcattgatggtgacatcgtcggggtgatcggcctgaccggcgagccgctggcgctgcggcattatggcgagctggtctgcatgaccgcggagatgatgctggagcaagcccggctgctgcatatgctggcgcaggacagccgtctgcgtgaagagctggtgctgaacctgatccgcagcgataccctgtcgccacagctgaccgaatgggcgcagcggctcgggatcgatctcaatcagccgcgtgtggtcgccgtggtggaagtggatagtggtcagctcggcgtcgacagcgcgatgtcagagttacagcagttgcaaacgctgctgaccacgccggagcgggacaatctgatcgcgattgtgtcactgaccgaaatggtggtgctgaaaccggccctgaatgggcatgggcgtcacgatcaggaagatcatcgccgccgcgtagagcagttactacagcggatgaaagagagcggtcatcttcggatgcgtatcgcgctgggcaacttctttaccggacccggcagcatcgcacgctcttaccggacggcgcgcaccacgatgatggtgggcaagcaacgtatgcccgaggtgcgcagctatttttatcaggatctggtgctgcccgtgctgctcgacagcctgcggggtggctggcaggccaatgagctcgcccggccactggcgaagctcaagagcatggataacaacggcttgctgcgccgtacgctgatcgcctggtttacccataacgtccagccgagcgccaccgcgcgtgcgctgttcattcatcgtaatacgctggaataccggctgaaccggatttctgaactgaccggactgaatcttggccattttgatgacaggctgttgctctatgttgctttgcaactggatgagcagggctgaagtgaagatttgcggcataaaaaaggccagcaatgctggcctctctggtcgggcaggaaattaacgaccgttacgggttaatttttccagatccgattcaatttcagtgatcttatgtgaaaccacgctttccaggtgacgcaggtcatccagaattttgcgtttcagatccacttcaacctgatcgcgctggcaaatctggtccagttcatcgatgacataacgcagattcgggctgatttcctgaacttctttgtagccctgggtcgcgtgatcggcaacaaccgttttgcgctggcgcggatatttgaatttaacgctcttcgcgaaaaactcacctttatctttgcggaagtagattttcagaatgtcgttattggcttcctgacgcaggctatagcggtcaatgtcgtctgggttactgatacctaagcttttcagattgtcatacatagcgttgtttccatcaaaagtgagaagcgcgcagacttgttcatgacgtccgtcaactgtagacataaataagcgggatgaacattgcgcgacaggatttaactggcgcggattatgacctggataaaaactaaacgcaccagttaattcgcgacgcgaagcatgttgttcaggaatcactgtaaagaaaagatgacgggctggaaaccagcccgtcgcttaaatcagtcgatggtgcgcagcagctcgttaatacctgttttgccaagcgttttcgcatccactttcttcacgattacggcacagtagaggctgtagctgccatctttagagggcaggttacctgagaccaccacggatcccgcaggaacacggccgtaatgcacttcgccggtctcgcggtcatagattttggtgctctgaccgatgtaaacgcccattgagatcacggaaccttcttcaacaatcacgccttcaacgatttcagagcgcgcgccaatgaagcagttatcttcgatgatggtcgggtttcgcctgcagcggctccagcacgccaccgatacccacgccgccagaaaggtgaacgtttttaccaatctgtgcacaggagccaacggtcgcccaggtgtccaccatggtgccttcatccacaaaggcgccaatgttgacgtaagaaggcatcagcaccgtgttgcgggcgatataggcaccctgacgcacagccgcaggcggcacgacgcggaaaccggcttctttgaaacgcgcttcatcccagcctgcaaacttcatcggcactttgtcgtaaaagcgggtttctgcaccttccatcacctgattgtcattgatgcggaaagagagcagtacggctttcttcagccactgatgcgttacccactcgccgtcgatcttctcagaaacgcgcagtgcaccgctgtccagcagggcgatcacctggttgatggcatcacgggtttcgctgtcgacgctggcgggtgtgatgtcagcgcgacgttcgaaggcggattcaataacgctctgtaactgttgcatatttttttcctgatctgtcatgtgcgatgccgggcaataccccgacacaagtaaagagattaatgtttacaaatcgagtctggtcacactttatcgtttggattaagggcctctgtcaaccgttgtcgcaacgcttttcgcatttcttcgtccagtgcctgacgttcactgttggccagaataaacaaatcttcgacccgctcgccgatggtgctgatgcgtgcgccatgcagtgagactccgagatcggcaaagacttcaccgacccgcgccagcaggcctggctgatccagcgccaccagttccagatagctgcgacgatcggtatgcgtcggcaggaaattgacctcggtatcgacgctgaaatgcctgagtttggccgacggacggcgggtacgcggcggcgcccactctgactgggttatcgcctgctccagcgcctgaatgatcattggatggcgatccggagagagcgggctgccatccggctccagcacaataaaggtatccatcgccatgccgtcgcggctggtaaagatttgcgcatcgtgcacgctgagattacggcgatcgagttcacctgccacggcggcaaacaggtgcgggcgatcgggactccagataaagatttcagtcccgccgcgcgtggcctgcggactgaccagcaccagcggttttttcaggtcgtgaaccagcaggtgacgggcatgccaggcgatctgattcggcgtatggcgcaggaaatagtcagcgcggcagcgattccagatctggtgcagacgctcttcatcaatgttgtccatccgcagcagcgccagcgcctgcaggcgatgatgacgcacccgctcacgcagatccggactgttttccatgccgcgtcgcaactgcttctcggtggcgaaaaagagctcacgcaacaggctctgcttccagctgttccacagactttcattggtggcacagatatcggctacggtcaggcaaaccagatagcgcagccggttctcattctgcatcacctcggcgaaactgctgtatcaccgtcgggtcctgaatatcgcgccgctgtgctgtcaccgacatcagcagatgatgacgcaccagccaggccaccagctgggtttcacgtgagttgagaccgtgcatttcagcaaagtcgagcgcatcctgcgcgccgagaatagagtgatcgccgccgcgccctttggcaatgtcatgcagcagcgcggccatcagcaacagctcctgttgcggcaggcgcggccataactcgacgcacagtggatgctgcgggcgggtgctttcattggcaaaactttccagcttctgcaacacccgaatggtgtgctcatctacggtgtaggcgtgaaacagatcgaactgcatctgtccgacgatatggccccacagcggcgtataagcccacagcacgctatagcgatgcattggcaccagcgcccggctgaccgcgccgggatggcgcagaatcgacataaaggtgcggcgcgcttccgggatctgacacagcggctgtttaagatgacgacgcgcatggcgcaggtgacgcagggtggtggagtagatccctttgatgctgtcgttacgcaccatgacgtagaacatgcgcaggatcgcctgcggctctcgccggaacagcgtttcgtcgcgcaggtcgatcaaatcgccacgcagctggaaatcgtcatcaataggcctgggcttttcgctggtggagagcgccagaatcgcctcatcaaacagctgcagcagcatctgattcagttcgccgatacgccgcgtgacccgatagaaatctttcatcatccgctcgaccggctcattgccctcgccctggtaattcaggcgttgtgccacgctgagctggcgatcgaacagcaggcgattatcgtagcggggcagggagaggtgcagggcaaagcggatgcgccagagaaatgcctgacattcgttgagttcgctgcgctcggcgtcggtgaggaaaccaaagccgaccatctcatccagcgtggtggcgccaaaatggcgtcgggcgacccactgcagcgtatgaatgtcccgcaggccaccggggctgcttttaatgtccggttcaaggttatagctggtgccgtggtaacgcttgtggcgctcctgctgctcttcaattttggcggcgaaaaagcaggatgagggccagaaaccatcgctgaagatgtttttctgtaattccagaaacagcgccacatcgccggtcagcatgcgtgactcaatcagattggtggcaacggtcaggtcagataacccctccagcaggcactcttccagcgtgcggacgctgtgacccacttccagcttaaggtcccacatcagcgttaacagatcgctggtgcgctgcgcagcctgttcattcagcggctggcggctcaggatcaggacgtcaatatcagagagtggatgcagctcggcacggccatagccgccaacggcgaccagcgcgatagccggcatctcatcaaagccaaaaaagcgccacaggcgacgcagcagccgatcgataaacagcgtgcgggcatcaatcagcggctcaacgggttcaccggcatcaaaagcggcggccagatgttgctgaaactgctccagccgcggcttcagaatgtcacgtgtcagctggtcgtcactccattcggctggcgaatcgaccagaccgtttttcacatcttctgacagactcacgctcatgcagctcttctcttttttagccaaaaaaaagccggctcagcgccggcttgatctgtaatgggggaattacccttcggcgacaagcactgcgggcagcgtgtcgtctttgcgcagggttaaaatctcacagccgttctccgtcaccacaatagtatgctcatactgcgcggacaagctgcgatctttggtttttaccgtccagccatctttcatggtgcggatgcggtaatccccggcattgaccatcggtttctaccgtaaaggtcatgcccgcctggagtaccacgccgccatcatcggcatcgtaatgcagcacctgaggctcttcatggaaacccttgccgataccgtggccgcaatattcgcgcaccacagagaaatcgttggcttcaacatatttctggatggcgcggcccagttcgcgcaggcggatgccgggcttgatcagacgcagtgagagatagaggctctcctgcgtgacacggcacaggcgttcgccctgaatggtcggcttaccgacgataaacatctttgaggtatcgccgtggtattcatctttaattacggtgacatcgatattcactacatcgccatcttttaacggacgatcatcgctggggatcccgtggcacaccacttcattcaccgagatgcagaccgacttcggaaagccgtgatagccgaggcaggcggagacggcctgttgcttttgagtaatgtgatcgtggcagatgcggtccagttcaccggtggtcacacccggttttacgtaaggctcgatcatctccagcacttcggcggccagtcggcccgcgacgcgcattttttcgatttcttcaggggttttaattgaaattgccattaaattaatccgcagttgtcgaaattttcgacaataataagttctgtgctgtcatgttagcagccagcaaatgggctgccaaatagagaacgcgctgacctccgtcagcgatcatttattggcgtccctgggctggttgtggtataaagcgcgccgacgattctctgtatggccgtttcggtcagcaggaaacgcataactctcattatgtgtaataaaacacacatgtatcgacacatacgccggggtgccttgaaagaggtcggtcgtatgggatacatggaggcccaaccccaatcaaactttagaggttttatcatggcaactgtttccatgcgcgacatgctccaggctggtgttcacttcggtcaccagacccgttactggaacccaaaaatgaagccattcatctttggtgctcgtaacaaggttcacatcatcaacctggaaaaaactgtacctatgttcaacgaagctctggctgaactgaacaagatctcttcccgtaaaggtaagatcctgatcgtaggtactaagcgtgctgctgctcaggcggtaaaagagtctgcactgagctgcgaccagttcttcgtaaaccaccgctggttgggtggcatgctgactaactggaaaaccgtgcgtcagtcaatcaagcgtctgaaagatctggagattcagtctcaggatggtactttcgacaaactgaccaaaaaagaagcgctgatgcgtgcgcgtgagctggccaagctggaaaacagcctgggcggtatcaaagatatgggcggtctgccagacgcgctgtttgttgtcgatgctgaccacgaacacatcgcaatcaaagaagcaaacaacctgggtatcccggtatttgctatcgttgataccaactcagatccagatggcgttgatttcgttatcccaggtaacgacgatgcgatccgtgctgtaaacctgtacctgactgccgttgcgaccaccgttcgcgaaggccgctctcaggacctggctgagcaagctgaagaagcgtctttagaaaacgcttaataaggtttgctctgcataagagcccttagcattcagatgtgatctgtaaggggcctatactggcccctttattttatctaagtctgtcacgcccccaaccggacggcgggacagagtaaattttccgcaaataagtgtctgctggtgaaaacgtacacaggcacgaaccgaggattctggaatggctgacattaccgctgcattggtaaaagaactgcgtgagcgtactggcgctggcatgatggattgcaaaaaagcgctgactgaagcgaacggcgacattgagctggcgattgagaacatgcgtaagtctggcgcaatcaaagcagcgaaaaaagcaggcaacgttgctgctgatggcgtaatcaaaaccaagatcgttggcgactacggcgtgattctggaagtaaactgccagactgacttcgttgcaaaagatggcggtttccaggcgtttcgcagacaaagttctggatgtggctgcagctgatcgcgttaccgacgttgaagttctgaaagcgcagttcgaagaagagcgcgttgcactggttgctaaaatcggtgagaacatcaacatccgtcgcgttgctatcctggaaggcgcagagctgggcagctacctgcacggcgcacgtatcggcgttctggtttcaaccaaaggcgctaacgaagatctgatcaaacagatcgcgatgcacgttgcggcaagcaagcctgaattcgttaagccagaagacgtttctgctgacgtggttgataaagagtaccaggttcagctggacatcgcgatgcagtctggcaagccaaaagagatcgcagagaagatggttgaaggccgtatgaagaaattcaccggcgaagtctctctgactggtcaggctttcgttatcgacccaagcaaaaccgttggccaggctctgaaagagcagggcgctgacgttatcaacttcatccgcttcgaagttggtgaaggcatcgagaaagttgagtctgacttcgctgcagaagttgcagcaatgtccaaacagtcttaatgctttgaaagaaccgccagatggcggttcttttttgtctgtgaatcgcaacagacacgttttcagtttcatcccaatagcaatttcattgcggtaagcggatgatcgatcagaatttacttctcctttacacccaatcttccaggaagaactgaccatggcgaccaacgcaaaacctgtttatcaacgtatcctgcttaaactcagcggcgaagccctgcaaggcgctgaaggttttggtatcgacgcgagtgtgcttgaccgcatggcacaagaggtaaaagagctggttgaactgggcatccaggttggcgtggtgattggcggagggaacctgttccgtggagcgagcctgcagcaggccggcatgaaccgcgttgtgggtgaccacatgggtatgctggcaaccgtgatgaacggcctggcgatgcgtgatgcactgcaccgcgcctatgtgaatgcacgcctgatgtcagcgattccactgaatggcgtctgtgacaactacagctgggcagaagcaatcagcctgctgcgtaacaaccgcgtggtgatcttctccgccggtaccggtaacccgttcttcaccactgactctgcagcgtgtctgcgcggcattgagattgaagcggacgtcgtgctgaaagcgaccaaagtggacggcgtctactctgcggatccggtgaaaagcccggacgcaacgctgtatgagcaactgacctatgctgaagtgctggatcaggagctgaaagtgatggatcttgcggcctttaccctggcgcgtgaccacaaattacctatccgtgttttcaacatgaataagcctggcgcactgcgtcgcgtagtgatgggtgaaaaagaaggcaccctgattacgcattaatacccgaggcgagataaaataaggtatattctgtcagcgcgatgataatgcatcgcgcaccagtcaggattatcgatgattatcgatcccgcttccggttacgccggaaactggccaggtcaaaccgaatccaagggtttcaacgtgattaacgacatcaaaaaagatgctgacacgcgcatggaaaaatgcgttgaagcattcaaaaccaccatcagcaaagtgcgcaccggtcgtgcttcaccttcgctgctcgacggcatcgtcgtcgaatattacggcacgccgacgccactgcgtcagctggcttctgtcactgtggaagattcacgcacgctgaaaatcaacgtgtttgatcgttcactgagtccggcagtcgaaaaagcgatcatgaagtccgatctcggtctgaacccaagttcagccggtaccgacatccgtgttccgctgcctgcgctgacagaagagcgtcgtaaagatctgattaaaatcgtgcgcggcgaagccgagcagggccgtgtgtcggtacgtaacgtccgtcgcgatgccaacgataaaatcaaagcgctgctgaaagataaagagatcagcgaagacgacgaacgtcgtgcgcaggatgaagtgcaaaaaatgaccgatgcgtacatcaagaaagttgatgctgcactgtcagaaaaagagacggagctgatggatttctaatcccatcactgccggacaaaacgccgtacagagaggtattcgtatgaatgcgacatctggcggcgttttacattgtgcctgtgggtacgctgacttcacacggatagcttcatgaagcgattaactctgctgggatccaccggatcaatcggcaccagtacgctggcggtggtgcgcgccaacccggcgctttatcagattacggcgctggttgccggccataacgtggcgctgatggccgagcagtgtgcggcctttacaccgcgctacgcctgcatggcagacgaggcatccgccgctgcgttgcgtgagcgactgagagcaatcagggtcaatactgaagtgctctccggcgtttcaggcagcctgtgagctggccgcgctggatgaggtggatcaggtgatggcggcgatcgttggcgcatcgggtttgctgccgacgctggcggccattcgcgccggaaaaacggtgctgctggccaacaaagaatcgcttgtcacctgcggccgtttgtttatggaggccgtgcgtcatcataacgcacagttactaccggtcgacagcgagcataacgccatttttcagagtttaccggctaccatccagcatcagttaggttacgctgacctgcgggataatggcattgagtcgattatccttacgggatcgggtggtccttttcgtgacacagatttagcggatctcagcgccatgtcgccagatcaggcctgtgcacatccgaactggtcgatggggagaaaaatctctgtcgattcggccaccatgatgaataaaggtcttgagtacattgaagcccgttggttgtttaatgccagcgcagcgcagatggaagtgatactccacccacagtcggtgattcactccatggtgcgatactgcgatggcagcgtgctggctcaattaggttctcctgatatgcgtacgccgattgcccacagcatggcctggccttcgcgcatcaatgcaggcgtgacgccgctggattttacccgcatgtcggcgctctcctttgcagaacctgattttagtcgctacccctgtctgaaactggccattgatgcctgtgatgcagggcaggcggcgaccaccacgctgaatgcagccaacgaggttgccgtcgcggctttcctgaatcaccagatccgcttcaccgacattgccgcgcttaatagtgaggtgatggcggcacaagtgtgtccggagccggattcggtggacgctgtccttgaaatcgatcgcactgcgcgcgcgctggcgacagaaatgttgccgcgtttcacgtcgtgatgccgatcgttatgaggccatttgttcgcttcaggtgaaaatgatatagtcgctggctcgcgtttcacggtctgtcaccgaattcggtgtggcccggcactgagagtgtgtcgggatttgaatcgggcgcaatgtattcagaaaccacagcatttctgatgaaaggaattggttaagcgttatgtcgtctaacaatcacaacaacactgatgaccagcagggaaacggtccgcgccacgtcgctatcatcatggatggcaatggccgctgggccaaaaatcagggaaaattgcgcatttcaggccacaaagctggcgttaaatcggtacgccgtgccgtcagctttgcggtcagtaacaatcttgaagccctgacgctttacgccttcagcagtgaaaactggagtcgtccgccgcaggaagtcaccgcgttaatggaactctttgtctgggcgcttgatagtgaagtgaagagcctgcacaaacacaatgttcgcttacgcgtcattggcgataccagccgtttcagcccgcgtattcaggaacgtattcgccgttctgagacgctgaccgcaaataatagtggcctgacgctcaacattgctgccaactatggcggccgttgggatattatcgaaggcgtgaaaaaactggctgaacaggttcaggaaggattactgcgacctgaccagattaccgaagagagcctgacgtcgcagctctgtatgcaggagctggcgccagtggatttagtgataaggaccgggggagagcatcggattagcaacttcctgctgtggcagattgcctatgctgaattctattttaccgatgtgctctggccggatttcgatgaacacgtttttgaaggtgcactgaatgcattctctctgcgggagcgtcgttttggcggcgctgcaccaggcggcgcctgagcaatctgggggtaacctttgctgaagtctcgtctgattaccgcgttgatattaattccgctggtaatagctgcactgttctggttaccgcctgttggcttcgccctgacaaccatcgttatctgcatgctggcagcctgggaatggggtcagtttgcagggatggcatcacggcaacagcgcgtctggcttgctgtactttgtggtctgctgctggcgctgatgcagtttacgctgccaccttatcaacacacggtgcatctgccacagatcgcgacatcgctttgggcgtcgctggtgtggtgggtcgttgcactgctgctggtgctctcctatcccgcttctgcggccttctggcgccattcgcgtccccttcgcttactgtttggcgtgttaacgctggtcccttttttctggggcatggtggcgttgcgccagtatcactatgacaccgaccacttcgccggtgcctggtggctgctgtttgtgttgctgctggtgtggggagcggattcaggtgcctatatgtttggcaagatgtttggcaagcacaagctggcgccaaaggtctcaccaggcaaaacctgggaaggcttcctgggcggtctggtcacctcggcgctgattgcagtgctgtttgcgacgctggcgccactgacggtttccaccggtacgctggtgatttgcgcgattatcgcgacgctggcctccgtgctgggcgacctcactgagagcatgtttaaacgtgaagcgggcatcaaagacagtggtaatctgattcctggtcacggtggcattcttgatcgtattgatagtctgactgcggcggtgccggtgtttgcctgtttattgctgctggtgtttcgcaccctttaaggacaggcaaagatgttgagcatactctggagtttcgtcgcctttatcgttgcgctgggcgtattaattaccgttcatgagtttggccatttctgggtcgctcgtcgctgtggcgtcaaagttgagcgcttttccattggttttggtaagtcgctctggcagcgccgtgaccgccacggcaccgaatttgtcatcgcgctgattccccttggcggctacgttaaaatgctcgacgagcgtgttgaaagcgtgccagccgaatttcgtcatcaggcttttaacaacaaagccgtctggcaacgcgcctccatcattgcggcaggtcctgtcgctaatttcatctttgccatctttgcctactgggttgtgtttattcacggcgtgcccggcgtgcgcccggtaatcggtgaaattttaaacggttcggtggcttcggaagctcaaattacgcccggcatggaacttaaggctgttgacggtatcgaaacgcctgactgggatgctgtgcgtatggcgctggtgggtaaaatcggcgacagcagcaccaccttaacggtggctcgatttggcgaggacgcgacccagcagaaacagctggatttgcgtaactggcagtttgagcctgataagcaggatccggtcgtcgcgttagggattcagccacgcggtccgcagattgagaccacgctggcagaagtgcaggcgaaactcgccagccagtgaagccggtttgcaagcaggcgacaggatcgttaaagtcgatggtcagccattatcgcagtggcagacttttgtcatgcaggtccgggataaccccggcaaaagcatggcgcttgaggtggatcgcggcggtgagtctattgcgctgacgatgacgccagaagcgaaatctggcagtaaagcgggatttgcgggtgtcattccgcgcattgttcctctgccagaagagtacaagacggtaagacagtatggcgcgtttgcggctatcggtgaggctagtgtaaaaacctggcaactgatgaagctcaccgtctccatgctgggcaagttaataaccggtgatgtgaagctgaacaacctgagcgggccaatttcgattgcgcagggtgcagggttgtcagcagagtatgggttgatttactacctgatgttcctggcgttgattagcgtcaacctgggcatcatcaacctgttccctctgccggttttagatggtgggcacttgctcttcctggcgatcgaaaagatcaagggtggaccggtgtccgagcgagttcaggactttagttatcgcatcggttcaattttactggtgctgttaatggggcttgcacttttcaatgatttctcacgtttgtaaccgctggaacgcgaacattcgagggatgtgttaggaaaacgcataacaacgatggcgatgaaaaagttgctcatagcgtcgctgctgtttagcagcgccaccgtttacggtgcagacgatttcgtagtgaaggatattcatttcgaagggctgcagcgagtcgccgtcggcgcggctctgctgagcatgccagtacgggttggcgatacggtgaatgacgatgatgtcagaaataccattcgctcgctgttcgctactggcaactttgaggatgttcaggtcctgcgagacggtacaacgctgattgtccaggtcaaagaaacgtcctaccattgccagcattaccttcaccggtaacaaagcggtgaaagaggatcagctcaaacaaaatctggaagcctcaggtgtccgtgtcggcgaagcgctggaccgtaccaccatctcctctatcgagaagggacttgaggatttctactacagcgtaggtaaatataccgccaacgtgaaagccgtggtcacgccactgccgcgtaaccgtgtggatctgaagctggtctttactgaaggtgtctctgcaaaaattcagcagatcaacatcgtcggtaataaagcctttagctccgatgagctgatttcccgcttccagctgcgcgatgaagtgccatggtggaacgtggtcggcgatcgtaaatatcagaagcagaaactggcgggtgaccttgaaaccctgcgcagcttctatctggatcgtggctacgcacgctttaacatcgattcaacgcaggtcagtctgacgcctgataaaaaaggcatctacatcacggtgaacatcaccgaaggtgaccagtacaaaatcgctggcgtgatcgtcaatggcagcatggcgggccattcagcagaaattgaacatctgaccaagattccggcaggcgagctttataacggcgccaaagtcacgaaaatggaagatgacatcaagaaactgctgggccgctacggctatgcctatccgcgcgtggcaacacagccagaaatcaacgacgccgacaaaaccgtaaaactgcatattaatgtggatgcgggtaaccgttattatgtccgtaacgtccgtttcgaaggcaatgacacgtcgaaagactccgtgttacgtcgcgaaatgcgtcagatggaaggcgcgtggctgggcagcgatctggttgaacagggtaaagagcgcctgaaccgtaccggttactttgaaaccgtggatgtggatactcagcgtgtgccaggttcgccggaccaggttgacgtggtctacaaggttaaagaacgtaacaccggtacctttaacttcggcgtcggctacggcaccgaaagtggtgtgagcttccaggtcggcgtcacgcaggataactggctgggcaccggtaataccgtgggcatcagcgggaccaagaacgattaccagacctatgctgaattctcgctgactgacccttacttcaccgttgatggtgtcagtctgggtggtcgtctgttctacaacgactttaaagcagataacgcggacctttctgactataccaacaaaagttatggtctggatggcacgcttggcttcccggttaacgaaaacaacaccctgcgtgtcggtctgggctatgtccacaatgacctgtcaaacatgcagcctcaggtggcgatgtggcgttatcttgactcggtcggcaagccgcagcagctcaatgatgaaggtgatttctcagcagatgacttcacctttaactacggctggacttataacaccctggaccgcggcttcttcccgacgtccggtaaccgtaccaacctgaacggtaaggtgacgattccgggctcggataacagcttctataaggccacgctggatactcagcagtatgtgccgattaaccaggatcgtacctgggtgctgttaggccgtggtcgcgtaggttatggcgatggtctcgacggcaaagagatgccgttctacgagaacttctacgccggtggttcaagcaccgtgcgcggcttccagtccaacaccattggaccgaaagcagcctacttaaataacaactcgtcgaactgccgaatcgccgatccaaatggcgtctgtaagtctgacgatgcggtgggcggtaacgccatggcgattgccagccttgagctgattacgccaacgccgttcctgagcgagaagtatgctaactcggttcgtacctcggtgtttgtcgatgccggtacagcgtgggatacccattgggaaaataccgcagaaacgcgtgcggcgggcattcctgactacagcgatccaaacaatatccgtgtatccagcggtgttgcgctacagtggatgtcaccgctcggcccgctggtgttctcttacgcccagccgatgaagaaagtcgatggagacaagtcagagcagttccagtttaacattggtaaaacctggtaatgttctgagcatggatgcatagctgaagtattgctgccggacagcacctgttgctgttccggggcaaacactgtgtcgctgacacaaacgttgatggtaaggagtttatagtgaaaaagttgttgtgtgccgcaggtctgggtcttgctttagcggtctccgctggtgttcaggctgccgacaaaattgcagtggtaaacgtgtccagcattttccaacagttaccgcaacgtgcgactgttgctaaacagctggaaaacgagttcaaaggccgtgcaactgagttgcagagccaggagcgcgatctgcaaaccaaaatgcagcgtctgcagcgtgacggtttctaccatgaaggcgagcgaacgcagccgtatggaaaaagatgtcatgtctcagcgcgaagctttctctacaaaagcccagtcttttgagcaggataatcgccgtcgtcagatggaagagcgtaacaagctgctgagccgtattcaggatgccgtgaagaaagtcgctgacagcgatggttacgacgtcgtgatcgacgctaacgcggtggcttatgcgtcaaacgcaaaagacatcactgctgacgtgctgaaacaggttaaataattcatgtcatctattcgactggctgatttagcccagcagttggatgcagaattgcacggagatggcgatatcgtcatctccggcattgcttctatgcaatccgccacaactggccaaatcacttttcttgcaaacagccgttaccgcgagcaactcgccctgattaaggcctcagccgtggtgctgacggaagcggatctggagtggtgcaataccgcagcgctggtggtgaaagatccctacctgacctatgcgcgtatggcacaaatacttgataccacgccacagccagcgcaaaatattgcccccagtgcagtgatcgatccctcagcccgactcgggagcaacgtcgccattggcgccaatgcggtgatcgaagcggatgttgagctgggcgataacgtggtcattggtgcaggatgttttgttggcaaaaaaacccgtatcggcagcggtacccgtctctgggccaacgtctctgtttatcacgaaattgaaatcggtcaggattgcctgattcagtcaggtaccgtcatcggttctgatggtttcggctatgccaacgatcgtggtaactgggtgaaaatcccgcagttaggcgcggtgataatcggcgatcgcgtagaaataggtgcctgcaccactatcgatcgcggtgcgctggataacactctgatcggcaatggtgttatcatagacaaccagtgccagatcgctcacaacgtagttattggcgacaatactgcggttgcaggcggtgtgatcatggcgggtagtttgaaaattgggcgttactgtatgattggcggtgccagcgtcattaacggccatatggaaatctgtgacaaagtaacggtgaccggtatgggtatggtcatgcgtcctatcacagagcctggtgtctattcatcaggcattccgctgcaacccaacaaaacctggcgcaaaactgcagcgctggtgatgaacatcgatgacatgagcaaacgcttaaaagccatcgagcgcaaggtcggcaaagacgactaaccgccatcccaaaactgaccggctttcataataaaaatgttaagcagggaagcccggcgccacagaaacctatttgcggcctgcggaagatcattttgatctgtgcaggccgtgttattgatgtcatcagatttttaggacaggaagagtattttgactactgaaactcatactctgaaaattgaagagattttagagctgctgccgcaccgctatccgtttctgctggtagaccgcgtgctggaatttgaagagcacaaatacctgcgtgcagtgaagaacgtttctgttaatgaaccgtttttccaggggcacttccctggtaaaccgatttttcctggcgttctgatcctggaagcgatggcgcaggctaccggtattctggcgtttaaaagcgtaggtaaactggagccaggcgaactctactactttgccggtatcgacagtgcccgtttcaagcgccctgtggtaccaggcgaccaaatgatcatggaagtcactttcgagaaaacccgccgtggtctaacccgctttaaaggcgtggcgaccgtcgacggtaaaatcgtttgtgaagcgaccatgatgtgtgcccgcagccgggaggcataattcgtgattgatccaacagccactatccatcccagtttctgtcatcgaagagggcgctattattggcgcccgcgttcacattggcccgttttgctttattggtgcgaatgttgagatcggtgaaggaacggtactgaagtcacatgttgtggtgaacggccacacgcgcatcggtaaagataatcagatttatcagttcgcctcaattggcgaagtgaatcaggatctgaaatatgccggtgagccaacacgggttgagatcggtgatcgtaaccgcatccgtgaaagcgtgacgattcatcgcggcaccacgcagggtggccaggtcaccacagtgggcagcgataatctgctgatggttaatgctcacatcgcgcatgactgcgtgattggcaaccgctgtatcttcgccaacaacgccaccctgggtggtcacgtgacggtcgatgatttcgccattattggcggcatgacagcggtacatcagtggtgcatcatcggtgctcacgtgatggttggcggctgttcgggcgtggcgcaggatgtgccgccttacgttattgcgcagggcaaccacgctacgccgttcgggatcaatatcgaaggtctcaagcgtcgtggcttcagcaaagagtcgttgcacgctatccgcaacgcctacaagttgctctatcgcagcggcagaacgctggaggaagtgaaaccggagatcgaagccatcgcacagcagcacagcgaagtgcaacctttctacgatttcttcacccgttcaacccgtggattaattcgttaatccatgtcagcgcgtcccttaacgattgccctggtcgccggagaaacctccggcgatattcttggtgcaggtctgatccgtgccctgaaagcccgtcatccggatgcacgctttgtcggcgtggcgggtcccctgatgcaggcagaagggtgtgaagcctggtatgagatggaagagctggcggtgatgggcattgtcgaggtgctcggtcgccttcgacgcctgctgacaatccgtcgcgatctcacccggcgttttaccgaactccgacccgatgtctttgtcgggattgatgcgcccgatttcaatatcaccctggaaggcaatcttaaacgcactggcattcgcactatccactatgtcagcccctcggtgtgggcatggcggcaaaagcgtgtctttaagattggtcgtaacaccgacctggtgctggcgttcctgccatttgaaaaagctttttacgatcgctataacgttccctgtcgttttatcggtcacaccatggcggatgccatgccgctgcaacccgataagctggctgcacgccgtcatctgggcattgccgatgatgcgctctgcctggccttgctgcccggcagccggggtgcggaagtggaaatgctcagcgccgattttctgaaaaccgctcagttgctgcgtcgtcactatccggcgctggaaatcgtggtgccgctggtcaacgcccgtcgccgcgaacagtttgagaagattaaagccgaaaccgcccccgaactgccgatgcatctgcttgatggtcagggacgtgaggcgatgattgcgagcgatgccgcactcctggcgtcaggcactgccgcactggagtgcatgctggcaaaatgcccaatggtcgtcggttatcgcatgaagccggccaccttctggctggcgaaacggctggtcaaaaccccttacgtctcgctgccaaacctgctggcagggcgtgagctggtcaaagagttactgcaggatgagtgtcagcctgaagccctggccgcagcgttagatccgctgctgcatgccgggcctgagcgagaaacactcttgcagacgtttcatgaattacatcaacagatccgctggaacgccgatgagcaggcagcggatgcggtactggagctggtgaatgcctgattttatctatcctgtcgccagactgattgccggtgtggacgaagtggggcgcggtccgctggttggcgcggtcgttactgccgcggtgatcctcgatccggcaaacccgattaccggcctggccgactcgaagaaactgtctgaaaagcgccgcctcgcgttgtatgacgaaatcaaagagaaagcgctggcatggagtctgggacgcgcagagcctgaagagatcgatcagctcaacattctgcatgccactatgctggcgatgcagcgcgccgtagctggccttggcattcagcccgattatgtgctgattgatggtaatcgttgcccggcattgccaatgccttcacaggcggtagttaaaggggatagtctggttgccgaaatcagtgcagcatcgatcatcgccaaagtgtcgcgtgaccaggagatgaccgaactcgatctgctgttcccgcagtatggttttgcgcagcacaaaggttatccgacggcgctgcatatggaaaaactgacgcagtatggcgtcacgccgcaccaccgtcgcagttttgcgcccgtacgcaatgcgctgctcgatgctgaagtactggctgcacgccagacccttacgctttaatagcctgacgctgttttaaccggaaactgatatggctgaaccccgttttatacatctgcgtgtccacagtgactattcgatgattgatggcctggcgaaaaccgggccgttaatcaagaaggcggcagcccttggcatgccggctatcgcgattaccgacttcactaacctctgtggcctggtgaaattttacggtggcgcacatagcgcagggataaagccggtcattggtgccgatttcaacgttgccagtgagctaatgggggatgaactgacacagcttactgtgctggcgtccagtaataccggatatcagaacctgacgctgctgatctcccgtgcctatcagcgtgggtatggcgtggacggaccgatcatcgaccgcgactggctgattgaattgcaggaaggattaatcctgctgtcgggcggacggcgcggcgatgtgggtcgcagcctgctgcgcggcaacaatgccctggtttcgcaatgcctgtcgttttaccagcaacatttccccgatcgctattacctggagctgattcgtaccggccgtcaggacgaagagagctatctgcatgcggcagttgaactggcgattgcagagggaataccggtggttgccaccaatgaagtctgctttatcaatgcagaagatttcgatgcgcacgaaattcgcgttgccattcatgatggctatacgctggatgatcccaagcgtccgcgtaactacagtcctcagcaatatatgcgcagcgaagaggagatgtgcgagctcttctcggacatcccggaagcgctggaaaacagcgtagagattgctaagcgttgtaacgtcacggtccgactgggcgagtacttcctgccgcagttcccgaccggtgacatgaccaccgaagattatctggtggtgaaatcccgtgagggtctggaagagcgtctcgagttcctgttcccggacgaagccgaacgccttgagaaacgcccggaatatgatgaacgtctggagattgaactcaacgttattaaccagatgggtttccccggctacttcctgatcgtaatggagttcatccagtggtccaaggacaacggcgtgccggtcgggccggggcgtggttccggtgccggttcgctggtggcctatgcgctgaaaatcaccgatatcgatccgctggaatttgacctgctgttcgaacgcttcctgaacccggaacgcgtctcgatgcccgatttcgacgtcgacttctgcatggagaagcgcgatcaggtgatcgaacacgttgcagatatgtacggacgtgaagcggtttcccagattattaccttcggcaccatggcggcgaaagcggtcattcgcgatgtgggccgcgtgctgggacatccttacggcttcgttgaccgcatttcaaaactgatcccgcccgatcccggcatgacgctggaaaaagcttttattgctgaaccgcagcttcccgccatgtatgacgcggacgaagaggttaaagcgctgatcgacatggcgcgcaagctggaaggggtcacgcgtaacgccggtaaacatgcgggcggcgtggtcattgcgccaacgaagatcaccgattttgcgccgctctattgcgatgagcatgggcagtttcccggtaactcagttcgataaaaatgatgtggaatatgccggcctggtgaagttcgacttcctgggtctgcgtacgctgaccatcatcgactgggcgctgaagatgatcaacccgcgccgggaaaagcaggggctggagccgatcgatatcgcctctatcccgctggacgataagaaaagcttcgatatgctgcagcgctcggaaaccactgcggtgttccagcttgaatcgcgcggcatgaaagatctgattaagcgtctgaagcccgactgcttcgaagatatgatcgcactggtggcgctgttccgtcctggcccactgcagtccggcatggtggataacttcattgaccgtaagcatggccgtgaagcgatctcctatcccgacattcagtggcagcacgaaagcctgaaaccggtgctggaaccgacctacggcatcatcctttatcaggaacaggtgatgcagatcgcccaggttctctccggttacacgctgggcggtgcggatatgctgcgtcgcgccatgggtaaaaagaaacccgaggagatggccaaacagcgttctgtattccgcgacggtgccgaaagtatgggcatcgacggggaactgtcgatgaagatcttcgatctggtagaaaaatttgcaggttatggctttaacaagtcacactctgcggcctacgcactcgtctcctaccagacgttgtggctgaaggcgcactatccggctgagtttatggctgcggtcatgaccgccgatatggataacaccgagaaagtggttggcctggtcgatgagtgctggcggatgggactgaaagtcctgccgcctgatatcaactccggtctctatcagttccatgttaatgacgcgggcgagatcgtttacggtatcggcgcgatcaaaggcgtcggtgaaggcccgatcgaagcgatcatcgacgcccgtaacgaaggcggttatttccgcgagttgtttgatctctgcgcccgtaccgacaccaaaaagatcaaccgtcgggtaatggaaaaattgatcatgtccggggcctttgatcgccttggaccgcatcgcgctgcgctgatgagttcactcagtgacgcgttaaaagcggccgatcagcacgcgaaagcggaagcgattggccaggctgatatgtttggcgtactggcggaagagccggagcaggttgagaaatcgtacgccagcgtcacgccgtggcctgagcaggtgcagctggatggcgaaacgggaaacgctggggctttaccttaccggccacccgattaatcagtacctgaaagaaattgagcgttatgttggcggggtgcggctgaaagatatgcatcctaccgatcggggtaaaattaccgtggcggccggtctggtgatcgcggcacgggtaatggtcaccaaacgcggcaaccgaattggtatctgtactctggacgatcgctccggtcgtcttgaggtgatgttatttaccgatgcgttagataaataccagcagttgctggagaaagaccgaattctgatcgtcagcggacaggtcagctttgatgacttcagtggtggccttaaaatgaccgctcgtgaagtcatggacatcaacgaagctcgcgaaaaatacgcgcgcggacttgctatctcgctgacggacaggcaaattgatgaccagctattaaaccgactccgtcagtctctggaacctcatcgatcagggactattccggtgcatctctactatcagagagccgacgcgcgagcgaagctgcgctttggtgcagcgtggcgaatttcgcccagcgatcgtttacttaacgatctgcgctcgttgattggatcggagcaggtggaactggagtttgactagaacaggaacattatgagtcttaattacctggattttgaacagccaattgcagaactggaagcgaagatcgattcgctgacctcaattggtcgtcaggatgataaacacgttaatctggatgaagaagttcagcgtctgcgtgagaaaagcgttgagctgacccgtaagatcttcgccgatttgggcgcatggcaaatcgctcagctggcgcgtcatcctttgcgtccttacacctttgactacgtgcgcaacgccttcgacgatttcgatgagctggcgggcgaccgtgcttatgccgatgacaaagcgattgtgggcggcattgcacgtcttgatggacgtccggtgatgatcatcgggcaccagaaaggccgtgaaaccaaagagaaaattcgccgtaacttcggcatgccagcaccggaaggctatcgcaaagcgctgcgcctgatggagatggctgagcgtttcaaaatgccaatcatcaccttcatcgacacaccgggtgcctatccgggtgtgggcgcggaagagcgtgggcagtctgaagcgattgcccgcaacctgcgtgaaatgtctggcctgaaagtgccggtgatctgtacggtcatcggtgagggtggttcaggtggtgcgctggcgattggcgtgggcgacaaagtgaatatgctgcagtacagcacctattcagtgatctcgccggaaggctgtgcatctattctgtggaaaagcgctgacaaagcgccgctggccgctgaagcgatgggcattaccgctcaccgtctgaaagagctgaagctgattgactccgtgatccctgagccgctgggtggcgcgcatcgccgtccggttgatatggcgcagtcactgaagcagcagctgctggccgatctggccgatctcgatggatttagcactgaagagctgctggatcgtcgttatcagcgcctgatgagctacggctacgcctgatttagccccatcaataaaagcggactccggtccgctttttttatgccgccggtttatctccgcacgctattcccctctctttcagcgccatccgatagccgccttgctacaccttccgcgggttagcggttatgcttgtccggttccacaataatcagggagatgggcattgaatattctggcgatcatgggcgcgcacggcgtgttttataaagatgaaccgttacgcgaactcgacgcggcgttaaatctgcaaggcttcaggctgctttacccgaaaaacagtgacgatctgctgaaactgatcgagcacaatccgcgtatcagcggcgtcatcttcgactgggacgcgcacaacagtccggaaactctgcggtgagattaatcagctcaacgaatacctgccgctgtacgcctttatcaacacccactcgcagatggatatcagcgtcaatgagatgcgtatgccgctgcacttttttgagtacgcgctgaatgccgccgacgatatcgcgctgcatatccggcaatataccgatgactatctcgaccacattacgccaccgctgactaaagcgttgttcacctatgtgaaagagggcaagtacaccttctgcacgccgggccatatggcgggtaccgcgtttcagaagagcccggtgggctgcctgttctacgatttcttcggggccaataccctgaaatcggacatctcaatttccgttaccgaactgggttcgctgcttgatcacaccggtccgcaccttgaagcggaggagtacattgcacgcacttttggcgccgaacagagttacatggtgaccaacgggacctcaacgtcgaacaaaattgtcggcatgtatgccgcaccggcgggcagcaccgtgctgatcgatcgcaactgccacaagtcactgacccatctgctgatgatgagtgatcttatccccatctggctgaagccgacccgcaatgcattgggtattctcggcggtatcccgaagcaggagttcacccgcgagagtatttcgcccaaggtggctgccaccgaccgtgccacgtggccggttcatgcggtgatcaccaactccacctatgatgggctgctctacaatacccagtacatcaaagagacactggatgtaccgtcgattcatttcgattcagcgtgggtgccttacaccaatttccatccgatctacgccggtaaaagtggcatgagtggcgaccgcatcccgggcaaagtggtgtatgagacgcaatcgacccacaaactgctggcggcgttttcgcaggcatcaatgattcacattaagggcgactacgacgaacagacgtttaacgaagcctacatgatgcacaccaccacctcgcccaattacgccatcgtctcctctattgaaactgctgctgccatgctgcgtggcaatcccggtaaacgactgatcaatcgctcggtggagcgcgcgctgcacttccgtcgggagatccagcgcctgcgcgaagagtccgacagctggttctttgatatctggcagccggaagaggttgatgaagcgcaatgctggccgatccagcccggcgacgaagagtggcacggatttactcaggccgatcgcgatcatatgtacctggatccgatcaaagtcaccattctgacgccgggcatgagcgaactggggaagatggcggaagaggggatcccggcggcgctggtggcgaagtttctggatgagcgcggcatcgtggtggagaaaaccggtccctataacctgctgttcctgttcagcatcggcatcgacaaaaccaaagcaatgagcgtgctgcgcgggctgaccgagttcaaacgcgcctacgatctcaatctgcgggtgaaaaacatgctgccggatctctatgccgaagatcctgacttctatcgcaatatgcgcatccagacactggcgcaggggatccatcagttgatccgccatcacgatctgccgcgtctgatgctgcaggcatttgatgtcctgcccgaaatgaagatgacgccgcatcaggcatttcagcagcaggtgaagggcaacatcgaaacggtggatctcagcgaactggtcgggcgggtgtcggccaatatgattctgccttatccgccaggcgttccactggtgatgccaggcgagatgattactgagaagagccgcgcggtgctcgattttctgctgatgctgtgcagcattggacggcattatccgggcttcgaaacggatattcacggtgccagcctgaccgaagagggcgagtatcgcgtccgcgtgctgaaaaacgacctcgcataaatctttaaacaactatcagcggcagggtgtctgcggacagcctgcccgaatcagggaattgaacatgttgcagttaaccgctattcaccacatcgccatcatcgcctctgactatcagcgcagcaaagcattctattgtgatgtactgggtttccgtctgatgggcgagtattaccgcgaagcgcgggactcctggaaaggcgaccttgccctacaggatcgctataccattgagctgttctcttttcctgagccgccggcgcgggtcagccatcccgaggcgtgtggcctgcgtcatctggcctttagcgtgccggatgttgccgctgccgtcgcgacgctggccgataaaggcgttatctgcgagccgattcgcattgatgacctgaccggtaaacaatgcactttctttgccgatccggatggtttgccgctggagctttatcaggcgtaaaatagcgcgctcagcgggcgacattcagtggcccgattttctggattctgccatgtctttgcccgcttttgacactctgttgcaatctgatgccgccctggtggtcgcattcagcggtggactggattcaaccgtgctgctacatcagcttcgcggctggcagcagcagcatcctcagttgcgcctgcgggcactgcatgttcaccatgggcttagcccgaatgccgatcgctgggcaacccattgccagacgatttgcgcgcagtggcagctgccctgtgaagtgctccgcgttaacgttgatggccgggaaaacggcattgaagcggccgcccgcaccgctcgttatcaggcgctgagtgcggcactgcagccgggcgaagtgttactcactgcgcagcacctcgacgatcagtgcgaaacattcctgctggcgctgaagcgcggcagcggtcccgccgggctggcagcgatgcccgctacacgcgcgctgggttctcatcagctggtgcgtccgctgctgaatcagacgcgacagtcgcttgaagcctatgccgacgcgcatcagctggtgtggattgaagatgagagcaatcaggatcttcgctacgaccgcaactttctacgtcagcggctgctgcctgagctttaccagcgctggccccattttgccgaagcaacggcccgcagtgcggcgttgtgcagtgagcaggagcagttgctggatgaactgctcgccgggcaactggctgagctgatccagcctgatggcagcctgtactttccacccttaatggccatgagtgagctacgtgctaatgccttattgcgccgctggatcgccggacagggtggggcgatgccgtcccgtgaagcgctgaaacgcatccacgacgaagtgatggcgagccgggaggatgcgcagccccggctgcgattcggtcaggctgaactccgtcgttaccgtcagcagctctactggctgccgttgctcagttcactgcgcgacaccgagctggcatggcccgatctctgtcagccgctggcgttaccacagaaccttggcacgctgcgtgccagccagtcgcagagcctgttgcgctatccagagccggatgagcaggtcagcgtgcggtttcacgcacagggttatgtccatctggtaggccgtcgtggcggaagggaaatgaaaaaactgtggcaggagttacagataccgccgtggcagcgtgaacggctgccgttaattttttataaccagacgctggtctgcgttccgactctctttgtcacctgtgatggcgcggcctctgatcagcagggctggcagatagtctgggacggggcatccggcgcaggagaacaacaataatgaaacagtggcttatcgcctgtttagcggtcaccgtgttaccggcatgggcagcgggtgatgcgcagcgcggcgcacagaaagcgggcagttgcatggcctgtcatggcgcagcgggaaaagcggcggtgccgctctatcctgacctggccgggcagcacgcaccttatctggaacatgcgctgcaggcctataaaaagggcgaacgcagtggcggtcaggctgaagtcatgaaagcatttgtggcgggattgagtgacagcgatatggcggatttagcggcgtactacagttcgttacagccctgaagtttaacagggcggaaaggtcccgccctgaatgcgtaggttactctgcgctgacaaccaccgtacccaactcgggatgggtgaagctggcgatatggtcgagacgtaattcgcgatgttcaccggaaagatcgatagccagatattcaacgttcttacgtgaaaagatctctttggcttttgccttaagctgctcgccatctttcatttccagcgacagcatccagttgttctggcaggcgagttccagattatcgtaatcatcgcaattgataggttggtacgcttcatttatcaacatagtcgctcaccaataagttagcagcggcgtaggccgcctgtttccctgacagaagagtttagctcagtatttgcggcaacatcattaagtgccttcaatgcgcagccaatcgcatccggtatgtaacctaaatccccgctgccgatttcggcatacttccggcgaactaactcacaataattttgcacgtggccctcctcggcagagcgtaaatactctggttaactggcgactatatcatagccatttagaggaaatcagcctgcgtaaagcaggaacagtgcgcgaatcactgctaaagtgacagattccgctgtctgaggcggaataaatcagagcacaaaaggttaatttgatgaacaggttatcggaggtcaacgtggttaaggtgtggggagcgagcttatgattatgctatcccgttcggttgagattccggagagtgagattgagctgacggcgattcgtgctcagggcgcaggcggacaacatgtcaataaagccagcaccgccattcatctgcgcttcgatatcgctgcctcttcactgcccgcgttttataaagagcggctgctcaccgccactcatcatttgattaccggtgatggcgttgtagtgatcaaggcgcaggagtatcgcagtcaggagatgaatcgtgaagcggcgctgcaacgtctggttaatctgatccaggagctgagtaccgtggaaaaagcccggcgcgccacgcggccgacccgcgcctcaaaagagcgccgtctggaaggaaaagcccgccgcagttcaactaaatcgatgcgcggcaaggtacaataaaaaacgccccgcaggcggggcgtttgagtacttacaacgtcaggggcgagcggcgaagagatcgagcctgctcagggaacggggtcagatctgaaagtcgctaaagccatccatggccgctcggcccgcaccgtccctggcgcgggacgctttcctctcctgacccggttcccttcgcgttgagctcatctgttgcggccagattcagcccgctttgattaacgctaagaacttacttattcagagccttcagcaggaattcaacaatttcatcctgcttaatcatctgcttctcaccggcacgacgtgatttgtactcaatctcctgattatcgagattgcgatcaccaatgacgatggtgtgtggcacaccgatcagttccatatcagcgaacatcacgcccggacgctctttacggtcatccagaataacctcaacgcctttagcacgcagggtggcatacagctcttccgccagctctttaacccggaacgatttctgcatattcattggcagaatcgcaacctcgaaaggtgccagtgcggctggccagataatgccgcggtcgtcatggttctgctcaatggctgccgcaacaacgcgggtgatgccgatgccgtagcagcccatgctcatcacctgattgcggccatcttcgccctgaacagacgctttcagcgcgtcagaatacttggtgccgagctggaaaatatgaccgacttcgatgccgcgcttaatctgcagcgtgcctttaccatccgggcttaaatcgccttcgaccacgttacggatatccgcaacgctggccagcggcagatcgcgctcccagttaatgccgaagtagtgcttaccatcgacgttggcaccggcgctgaagtcgctcatcttcgccacggtacggtcagcaatcacaggcatctgcagaccaaccgggccgattgaacccggtccggcacccactgcggcgcgaatctcttcttcggtcgcgaacaccagcggtgatgcaacgatctctgacttctccgctttgatctcattaagctgatgatcgccgcgtaccagcagggcaaccagcgcgtggccgctctcttcagcacctttaacaatcagcgttttcactgttttttcaacaggcacactgaattgctcaaccagctccgcgatggtttttgcgtctggcgtctcgaccagttgcatctcctgcgacggcgctgcgcgctcaccggcgggtgcgacggcttcggccagctcaatgttggccgcgtaatcagaatcggtagagaagatcacatcatcttcaccgctctgcgccagaaacctggaactcatgggaggcgctgccgccaatcgagccggtgtcggcctgcacggcgcggaaatccagacccatacggctgaagatctggctataggcgcggtacatcgcgtcatacgtttcctgcagcgattcctgcgaaacgtggaacgagtaagcatctttcatgatgaattcacgtgaacgcatcacgccaaagcgcggacggacttcatcacggaatttggtctggatctgatagaggttgagcggcagttgcttataagagctcagctcattgcggatcaggtcagtgaccacctcttcatgcgtcggacccagcacgaacggacgctcgtggcgatctgcaatacgtaacagttccgggccatactcctcccagcgaccgctctcctgccacaggtcggcgggctgcacaaccggcattaaaatctcaaccgcgcccgcgttgttcatctcttcgcgcacgatgttttcgacttttttcagcacgcgaaccccggtcggtaaccaggtgtacaagccagaagccagtttgcggatcataccggcgcgcagcatcagctggtggctgatcacttcagcgtcggaaggcgtctctttctgagtagagagcagatattgagtagtacgcattgattacggttccagttgatcggaaagtcacagacagaattttgctggcggctagtgtaccagtgagatcaccggctcaaaagcgggttttaacgcgggtcgatggcgatcacttcagtaccggcatcgtcaatgcgccagcgtacattaaaatccatcagccaggccgcatattcccgcgcctgtgtctcgccctgacggtaagcgggacggggatcctgtgccagcacttcactgataaagcgagccagattggggtagcgcgactgctggtgaagctgctgttgtgccagcgcggagaagcgaaccggcatatcagccgcaggtgccgcctgagcaaaacccgcctgggcatgcggcaatgcttcggcaaagggcagataaggtttgatatccaccaccggggtgccatcgaccagatccagactgccaagctgcaggatcacctgctgtttttcaatcctgataccttttagctcaaccagcgacatgccaatgggattgggacggaacgttgaacgtgtcgcaaatacacccatgcgcgcattgccgcccagccggggagggcgaaccgtgggacgccagccgccctccatcgtctgatggaagacaaacagcagccagaggtggctgaacgcttccagtccacgcaccgcttccggctgattgtaaggtggctgcaggtgcagttcgccgcccccatcctgcaccagccctggctggcgcggcacggcaaacttctccttccatggtgagcggattaccccaatttgcgcaaaggcaaattcactcattgattgctgactttcagtgccgaaccctgacacaccgcctgacgatagcagcctggcgtgccggtgacgatttcacactgatgcagcagcaccgcattggctttcatctgtgacgctttgatctgcagacgtttacgtgcagtagcgatgttggctggggagttctgattactcatctggcaatcttcagcggagacttcacccagatcgcggaacggcttgctgaccagatcggcggcatcagtatagagcttaaccggtgccggtcgtgacacaggcttgcgggtgggttcactggattgctgcggccgggacggtgcgctgcttatcgggtgatactcatgaacacaccctgtcagcatcaatgctaacaagcagagcggtaaaaaacgcatggcaacatcctcaggtttcaaaaagtggcgttattgaaacaaggacaagaataaataacaagtcgggcagggcacccaataacagaaagggcggcatagcgccgcccttaaggagatgaacagctgaattaccagcctttaaccgcgccgccgttaaagactttgttagcggcatcgtagacttcgtcagactgataagccttgacaaatttcttcacgttttccgcatctttattatcttcgcgcgccacaatcaggttcacgtacggtgaatctttatcttcgacgaaaataccatctttggctggtgtcaggccaatctggctggcgtaggtggtgttgataaccgccagcgcgatctgctgatcgtccagtgagcgtggcagctgcggcgcttccagctcaacaattttcagatgcttagggttttcagtgatatccagcgaggttggcagcaggcccacgccatctttcagcttgatcagacccactttctgcagcagcagcagcgtacggcccaggttggtcgggtcgtttggaatggcaacctgagcgccatcctgcagctcatccagtgacttaatctttttcgaatagcccgcgattgggtagacgaaggagttacccactgaaaccagcttgtagccacgatctttgatctgctgatccagatacggtttgtgctggaaggcgttgacgtcgatatcgcctttgctcagtgcttcattcggcagtacgtaatcgttgaaggtgaccagctcaacgtccagaccatatttctctttggcaactttctgcgctgcttcagcaacctgctgctcagcaccgacaatcacacccactttgatgtggttagggtctttctctttttgatcgcatcctgccagcgcaatcgcgccaatcagtgcacccacagcggcaattttcttgaatctgaaagacatatcctttccttcttaataatgtgatattgctggcttatttatgggacaccgcacgcacgatgcggtcgccacagaattgaatgagatacaccaaaaccactaacaacaccaataccgtattcatcacagtggcgttatatccgatataaccatactgataaccgatctggcccagaccaccggcacccaccgcgccacccatggcggagtaaccaaccagggtaatcagggtgatggtcgcagcattcaccaggccaggcatcgcttccggcagcagaaccttacggatgatctgcattggcgtagcgcccatggcacgtgacgcttcaatcagtccggttggcagttccagcaaggcattttcaaccatacgtgcgataaacggtgccgcgcctacggtcaacggcacgatagccgcctgcagtccgattgaggtgccgacgattacgcgagtaaaaggaatcatccagaccagtaagataatgaaaggaatggagcggaagatattcaccagcgcggagagcacgcgataaagtccctgattctgcagaatctggcccggacgggtgacatagagtaaaacgccgaccggcagacccagcacaaaaccgaaaaagcccgagacgaaggtcatcatcagcgtttcccacacgccccgtcccagcaaccacatcatcgcttcagacataacctaacacctctactttcacatgattctccttcagccaggctatcgcctcgcgggtatcgctttctgtgccgtgcatttcggccagcataatgccgaacttcacgccaccggcgtaatccatctgggcactgataatgttgttattcacgttgtaacggcgggcagcttcagacagcagcggcgcatcaaccgatttaccggtgaattccagtcgcagcaggggcacggtgccttcagcggcggtggcagaaaggcgctgctggtaatcatccggaatatccagatgcagcgtagactgaataaactgctgcgccagcggtgtcttaggatgagagaagacctcactgacgctatctttctcaatcagttcaccgtgactgatgaccgcaacctgatcgcagatgcgtttcactacatccatttcatgagtgatcagcagaatcgtcagcccaagccggcggttaatgtctttaagcaattccagaatagagcgggtcgtcgcgggatccagtgcgctggtggcttcatcacacagcagaaaccttgggattgctggccagggcgcgggcaatcgcgacacgctgcttctgtccgcccgacagattggcgggccaggcatcatgcttgtctgataatcccaccagttccagcagttcagttacgcgagccgtgatctgagcgcgggagagattaccgagttccagtggaagagagacgttacccgcgacggtacgggagttcatcagattaaagtgctggaagatcatgccgatctggcggcgcgcctgggttaactgacgttcgttgagtgcggttaaatcagcaccgtctaccagtacgcggcccgaagtagggcgctccagcaggttaacgcaacgaatcaacgtacttttaccggcaccggaagcgccgataacgccataaatctgtccggcaggcacgtgcaggctgacatccgttagcgccggaacagaccgcgtaccttgctgaaacaccttggtaatattttctagtttaatcattatgttatttattatcgtgttgcgttgtccgtggtgtgggaagcctcgtcgcttttattcggtataaaagctggatggatgttaaggcatccagacgtctaaatcaatggaagtgattcaatctgacattctcccttttatagcaatcatgcgatactgatcggcaatttttacagcaggagtttctacgtggcgaataaagtccccgctatttttcttgatcgtgatggcacccttaatgtcgacaatggctatgtccatgagatcgatgacttccagtttattgacggcacgattgaagcgctgcaacaacttaagacaatgggttttgcgctggtggtcgtgaccaatcagtctggcatcgcgcgcggtatgtttactgaagatacctttatgcggctgacagaatggatggactggtcgctggccgatcgcgatgttgatcttgatggcatctatttctgtcctcaccatcctgaagcaacagtagcagagtttccgtcaggcctgtgactgccgcaagcctcagccgggtatgctgctgacggcgcaggaagaactgaatattgatatggccgcttcttatatggtgggtgacaagctggaagatatgctggcagggcaggctgccggtgtcggcaagaaagtactggtgcgcagcggcaaaccggtcactgctgaaggtgaagcagcagcagattgggtgattaatagcctggcagagcttccggcgcgcattaaaaaggggtaaaacggcgcttttgtgcaaatttcagacgaacagaaaaaaagtctcaatttgcacttgcgctatctgagccgttccctataatgcgcctccactgacacggcaaaccggaaacggaaaacgggtcaggaggcacaggagaatgcgccgccggagaaaaacttctgagaaagaggttgactctgcaggaggaaagcgtaatatacgccacctcgcgacaggacgctaacgcactgttcgcactgctctttaacaatttatcagacaatctgtgtgggcactcgcaggattgatatcagcgtctccggacgtaaaaaatatcaagcctcacgagtgaacacataatgaaattcattatgacgttttacagatgagcaccgcttaacttgtttaagcaaatcaaacttaaattgaagagtttgatcatggctcagattgaacgctggcggcaggcctaacacatgcaagtcggacggtagcacagagagcttgctctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttagcagagatgctttggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaagataccttcccgcgcagtgtccacacagattgtctgataaaaagtaatgagcaggacggctgcgaagtcgtgacacttttgtgtccccttcgtctagcggttaggactccgccctttcacggcggcaacaggggttcgaatcccctaggggacgccacctgcttggtgacaggtgaaaggtgtctccatacagtatctcaaaaccgatttggttgcgtaagcaaccgggccgcgtttgagatatttgctctttaacaatccggaacaagctgaaaattgaaacgacgcagcgcgtcattcctccgtaatagggaatgacaaagcgatgcgttcgagtctctcaaatgcttgcagcacgcagcgttgtaaaacgcctgtgggttgtgaggttaagcgactaagcgtacacggtggatgcccaggcagtcagaggcgatgaaggacgtgctaatctgcgtaaagcgacggtaaggtgatatgaaccgctacagccgtcgatgtccgaatggggaaacccggtgcactctgtgcatcattgcagcatgaatacatagtgctgcaaggcgaaccgggggaactgaaacatctaagtaccccgaggaaaagaaatcaaccgagattcccccagtagcggcgagcgaacggggagcagcccagagcctgaatcagcttgtgtgttagtggaagcgtctggaaagtcgcagggtacagggtgatactcccgtacacaaaagcacacatgctgtgagctcgatgagtaaggcgggacacgtggtatcctgtctgaatatggggggaccatcctccaaggctaaatactcctgactgaccgatagtgaaccagtaccgtgagggaaaggcgaaaagaaccccggcgaggggagtgaaacagaacctgaaaccgtgtacgtacaagcagtgggagccttctttatgggggtgactgcgtaccttttgtataatgggtcagcgacttatattctgtagcaaggttaaccgtataggggagccgcagggaaaccgagtcttaactgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaactcatcttcgggggtagagcactgtttcggctagggggccatcccggcttaccaacccgatgcaaactgcgaataccgaagaatgttatcacgggagacacacggcgggtgctaacgtccgtcgtgaagagggaaacaacccagaccgccagctaaggtcccaaagtcatggttaagtgggaaacgatgtgggaaggcacagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagccgtcgaaggtgtgctgtgaggcatgctggaggtatcagaagtgcgaatgctgacataagtaacgataaagcgggtgaaaagcccgctcgccggaagaccaagggttcctgttcaacgttaatcggagcagggtgagtcgacccctaaggcgaggccgaaaggcgtagtcgatgggaaacaggttaatattcctgtactcggtgttactgcgaaggggggacggagaaggctatatcagccgggcgacggttgtcccggtttaagcgtgtaggcggagtgtccaggtaaatccggacgcttgttaacgctgaggcgtgacgacgaggcactacggtgctgaagtgataaatgcccagcttccaggaaaagcctctaagcatcaggtaacacagaatcgtaccccaaaccgacacaggtggtcaggtagagaataccaaggcgcttgagagaactcgggtgaaggaactaggcaaaatggtgccgtaacttcgggagaaggcacgctggcgcgtaggtggagggactagctccccgagccgaagccagtcgaagataccagctggctgcaactgtttattaaaaacacagcactgtgcaaacacgaaagtggacgtatacggtgtgacgcctgcccggtgccggaaggttaattgatggggttatccgcaaggagaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactacagcttgacactgaacattgagccttgatgtgtaggataggtgggaggctttgaagcgcggacgccagtctgcgtggagccaaccttgaaataccaccctttaatgtttgatgttctaacgtaggcccgtgatccgggctgcggacagtgtctggtgggtagtttgactggggcggtctcctcctaaagagtaacggaggagcacgaaggtcagctaatcacggtcggacatcgtgaggttagtgcaatggcataagctggcttgactgcgagagtgacggctcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgctggagaattgaggggggttgctcctagtacgagaggaccggagtgaacgcaccactggtgttcgggttgtcatgccaatggcattgcccggtagctaagtgcggaaaagataagtgctgaaagcatctaagcacgaaacttgccccgagatgagttctccctgactccttgagagtcctgaagggacgttgaagactacgacgttgataggccgggtgtgtaagcgcagcgatgcgttgagctaaccggtactaatgacccgtgaggcttaaccttacaacgccagaggcgtttttgcagagacaggttttcagcttgttaaccggatacagttgtgtcctgcggactgaagtccgaaggattttgcgctgaggcaaggcggcaaccgagcgatacgaaggagcatactgaagtatgtgacggagtagcgcgagggcgaccaacgcagcatcagcacaaaagacacaggacagagcacaaagaatttgcctggcggctttagcgcggtggtcccacctgaccccatgccgaaactcagaagtgaaacgccgtagcgccgatggtagtgtggggtctccccatgcgagagtagggaactgccaggcatcaaattcgttccttttcccctgacaaggaaaataacaggaacagacggccatcagcccgttgctgacagctgtgaaagaatcggtggagcggtagttcagttggttagaatacctgcctgtcacgcagggggtcgcgggttcgagccccgtccgttccgccacttaattggaaagccctgacttaacggtcagggctttttccattgcagcaaattcaacacggaaaaatacaccgcgctgattctcttcgatctcccggatcattttaacgatcgctaattctttgaatctgaagcgataatcccgcgagcgatcccacccctcccaattgtgtgcgggcagaccccgatcaggcctgcccctgtagacttcaggtacgccacggttggtcagctgtccactcactcagaaaatcgataaaagcgcgcacacgctggcttacgccaatatcactatagtaaacagcatggaagggcatctcgaccggcagacgctgatcggccaacacttccaccagttttccctcagcaacttcacgatcgatcatatagtccgacaggcaggcaataccattaccggtaagacagagctgcttaatcgtctctccgctgttagaggaaatagtccagctaatatcatagagtttcgccgctttcacgggagacgggccagcgattgagtcgtggggaatcatcaaagccgagacaatggtgattatccagctcagccaccgtttgcggtgtcccatgctcacggagataggcgggtgaagcaaccatcttgcgaaagctcctgaacagcagccgggcgcgcagcgttgagtcggtgagattgccggcgcgaatggcgatatccactttccgctcaatcagattgataaaactctctgaggagatcaaagaaagagtcacgtcaggatagcgcagacgaaagggtttaatcatcggcatcagcaaatgcagaatgaccggcgtcgcggcatcaacgcgcagtagtcctttaggcgcctgtaaactctcgatcaaatcgctttctgccgtggtcatctcctgcaaaaaacgttgaacatggcgaaaatagcgttcgccctcctgagtaagcgccagctgccgtgttgtgcgggtcagcagggcaatacccagcttgctctccagctttttaactgtcctgctgacggcagagttagccatcttcagctgttcagcagcgcgactgaaacttccattttctactacgctgacaaacacttttagttcatcagaagatgccttcattcttcctccctgcagtcacatggccattaagccagtttatgactgataatgctgttataaccagtacaggagccgttaacgatgacatcggggatgtcaccgcctgatctgcctcgttttgcttagcgaacgtaaaagggctgctttattctggaaaaggtgatgaattctgacattcacctgcatccattgaaaccccggtctaaaatccctataacagacaggtattaactgtattttgaatcatcagccaggcgggaaagtgcgcaaaaaaacttatgcaatgcgatatgtagcaggacaaccagtggaacagatctttccacctggcgcgatgctccatctcggtcaggcactgccacccggcgcacccttgcccgcgcacccaaacctcaaagttctggtgtggaacatcttcaagcagcaacgcgcagactggatgtcggtactggaaggatttggtaaagatgcgcacctggtattactgcaggaagcgcagaccacaccagaaactggtggagtttgccaccagtaattatcttgctgccgatcaggtacctgcctttgtgctgcctcagcatccctctggggtgatgacgctcgcctctgcgcacccggtctattgctgcccgttgcgtgagcgtgagcctctgctgaggctgtcaaaatcggcactggtcacggcgtatccgctgcccacgggggaaatgctgatggtcgtgaacatccatgcggtaaatttcagcctgggcgtcgacgtctacagtaaacagctggggccaatcggggagcagatcatgcatcaccaggggccggtgattatggccggggatttcaatgcctggagccgtcagcgtatcaatgcactctaccgttttgcacagcgaatgaagctggaagaggtcatgttcactgccgatcaccgccgtaaagcctttggtcgcccgctggatttcgtcttctatcgcgatctcagggtgagtgaggcatccgtactggtgacgcgcgcgtccgaccataaccccttactggtggagttcagttcaggaagctagtccggtgcattaagcgagcctgctgaaggggagggaagtccggcagatgagtaaacggtggcggatgaataaaagaaaaaggctgacaaatgtcagccttttcaacgtatcaggtatcaggtatcaggtgttgcgttattattcacaaacagcgttaagttatcgccgggttgaatatctttcgcactgtccagcacactgttccagcgcatcacgtctttgatattaacgccgtgatgacgggcaatactgtcaagagaatcacccttacgaacacgataggtgatgctgttgccgttatcagccagtcgggtgccattcgaaccaatggtcagagtctgacccggtcggatatcagcaccgcgcaggttgttatcctgcttcagtgtcgagacgctaacgccaagttttgaggcgataccagagagcgtatcaccacgtcgcactttgtacccgccactcgcactggctttcgcaagctgagtaggctgtaccgctgcgatgtcaccggaagccagtgagttacgcagtttcgcgacgttcgacttcggcaccataatatagtgtgggccgtttggcgctgttgcaccgcctttataaccggtattgaagctcttcagtttcgtgagcgacatacccgccatttcggcagcctgcgtcagctgtatctgctgacccacttccactcgcgccagagcacgactttcattaggtgtcggcagtttgataccgtaacgcttgttatttttgagcagttcactcagagctaacattttaggcacatacacggtcgtttcgcgtggcagcgataaatgccagaagtcagtcggcttaccgcgcgccttgttctgctttatcgctttgagtacacgtccttcaccactgttgtacgctgcgatggttaataaccagtcgccgtcaaacatggtgttaagacgctgcatcatatccagcgcaactttcgtggatgcgaccacatcgcgtcgcccatcgtaatactggttctgtttcaaaccatagtttcgacctgttgcagcaacaatctgccagataccagcggcattggcggatgaagttgcccgggggtcaaaagcgctctccactatgggtagcagtaccagttccatcggcattttacgtttctgtatctgctcgactatccagtacatgtacggctctgcccgtaatgttacatcgtggagatagctcttattttttaaaaatttacttttttgttcgcggattgccgggttttccggaatccccatcttcaactcgtcactaatgaaactccagagatctgcgtctgctgcgaggccagttccatcttcctgccatcgcggcgacaaaaactcgtctccgtactttccattttcaccttgaccagctgaagacagactctgtgcatgctgtaccgggatattggcatcgtttcctggacgcctgacatcctaccagcaagactgaggcgagtaagatcgctttagccttcatgtgtgtgtcaatagttcgcttaaaagacgagcaactatacgtgacgacttttcacaacacaacccgaaaaatcaaaaagcgtctttcttctcgcgtagaacggcaaatgaacgccatacgggttcatcagtaacgttaacgtttaatgccctttgtaaatcaacgtcttgcgtgcgaagaaataaatttattgtccgttcgtgcgccagttttgtgggcaaactaatgccattttcagcgcgtaagtccttaattttctgatattcggccgttatttgtgggtcgtggggcagaatagccgcagcaaacttcagattggataaagtatattcatgtgcgcagcagactaatgtttcacctggaagctggttaagcttttgaaaggaatcatacatctgctctgccgtgccctcaaaaaggcgtccgcagccgcccgaaaagagtgtgtcaccacagaaaagataaggtgagctgtaatatgagatatgtcctaaagtgtgaccaggggtgtggatcacctcaaacgtcaggcccagtaccgtgaccttatcgccttcgctgactatcgttctggcccctttagccgcagtttcctggggaccatagacctcaaggtgagggaaatgctcgcacagtgttttcactccgcccgtgtggtcgttatggtggtgagtcagcagaatagcgaccggctgccagccgttggaggccattttttctaacaccggttgggcttcgccgggatcgacaatcaggcatttaccgtcatcatcagtcagcgtccagatgtagttgtcctgcaacgcaggaatactggtaagattcatcatcacctctcgcaggtcgtaggaaaaggaagagcgtaaagcatgaagcccgctaaatcacgccagattctgaacgcaccgctgtcatggcgcgatatgccgtggggagattatttccgcgacgcgctaacgcagcagcttcagccttaccttggaaagctttatggctttcatatgcttaagcttggcaacctcagcgcagaaatcaacaccgaaaactgtgctatttcacatcaggtcaatgttggcagggaaggtgagctgttacaggtgctggctgacccgatgcaactgccgtttgagtcgaagtcgatcgatgcctgtttgctggcccatacgctcgcctggagccaggatcctcaccgggtgttacgtgaagtagatagggtgttaattgatgatggctggatgattatcagcggcttcaatccattcagcctgctcggcgtgagtaagatggtgccgggcctgaaccgcaaagccccctggagcggacggatgttcagccaggtgcggttagtcgactggctgggactgttgaattatgaggtggtctatcgcacccgctttcaggtgctgccgtggcatcggcagggcggaaaactgatcagcgcccacttaccggcgctgggctgtctgaatattgtggtggcacgtaaacgcaccttcccgctgctgccgacccgggctaagaagagtatgagcaccagcaagatccgccagacggtcaatgccacacgccagtttccggcaggcagaggatcaggattcggttttataaccgatatcctcaaaagcgggattttcagctgcgctgcgggccagcacgtcgcagcgctcattttccggatgtccggcatggcctttaacccactcccactgaatcttatgggtgctgagtgctaagtcgagacgctgccagagatcgacattcttcaccggctttttgtcggcggttttccagccacgctttttccagttatggatccagctggtaattccctgacgcacatactgactgtcggtactgagcaccacatcgcacggctgggtcagcgcttccagtgagacaatcgccgccatcagctccatccggttattggtggtaaggtgatagcccgcgctgaaggttttctcatgctgaccgtagcgtaaaatcgccccataaccgccgggaccgggatttccaagacaggatccatcggtgaatatttctacctgtttgcgcatctctggtagacttcctctcaaaaacgctaagtctgacataaaacgggtcttatgagcactgcaaataaccgccagatcgttctcgatactgaaaccaccggcatgaacatgatcggggtacattatgaggggcaccgcatcattgagattggtgcggtagaggtgattaaccgtcgcctgaccggtaacaatttccatatgtatctcaagcccgatcggctggtcgatcccgaagcctttggtgtacacggcattgccgatgagttcctggccgacaagcctgcattcagcgagattgccgatgagtttctcgactacattcgcggtgctgaattagtgatccataatgccccgtttgatatcggctttatggactacgagtttgcaaagctgaaccgcggcattgagaaaaccgaaaccttctgcaaaatcaccgacagtctggcgctggcgcgccgtatgtttcccggcaagcgcaacagccttgatgcgctttgctcgcgttacgaaatagacaacagcaaacgaaaccctgcacggcgcactgctcgatgccgagattctggctgaagtcttcctgacgatgaccggcggacagacgtcactctcctttttatcggaaagtgaaagcgcccgacaggcgcagggagagagcatccagcgcatcgtgcgtcccacctctgcattgcgcgtggtcacggccagcgatgaagaagtggttgcccatgagtcacgtctggatctggtgatgaaaaagggtggcagctgcctgtggcgcggctgaattacgcatttttgtggataaaatcaacggcaagctgaaaaaaacagcaaacgatttgttcgcctggaaaaagcgttgacgtcgcaacaggctgccattactatgcgcctcgttcccgacggggaacaaagcgcggagcggtagttcagttggttagaatacctgcctgtcacgcagggggtcgcgggttcgagccccgtccgttccgccaatctctttaaaaaagccgattcagaaatgaatcggctttttgctgtctgctattcagcggcggcctggttcttctgcggcatcacctcgccttgccagcgggcaccatcctccgcctcacgatcttcacgggcaataaagcgatagcagcctgccgccagaccggcaccaataaaccagctgaagttcgccacctgatgcagggaagggataaagctaatcaccaggcaaatcgccaccgatggcagcagcgcgccaatcgctttagggttaaagccaccgcgataccagtaacggcctgctggcgtatcgttaaacagatcgtcgaccgagatacgtccacgtttaatcagatagaaatcggtcagcaaaatcccgaacagcggcccgataaacgatcccagcacatccagcgtgtagtgaatcagctctggagactggaacagattccacggcgttaacagcaccgaccccaccgcagcgatcatcccgccggtacggaaactgattttctgcggtgaacagttagagaagtcaaaagcgggtgagacgaagtttcgccacgatattgataccgatggtggcggtaatcatggtcagcaatccaatcgcgaccgccagatcgttgccgaccatgcttacggtttcgatgggatcggtaatcattttgccaaacagcgactgggtgcccgacacaatcactacggtcaccaccgagaacagcagaaagttaaacggcagtccccagcggttgccgcgacggatctctgacatgcttttgccgtagcgtgagaagtcaccgaagttcagcagcggcccggagaagtaagagaccaccagcgccgtcgccgtaatcatctgccacgtctgctcgcctgcggtcagcgatttgctggcgagagtaaacgagatcccatcgaagccggtcttgtatacaatccagcccgccagcgccaccatcaccacatagaccgccggtccggcgacatcaataaaccgtttgatggcgttcatgccatgccagaacaccatcgcctgcagtaaccacataatgccgaagcagcaccagcccagcagcgacagaccaagccagtgcggcacggtcatcgacgtcagcgacggcgcgaacttcagcagcaccagcatcagcgcattcgccgccagataggtctggatgccataccaggcgaacgcgatcaggccgcgtatcaccgccgggatattggcaccaaacaccccaaacgcctgacggcagatcaccgcataggggacgcccgccatctggctcggtttcgccaccagattcgcacagatctgcacgatgcagatccccgccagcaggcagagcagcacctgccagctggctaatcccagcgtgaagaagctggcggccaccacatagccgcccatgctgtgcacatccgacatccagaaagaaaaaatgttgtaccacgaccagttctgatcgcgagtcggtgccaggtcgtcgttacagagtcgtgggctgtaacgggcgttggcttcagaggccgtgctggccaccgttgattgatttggcatgaaacctgctcctctacccgagagtggaatgaataatctggtaaagcggtattgcaggatccaggccagatctcttttcttgtatacaatatttatttttcacgtatacgatatgtggcgtacagcaagcgaccggagcgggtaatgacgagtaaaacaggacagcgagacgccaccaggctgcaggataaagatgaagggatttaccaggcgttgatgaacgccattgttgagcatcagctgccgccgggcagtaaactgccggaagaggccctttccggggtcttcggtgtgagccgcaccggcatccgcaaagtgctgcaacgcctcgcggcggtgcaaatggtcactctgacgcccaaacgtggtgcgcaggtctccacacccggcgttgaagaggcgcgggatatcttctcaacccgcagtttaatggagtgcgctaatctgccagcggtcctggcccatctgcagcccccgcatctggtggcgctggagcagctcatcgcgcaggagaaccaggcgcacgccgatcatgatggcccggcagccatccggctgtcagcggcctttcatattcagttgcaggcgatctccgggaatcaggtgctcaccggcatggtgaccagtctgacgcagcgatcatcgctggtgatcgccgcctatggcgcaccctggcagcgtggctgccgctgtgacgatcatgcgaatctgcttcagttattgcgcgcgcgtgcgctgcagccgctgacgcaggcgctacagcatcacttcgagcacatcgtctccagcctgcactttgagcgcagcggggaaacgctgcccgacttttcccgactgtttgccgcaggctctggagcggcctcatgagcctgattcaggttattaaccctaataccagcctggcgatgaccgaaactatcggtcaggccgcgcgtgcggtcgccgcaccgggcaccgaaattctggctgtttcgccgtcgcagggcgtgccttccattgaagggcacttcgatgaggcgatcgccgccatcggcgtactggagcagattaaactgggcagagcgcagggcgttagcggccacgtcattgcctgctttggcgatccgggtttgctggcggcacgcgagctggccagcggaccggtgatcggcattgcggaagcggcgatgcataccgccacgctgctggcgacgcgtttctccattgtcaccacgctgccgcgcaccctggtgattgcgcgtcatctgctgcagcagtatggctttacccatcactgtgccgcgctgcatgccatcgatctgccggtactggcgctggaagatggcagcggcctggcgcaggaaaaagtgcggcagcgctgcattcaggcgaagcgggaagatggcagcggggcgattgtgctgggctgtggcggaatggcgacgctggccggggagctgacccgggagctcggcctgccggtgatcgatggcgtcagcgcggcggtgaagatggtggagtcgctggtggcgcttggttttggcaccagcaaacatggtgatctggcctggcctttgcagaaacctctctcaggtgcgtttcagcatctaaactaacggaactttcccgaatcaaaacaggtggagtgatgactgacgctgcagagaagaaagagtacagctttaataaaaactatccgcgcgatttaatcggttatggcgctcatccgccgcacgccgcctggcccaacaacgcccgtgtggcggtgcagtttgttctgaactacgaagagggcgcagaaaacagcgtgctgcacggcgacaccggctcagagcagttcctctccgacatcatcggggcagcgagctatcccgatcgccacatgtcgatggagtcgctgtatgagtacggctcacgcgccggtttctggcgtatccacaatgaattccagaaacgcggtctgccgttaacggtcttcggcgtggcgatggcgctggcgcgtcatccggaagtcgtcgaggcgattaaacaggctgactacgatgtggtcagtcacggctggcgctggatccactatcagggcatggatgcaaaaaccgaacgccagcatatgcagcaggcggtcgatgtgctggttgatctgtttggtaaagcgccgaccggctggtacaccggccgcgacagcccgaatacccgtcggctggtggtggagcagggcggttttagctatgacagtgactactacggcgacgatctgcctttctggacccaggtcacctgtcaggatggaacggttaaaccgcacctgattatcccctataccctggagtgcaatgacatgcgctttgcctcgccgcagggatttaataccgccgaacagttctttacctatctgcgcgacagcttcgatgtgctgtatgaagagggcgaaaccgcaccgaagatgatgtcgatcggtatgcattgccgcctgctgggccgtcctggtaaattccgcgcgctgcagaattttctcgatcacatccagcagcatgaggatgtctggatctgcacccgtcagcagatcgctgaccactggatcaacacgcacccggcaccttaagccggttccggcgctcgccccgcgttgatcgggcgaagcgccggacgatgtcagctcatcaggctgacctgcgccgccacgatgcaccagccgtggggcatgcgtacccaggtctgctgctgacggccaattttatcgctgccggtgcgggtaaattcggtgctgcagaccgcataatcctcgccaaaggtggtgatcacggtgtttcgcagcgtccggttcagcccggctgcaggacgcgcggcgcggaaggcccgaatctcatcaatgccatacagattctcacccgcgccgaggcgcacggttcgcgggtcgtgccagaacaacgcatccagtttcggccacgtcattgctgaccagcgcctgctcgtagcggtaaaactgcgccgtcacctcggtgacgacctgcggtaaattaatctctctgctcatcaggctccagccatattgatttgcggtatcgtaatgccgcgttgttccagtgcccaggcggcacgtaacaccgcctcttcattaaatggacgtgcgataagctgtaatccaatcggcagaccgcttcgggtcgccagcggcacggtacagaccggcaatcccaggaaggagatcggctgcgtcagcatacccatgctcgccttagcgggcagcgattccccctgaatcgacagggtctgctgaccgatggtgatcgcgctgcagggtgtcgccggcgctatcagcacatcaaaccgatcaaaaagcggcaacacctgctgctggaaatggcggcggaaacgctgcgcctgcacgtaccaggcacctggtatcatggcaccggccagcagacgctcgcgtgaattgggttcaaactgctcaggcgtctggcgcagggcgggcagatagtgattgccgccttctgccgcggtcatgataaatgccgccgagcgtgccagctcagcgtccggcatcagcacctcttcctgtgcatcaagtgctgccgcgaccaccgcgacggcagcgcgggcatcctcatcgcaccagcgggcaaaaaagccacccagtacgccgcagcgcaagccttcgctgccctgtgacagccctggtagcgtcgcggccagcgggcgatcggcctgaaacgcatcggtgtggtctgcgccctgcaacagatcatataccagcgccaggtcttcaacccgccgcgccagaggaccgatgtgatcgaggctggcgacaaacggatggctgccgctgcgtgacaaccggccaaaggtcggcttaagaccaaaaataccgcacagcgacgcgggcacccgaatcgagccgttggtgtcggtgcccagtgaaaagtggaccagaccggcggccacggcagccgccgaaccgcctgacgagccgccagccacgcggctgagatcgcgcggattgtgcgtcgcgccgtagtggctgttttcggtggtaaaaccatacgcgtaggcatccatgttcagcatgccagacagcagcgcaccagagcgacgcagtttatcgacagcaaacgcatctgcacgtgccgccggccggtcgctgaacaggctggcaccggccagggtagtgtgacccgccacatcaaacaggttttttaccgcatacgggatgcccgccagcggtggcagggtttcgccgcgctgccgctgcgcatcaacatccgccgcttcttttaacatgcggggcccggtcacttccgtccaggcattcagcgccggattatgctgctcaaccgcctgcagcgtgcgctttgccacttccagcgcactgatttcaccctgctgaatcgcccgctgcagggtctgaatcgaaacgtcacctaatctcatgcctggtatactcctgccacttcaagccggtcatccagcggaaacgtcatcagcggcgcggtcatctccgcgatacgcgacagctggatcagcagttcagcgcggcgggcgtcatccagttccagttgcagtatctgctccatatggccgatgtagctggcccagtcgtgttgattcatgattcgctcctgttaaaaaccggcggcgctgccgttactgcgtggatcgcttgcgccctcaaacatgccgttgctgtggcgcacaatggcgcccgcatggcccacggattcgctgaagtccggcagcagctccacctcatgtccccacagacgcagcatcaataccgtttcgtcgtcaaaacggccttccagtttcagcgagtctgatgattgcccccaggtccggcccagcagccagcgcggcgcactgactgcctgttgtaacggcaagccctgaatcacatggcgggtaaaaatcgccgcctgagtctgcggctgtccatccccacccatcgcgccatacaccagcgtccggccatctttcagccgtgcggcggcgggattcagggtatgaaacggttgcttaccgggtgccagggccagcagatggtcaggatcgaggctgaaagcggcgccgcggttctgccaggtgatacccgtgccgggcagcaccacaccactgccaaattcgtgataaatgctctgaataaaggagacggccaggccgctgctgtccatcacgcccatccagaccgtatcgcccggcccgcgtccgtttccccatgccgccgcctctccatcggtgatctggctggcgagtgtggcaaggtgatcgctgtccagcagcgcctgcaaatcttccgtgacgtgacgcggatcggtgatgtgtttgtcgcgcagtgcaaacgcttttttggtggcttccacgatacggtgcaccgtctgcgcatcgtcagcctccgccatctccagccgatcggtgatgcccaggatcgccagcgacaccatgccctgcgttggcggggtgatattccagatgtcaccttcgctgtgggagagatgcagcggcgtcgtgcggcgggcgcgatgctgctgcagatcggccagcgtcaccggcatgcccagcgtggccatctcatcggccatatggtgagccagcgtgccgcgataaaagctgtcgagcccctcttcagtaagctggctgagggtgtttgccagggcgggctgggtaaaacggctgcctggctgcggcacgttgccgtcaggcataaaggtggcgctgaagccgggctgatgctgcaattcactgcggaaacgtcgcggtggcggcgctctgtgaggtggtcaccggaataccgtcggcggcgtagcgaatcgcatcgcgcagcagacgtgccagcggcagcggcggggtgcccatctcagccgagagattcagtgcctcctgccagccgctgaccgtaccggccacggtcagcgccgctttcggcccgcgatgcggaatcttagggtgatcggcgtagaaatcgtgatgagccagcgaaccggctgcgccgctggcgtcgatagcgacaggatcgccgccgggcggcagaatcagccagaaaccatcaccgcccagtccattcatatgcgggtagactacggcgatggtcgcggcagcggctaccatcgcttcaatggcattaccgccatcacgcagtaccgcgagcgcgctttcactcgccagatggtgtggcgtcaccgccatcccctgcggggccatgttgctttgaatcatctttttctcgttatccgggtgacagaaccgataacaaagcaagagctgttccagttttcaccctgagctgacaatgcgccggttaacctggcgcaaattgtgctagcttctgctgaaacaaaagttacaggacgggttatgaaacagcttgatgaacgactcaggagtcactatccccagctctctccgcaggagcagcgcattgccgacttcgtgtttgaccacttcgatgacctgatcagctacaacagtgccgagctggcgcggctaagtggcgtgtctaaagccacggtcagccggctgtttaagcgcctgggctatgaaaaatacaaggatatgcgtgatgagttacgcatcctgcgccagagcggcatgccgctgactgataatcgtgatgcggtgcagggcaatacgctgctggcgcgacactacaagcaggagatggctaacctgacgcagtgggtgaacagtctggatgcccggcactttaatgaggttatccagcagctggcacaggcaaaacgcgtctttatcatcggcatgcgcaacgcctatccggtggcactgcatctgcgacagcagctggtgcaggcgcgtttcgcaggtacatatcctgccgcagccgggccagacgctggctgaggagctggtggatattacgccggaggatatggtggtcgtgatggccttccgtcgtcgtccccgcatcattcgcccgctgatgcagcagttgcaggctgccggtatcccgctgctggcgctgtgtgagccgcaggcgcagacggtgattgcgctggcgcgctggcagctctgtacgccgctggacagcgtttccgccttcgacagttatggctccgccatgagtctggttaacctgattgccaatgcactgctgcatgaaatgctggcacagggacgccagcgcattcatcagatcgccgacctttaccagcagtttgatgagctggagcaccgctaacaggcaccgttttggtgctttgccccatttcagaacagaccttcccccggcgtagtcgtccagattacgccagatttcagctgaatgctttgccacttaaccctttttctgtagccgtccgggttggcacattagttgcagattgcatgctaaagaatcttttgtttcacgttaatctcaccggggtgcataatgaaaaaagttttgatggcggttgcgacagcggcattactgatggcacaagcgggaagcgcgctggccgatcaactgcaggacatccagaaacgcggcgtcattcgcatcgccgtgccgcaggatttcccgccgtttggctcggttggcaccgatctgcagccgcaggggtatgacatcgacacggccagatacctggcaaagcagatgaaacttaagttgcagctggttccggtcagcagtgccaaccgcgtgccttatctgcaaaccgacaaggtcgacctggtgatctccagcatgggtaaaaatgccgagcgggaaaaagtgatcgacttcacccgcgcctatgcgccgttcttcctgggcgtattcgggccgaaaggcgatgaaatcaaagcggcgtctgccctgagcggcaaatcgatcggcgtaacacgcggtgcggtagaggacatggtgctcagtgacgttgcgccgaaagatgcacaggtgaaacgctacgaagataacaacactaccttgtctgcgtatctctccggtcaggtgcagtatgtggcgaccggcaacctggtggtcgccgccattgcccgtcagaatccggctaaagcgccggtggcgcagtttatgctgaaagattctccctgctatatcggcctgaagaaagatcagcccgcactgaaagcgaaagtaaatgcgctgattgagcagggcatcaaagatggcaccctgaataaactgtcagaagagtggctgaaagcgccgctgcccgccaacctcggcgcctgaggaaagattcatgaccgggcaacttaactttcccgccctgtggccctactggccggagctgctctccggtctttgggtcaccattcagctgacggtgctggcgactaccggtggtgtggcgctgggcattgcgggcgcggcgctgcgcagtggcagacccagctggatgagccgcctgtggggcatctatgtcgagctgatccgcaacacgccgtttgtggtgcaactgttctttatcgttttcggtctgcctgcgctgggactgaaactcactgctggcgaggcggcgctgctggcgatgctgatcaacctcggggcgtatagcaccgagattattcgtgccggaatacaggtgacacccaaagggcagtgggaagcgggacgagtgctgggattaacccgcagccagacgtttctgcgggtggtcttgccgcccgcgctgcagcgcatttatccggcactggtaagccagtgcatcatcgtgatgctgggttcgtcggtggtgtcgcaggtctcctacgaggagctgaccttcgccgccaacctgatccagtcgcgcaccttcttaagttttgaggtctatctggtgaccacgctgatctacctggcgttgtcgattgcgatgcgccatctgctgctggcgattggccgtaaatggtttggagtgcagccatcatgatgacgacctttaccgactgggacatcctgcgcaacctgctgctggcggcacgctggaccctgttgctgtcgctggtggcctttgtcggcggcacgctggtgacgctgccgctgctgtttatgcgcctgctgcaacgcaaatggttaacgcggctggtacgcggttacaccgcgctgtttcagggcacgccgctgctgatgcagctgttcctggcgtttttcggcgtcggcctgttcggcattgatgttgcaccctggacggcagcctcgctggcgctgaccttctacaccagcgcctttctggtcgatatctggtacggcagcatccgcgccctgccaaaaggccagtgggaagcgtcgcgctgtctcggcctgacctttggtcagacgctgtggcgggtcattgcgccgcaggcgatccgcatcggtattgccccgacggtggggtttgctgtccaggtgatcaagggcaccgcgctggcgtcaattatcggttttatcgagctgaccaaagcgggcaccattctgaacaacgtgacctatcagccgtttaaagtctttgggctggtggcgctgggctacttcctgatgtgttatccgctgtctcgctacagccagtatctggagaaaaaattcaatgccgctcatcaccattaatcaggtgcaaaaatattacggcgacaaccatgtgttgaaaggcgtggatctggatatcgacatgggcgaggtgatctcaatcatcggtcgcagcggatcgggcaaaagcacgctgctgcgctgcatgaacgggctggaaggctatcaggagggcagcatcaagctcggcggtatgacgattaccgatcgcgactcgcaggcgcgtgaaatcagccgctcggtcgggatggtgtttcagagcttcaatctgttcccgcacatgacggcactggagaacgtgatgctggcgccgcgccgggtgctgaaaaaaagcgaggccgagtgccgggcgctggcggcgcagatgctggagaaggtcgggctgggcgagcgtctcaactactatcctgccagcctctccggcggtcagcagcagcgcgtggcgatcgcccgtgcactggcgatgacgccgaaagttttactctgtgatgagatcacctccgcgctcgatcccgagctggtgggcgaagtgctcaaagttctggagcagctggcgtcagaagggatgacgctgatcctcgtcacgcatgaaatgagcttcgcccgcgacgtgggcgatcgtgtggtctttatgcatcaggggcgcgtatgggagcagggcgacagtaagacgctgttcgctcagccgcagtcaccggagctgaagcagtttatctcttcggttcgcctctgattctgaaaaaggaaattacgatggatatcaatcactacccgcaacttaacccgccacagcgtctgctaatggggccaggaccgatcaacgccgatccacgcgtgctgcgcgctatgtcgagtcagctgctggggcagtacgatcccgcgatgactcactacatgaatgaagtgatggcgctctatcgcggcgtgtttcgcacagagaaccgctggacgctgctgattgacggcacctcccgcgccggtatcgaatcgattctgctgtcatcgatccggcctggcgacaaagtgctggtaccggtgtttggccgctttggtcatctgctgtgcgaaattgcccgccgctgtcgtgcggaagtgcacaccattgaagtgccgtggggcgaagtctttactcccgaccagatcgaagatgcgatcaaaaaagtgcggccgcgcctgctgctgaccgtgcagggcgacacctcaaccaccatgctgcagccgcttgagcagctgggtgcgatctgcaaacagtatggcgtactgttctacaccgatgccaccgcgtcgctggcgggtaacgcgctggaaacggacgcctggggacttgatgccgtatccgcggggatgcagaaatgcctgggcggtccatcgggtacctcgccgatcacgctgagcgcagagatggaggcggtgatccgcaaacgcaaatgcgtagagcaggggatccgcaccgaggcgcatcaggatggcgaagaggagatgatctactccaactattttgatctcggcatgatcatggattactgggggccggagcggctcaaccaccataccgaagcgaccagtgcgctgtttggcgcgcgcgagtgcgcccggctgatcctgcaggaggggctggacaacggcatcgcccgccacaagctgcacggtgaagcattgctgaaaggcattcaggggatggagctggagaccttcggcgacctgaaacacaaaatgaacaacgtgctgggcgtgatgatcccgtctggcgtaaacggcgatcaggtgcgcaagctgatgctggaagatttcggcattgagattggcacctcgtttggcccgctgcatggcaaggtgtggcgcatcggcaccatgggctacaacgcgcgtaaagattgcgtgatgcagactctctccgcgctggaaacggtgctgacctatgtcggctatcgcacgccgcagggtgccgcggcgcaggccgcctgggatcactacgggagccacgcatgatgatgagcgccagcgaagcccaggccgctgcacagcgcgttatggcgcgctgcgatgcgctggcggcgatcagcgaaacggccgaggggctgacccgcgtctacctctcacccgaacatctgcgcgccaacgcctgtgtcggtgaatggatgcaggcggcggggatgcaggtgtggcaggatgaagtcggcaatatctgtgggcgctacgaggcggcagaagcgggtgcacccgcgttactgcttggctcgcatctcgacacggtgcgcaacgccggtcgctacgacggcatgctgggcgtgctcagcgcgattgaaaccgtgcagtggcttaacgaacatcagcgccgcttaccgctggcgattgaagtcattggctttggcgacgaagagggcacccgttttggcatcacgctgctcggcagtcgtggtattaccggcagctggccgcaaagctgggtgacgcatcctgacggcaacggcatcaccgtggcgcaggcgatggcggatgtcggtctcgacagcgacaggatcgcatctgcggcgcgacgggttgaggatatcgtcggttatcttgagctgcacatcgagcagggcccctgcctggagcaggaggatctggcgctgggcgtggttacagcgatcaacggtgcgcgccgcctcaactgccgtttcaccggagaagcgggccatgcgggcacggtgccgatgacccaccgcaaagatgcgctggctgccgctgccgagtggatggtgtttatcgagcagaccacccgtgagcaggatccgcaactggtggcaaccgtcggtacgattaactgcgcgccgggggctgtcaatgtaatccctggcgaggtatcgctgtcgctggacgtgcgcggtccgctggataacccactggagacactgctctccagtctgttaacccaggcggaggcgattgcgctgcggcgtggactccgctttgagtcgaacgaatattatcgcatcggtgccaccgcctgtgactccgcgctgcaacaggcgctgagtcatgcggtggaaacggtgcaggggcgcagtctgtcactgccgagcggtgcggggcacgacgccatcgctatcgctgaacgctggccggtcagcatgctatttgtgcgtaaccatcgcggtatcagccaccatccggcagagtccgtggcggtggctgatgtggcgcccgcgctgcaggcttatttacaggcggtctcgctgattgctgaacggagctgaacatggaattagccgcatttaatcagctgtcggctgatgaggcgcaggcggccatccggcattgtgttgccattccgcactggcagcagtcgctggtggcagcccggccttttgacaccctggatgcgctacgggcaaccgccgatgcgctggcccgccagtggcagcagcctgagctggaggccgcactgtcggcgcatccccgcattggcgaacgcgcgaacggcgcggataaagaagcggcactttcacgcggagagcagtctgcgatgcagcaggccgacagcgctttgcagcaggcgatgcagcaggggaatcaggcttatgaagcccgttttggccgggtgtttctgattcgcgctaaagggcgcagcggcgagcagatgctggcagagttgcagcgtcggttgcagaatagcgatcctgccgagcagcaggaggtgctggatcagctgcgtgaaattaccctgttacgcctgaaggagacgattcaatgagtactgttaccacccatattctggacacggcgctgggcaaaccggccagcggtgtagcgatttcacttgagcagaacagcccggaagggtggtttccgatttcacagggtgaaaccgacagcgacgggcgtctgaaagatctcacgcccgagccgctgacgccgggccactaccgtttaacggcagaaatcggcgactattttgccgccgccggtcgggatgcactctacgtcagcgcgcagatcgattttatgattgccgaagcgggcagccattttcatctgccgtttctgatttcgccctggtcctggtcaacctatcgcggcagttaatgggcgggctgacttcccacccgccattcacagcgaaaagcgatccgcatcctgccaggccgggaagcgctcgcgataagcattcagtgcgtccagcgacagctctgcgtccagcctggcgcgctggtgcggctcagccgcgctgaggatctcgccctgcggtgaaataatctggctgtcgccgctgtattcatgctgattgccgtcattgccgacgcggttacagcctgctacataagcctgattctcaattgcccgcgccagcagcagtgcctgccagtgcagtgcacgcggtgcaggccagttggcgacatagagcgccagatcgtaatcgttgcggttgcgcgagaagaccgggaaacgcaggtcgtaacagatttgcggcaggatgcgccagccgcgccactcaaacacctgacgctgttcgccaggcagatagtggtgatgctcgtccgccatgcggaacaggtggcgcttgtcatactgatgcagcgtgccgtccggctccaccagcagaaagcggtttaccgcgccgtgttcggtctgaatcgccgcgctaccgccgaccagggcatcgttgcgacgggcatgctgatgcagccactccaccacctgcgcctgaggcagcgagcttttcgccgcttccattgcaaagccggtggtaaacatctctggcagtaaaatcagatcgcgcccggtgagtccatccagttgctcgtcaaaatggcgcaggttggcctcgccatccatccagctcagcgtctcctgcagtaacgtgatttttaaagctgacataagcgctccgcggcggcatctaatgtcgccggctgtttggcaaaacagaggcggatcagtttatgaggaaaggcatcggcgcagaacaccgacagaggaatcgcggcaacgcccacttcgcgggtcagccactggcagaaactgacatcatccagatcggagatggcgctgtaatcgaccagcaaaaagtaggtaccttcgcagggaagcaccttaaagcggctgctgcttagcgccgttgccagccgatcgcggcggtcgcgataaaacgccggcagctcaagatagtgctccggatgctcacgcagcatatcggcaatcgccagctgcgccggcgtattcaccgagaaggtcagatactgatgcaccttgcgcagtttccgcgctgatcgcggcaggggcaatgcagtagcccactttccagccggtcatatggaaggtcttaccaaacgacgacaccgcgatagcgcgctggcgcagttcgggatgtgccagcacgctggcgtggcctgcctgatcgaagcagatgtgctcatagacttcgtcgctcagtacatagaccggtcgcgcagcaatcgcctgccatagcgcggtgaaatcctgctgctgccagacggtggcggaaggattgtgcggcgtattcaggatcaccagccgggttttatcactcagcagcgcagcaaacgcctgccagtccacccggaaagcgggcggctgcagcgtaatgcgtttcatcacgccgcccgacaactctaccgcaggcgcatagctgtcgtagctgggatcaaagcagatcacctcatcgcccggccgcaccagcgcggtaatcgccgcatagagcgcttcggttgcgcccgccgtcaccgtaatctctgtttcgacatcaggacgatagtcatagagccgcgcggttttctctgcaatcgcctcacgtaacggcagcgcaccggtcatcggcgcatactggttcgcgccctggctgacgtgatacgccagccgctgctgcagatagtccgggccgctaaaatcaggaaagccctgagagagattgatagcgttatgctgctgcgccagcgcactcatctggctgaaaatggtggtgccgagcaaagggagtttactcccggggatcaggttgtgctgcgtcatgatgtcaggccttaagcgcgaagattgatgcggtgtcacccggtgtttgtgccactataaacaggatggtagtatttggcaatcaagacgcttagatggctaaatgcgtcatactccacacctcagcttcgttagcttcgtttgcttaccccggtcactgacgagtgtcagctcccagcgataagcgcttgccgccttgctgagatgcggatcatctggcaggacccggagagtatggttcagcagtcgggcacgtttgctaactgtttaagattttcaaactgttgtaattttatagccattaccgttatctgagccacccgagatcatatttcaccgcaaggaacttttatgtcgcagagtcttccattagatcaactggtcgccgcctgtcactggattggcgcgaaaggctgggcaccggccaccggcggaaatatgtcggtgcgccgcgatgaacatgtctgcctgctgagtgaatcgggcaaagataaaggcacgctgacgcgggatgactttatcgaggtcgatattgccaccagccagtcgctctctggccgtaagccgtcggcagaaaccggtctgcacacgatgatctatcgactctttcccgaagcgggcgcggtgctgcatacccacaccgtgaatgcgacggtgctgtcgcgggtggagcagggcgcggcgctgctgctgcacggctatgagatgcaaaaatcattgagcggccagcacacccatctggatacgctggccattcctgtattcgacaacagccaggacattgcggcgctggcgtcagaaattgaagattacgctgcccgctttccgctgcgttacggctttctgctgcgcggtcacggcttaacctgctggggccgggatgtcagcgaagcacgccgtcatctggaaggtctggaatttttatttgaatgtgaacgtcaacgtcgcctgctggagagagcatgattcgcgccattgttactgatatcgaaggcaccaccagcgatatccgttttgtacataacatcctgtttccctacgcccgccagcatctggcgagttttttgcgtgaaaatgcgcatcagcccgaggtcgccgcagcgctgcagtcggtacgtgaggaggctggtcagccgcagtctgatctggatgcggtgacagagattctgctggggtttatggaccaggatcgcaaatcaaccggcctgaaagcgctgcagggcatgatctggcgcgatggctatgttaacggcagttttaccggccatctctatcctgacgtcctgccagcactgagccgttggaaggcgcagggcattgaactgtatgtatattcctccggctcggttgcggcgcagaaattgttatttggctacagcgacgaaggtgatattactgacctcttcagcggctattttgatacgcacgtgggtgccaaacgcgaagtcgcagcctatcgcactatcgccgctgaaattggtcagccagcggagcagttgctgtttctctccgatattcatcaggagctggatgccgccgctgaggcgggctggcagacgctgcaactactgcgtggcgatgcggacggcgagagccgccatcgtcaggtgacagatttttcccagattaacccggagtcaatttaggatgagcgcactgactatttttaccgaccgcgaagccagccagccggtgtggcacagcaccgacgcggaagagattcgtgaacgcctgagcaccaaaggcgtccgttttgagcgctgggaagccgatcgcgatctgggtgaaaatccggatcccgaaacggtgatcaacgcctatcagcatgcgatcgatcggctggtggcagagaagggctatcagagctgggatgtgatcagcatgcgcgccgataatccgcagaaaaccgtgctgcgcgagaagttcctctctgaacatacacacggcgaagatgaggtgcgtttctttgttgagggtgccggactcttctgtctgcacctggatggcgagatcctgcagatcctctgcgaaaaaaacgatctgatctcggtaccagcgggaacaccacactggtttgatatgggatcgtcaccgcacttcacggctatccgtattttcgataatcaggaaggctgggtagcgaactttaccggcgataagattgcggatgcctatccgcgtctggcgtaaaccgcccgtcgttttcgcaaggcgtttgccgctcacggtaaacgccttgcagaccgttattgtggctggaaaatgccaccctgaacctggtcaggcgtgactaccccggtgtccagtacccagccgctgatcagggtggcgggcgtgacatcaaacgccgggttatagatcttcgccgcttccggcgcccactgcacgctgccaaaactgccggcaacgcccgtcacttcactggcggcgcgctgttcaataggaatcgctgcgccgtccggacagctgcgatccagcgtggtatgcggggccgccacgtaaaacggaatctgatgataatgggccagcaccgccaggctgtaggtgccgattttattcgccacatcgccgttggcggcaatgcggtcagcgcctacccatacggcatcgacctctccacgggccatcaggctggcggccatggaatcggtaatcagggtgtaaggaatcgccagctcacccagctcccaggcggttaaccggccgccctgtaacagcggacgggtttcatcaacccagacattcttaatcagcccctgctgatgggcgcgggcaatcacgccaagggcggtgcccacaccggcggtggcgagtccgccggtattacagtgggtcagcagctggctgccgggtttcacccgcgtacaacccgcgtcagcgatggcatcacacagctgcttatcttcctgcaccagtcgccaggcttcttctgccagcgcgggggcaaagtccggctgcgccagcgccagtttcatccggtccagattgttcatcagattgacagcggtagggcgggcggcgcgcagggtctccagtgcctgcgccagttcagcgcgcgtctgcccctgttctgccagcaacgccagcagcagcgaggcggaaaggccgagcagcggcgcaccgcgcacccgcagcgcatgaatatgttcaatcagctggggcacgctgtgcgcgggcagccagtttcttttgctgcggcagtgcctgctgatccagaatccagagctgattgtcacgaacctgtaagctggtggtttgaagtgtctgcattgtgggtgaaatccatgttgcgttaatgatacctattgtgccaacatgctgaacggatgtatagacgtctgaacggcttattacacccaggtcatcccccttcgattgatgaggaacaggcaatgtcgcaataccgtacctttactgctgctgatgctgtggaatatgcccgacaatttggcggcgtggacaatcctgccgcgctgagcagcgcagaagagattggtgatggcaacctcaacctggtgtttaaaatttatgacgatcagggcaacagccgggtggtggtcaagcaggcgctgccctatgtgcgctgtgtgggtgagtcgtggccgctgacgctggatcgggcgcggctggaagcgcagaccctggtcgaacactacaaatattgtccgcagcacacggtgaagatcacccattacgatgcggagctggcggtgatggtaatggaagatctctccagtcatcgcatctggcgcggcgagctggtgaagggcgcttactacccggaagcggctcagcagttaggcgactatctggcacaaaccctgtttcatacctccgatttcatcctgcatccgcaccagaaaaaagcggaagtggcgcgttttattaatccggaaatgtgtgaaatcaccgaagatcttttctttaacgatccctataccgaccatgagcgcaatagctatcccgaagcgcttgaaccgctggtcgccagcctgcgtaatgacgatgcactgcgcattgcggtgggcggtctcaagcatcgtttctttgcccacgctgaagcgctgctgcatggtgatattcacagcggatcgattttcgttgctgatggcagcctgaaagcgattgatgcggaatttggttattttggccctatcggttttgatgtcggcaccgccatcggcaacctgctgattaactactgcggcgtgccgggtctgctgccaccgcgtgaggccgccgatgcacgcgagcagcgtctcagcgatgtgcacaccctctggaccacctttgcctcgggctttctggcactggcggctgagaaaacccgtgatgaggcgctggcttatccaggctatgcggaggcgtttctgcgtaaagtatgggctgataccattggttactgcggcaccgaactaattcgccgcactgtggggatgtcacacgtggcggatatgaagctgattgccgatccggcgatgcgtaccgactgcatccgtaatgcaattaatctgggacgcacgctgattctggcggccgatcatgtagaagatgtggatgcgctgattgcccgcatccgtcaggcgggataaaaaaagccgacgtgatgtcggctttcaggtaaatcaaaggctggctgtaagagtgtgcccgcgccggaaacaggggcagatcggaaagtcgctaaagccatccctggctcgctcggcccgcgtcgtcctgacgcgggacgctttcctcttctgaccctgttccctgcgccggtgatgcaggctaacgctaaaactatgctgcctcactcgcccgcgacgcagcctgaggggctttctctagcaccggcactgccagcgcatccgcctcaaactcatcgacgttaatcgaacgcaggcggctggcctcagcacgctgcaacacttcagcctctttagcatcaatccagccctgctccagcgcgcgcttcgccagcgcatccagccgggtaaaggagaggtgctgcttcgtctgtttgcacagcctgtcatggatcacttctgccgccatcacatcctgcaacgcctgttccagctgaccggcagggttgtgctcgctgggcgtcaggtacatgccacggcccagacggctgcgggtagctgacggctgttgcagcagttttgccagctgatggtccagacggtcagacggagcagggcagtgatgaccgcctgcaaaaatagtcatccgcaatgcgcccgcgaccagacggttcgggaaattacgcagcagatcgtccatcgcgacttccgcctgatgtaacgcatcctgcacgccccagtgcaccagcggcagatcggcttcgttgcggccttcatcgtcatagcgtttcagcgtcgccgaggcgagatagagctggctcagcacatcgcccagacgcgccgaaatacgctcacgacgtttcaggctgccgcccagcaccgccatcgacacatcagagagcaacgccaggttggcactgatgcggttcagatgctgatagtaacgacgggtgccatcgcgggtcggggtggcgctggtgcgtccggcggttaagcccagccacaggctgcgcatggtgctgctgccgacatgaccgatgtggctgaacagcgcctgatcaaacgcgttaacatcattgctggctgctgccgccatctcctgcaatacataaggatggcagcgaattgcaccctgtccgaagataatcatgctgcgggtcagaatattagcgccttccaccgtgatggcgatgggcgcaccctgataggcgcgggccaggaagttgctgttacccagcataatgcctttaccgccggcaatatccatggcgtcaataatggcgcgctgaccgcgatgggtgcagtgatatttcacaatcgccgacagcactgccggtttttcaccctgcataataccggccgtaatcagcgtggccgccgcatccatcacgtatgcgttaccggcaatgcgcgccagcggctcttcaatcccttccatcttaccgattgagacgcggaactgacgacggatatgggcataggcgcctgtcgccagcgccacacttttcaggctgccggttgagttcgatggcagcgtaatgccgcgacccacagacagacactccaccagcatccgccagccctgaccggccatttgtgggccgccgataatatagtcaatcggcacaaagatattattgccgcgtgtcggcccgttctggaacggcacgttaagcgggaagtggcgatgaccaatctccacgccgggcgtattggtcgggatcagcgcacaggtaatgccaggattttcgttatcgctgagcagatgatccgggtcggagagtttaaatgccagccccagcacggtggcgatcggcgccagcgtaatgtagcgcttgttccaggtcagccgcatgcccagcacctgctgaccctgccattcgcccatgcagaccacgccggtatcggggatggctccggcatctgagcccgcttccggactggtcagcgcaaagcaggggatctcatcgccgcgtgccagccggggtaaatagtgatttttctgctcttcagtgccgtagtgttgcagcagtttcgcccggacctaatgagttaggcacgcccacggtaatcgccagaatcccggagacgcccgacagtttttgcagcacgcaggcctgcgcataggcggagaaatcgagtccgccatactcttttttgataatcatcgcgaagaaacgatgctctttcagataggcccagagttccggcggcatatcggccagctcatgggtgatctggaaatcattggccatgcggcatgcttcttcaaccggaccattgagaaaagcctgctcatcggcggtcaggcgcggctgcggatagttgtgcagcttctgccagtctggtttgccctgaaacagatcgccttcccaccaggtggtgcccgcatcgatcgcttctttttcggtgcgtgacatcggcggcatcacctgctggaagcgctgaaacatcggctttgaaaacaggctgcggcgcagtgacggcaggttgaacggcagcaggatgatcgccagcggcaacagtaaccatggcgtccagaggtgagcaaaagccatcgcagcagtccacagcagcagaatcgcgctgctgagccgcaacgacaggcggtgatagaacagggcgccaatcagcgccaccgtggcaagtatcgagacaaccatcataatgaaccgctccaagtagtaagaggtctgacctgttatgtagagaggtttagagcagttgggttgatttatcaatttgtttacatcgcaattacaacctgcctcacaaaaaccgatttctgtccatttttgcatcacccgctgcagcgataatcgccgccactgcctggccagccatggcatgacgctttgcgctgaccggccattccgttaaacttgctgcgattaaactctcctaaaaaaggacatccctatgtaccaggacattatccgctctgagcttaatgaagctgctgatacgctgaataaattcctcagcgacgaggccaatatccatgcgatccagcgtgctgcggtgctgctggctgacagctttaaggcgggcggcaaggtgctttcctgcggtaacggcggttcacattgcgatgcgatgcatttcgctgaagagctgaccggtcgctaccgcgaaaatcgtcctggctatccggcgattgccatctctgatgtcagccatctctcctgcgtcagtaatgattttggttatgactatgtcttttcacgctatgtggaagcggtagggcgtccgggcgatgtgctgctgggcctctcaacttccggtaactctgccaatatcattaaagcgattgaagctgcccgtgcgcaggggatgaaagtgatcaccctgaccggtaaagatggcggtaagatggcaggcagtgccgacattgaaatccgggtgccacactttggttatgccgatcgcatccaggagatccacattaaagtgatccatatcctgatgctgctgatcgaaaaagagatggtgaagtaactgcgctggcctcccgcctgacgggaggccgcttactctaaggcggtggctatgtgcgaattgctcgggatgagcgccaatgttcccacggatatctgtttcagctttaccggtctggttcagcgtggcggtggaaccgggcctcacaaagatggctggggcattaccttctacgaagataaaggttgtcgtacgtttaaagatccgctgcctagctttaactcgccgattgcgcgtctggtgcaggagtatccgatcaaatcgcattcggtggtggcgcacatccgccaggcgaatcgcgggcaggtgtcgctggaaaatacccacccgtttacccgcgaattgtggggccgtaactggacctatgcgcacaacgggcagctcaggggctatcggcagctggagactggcacattccggccggtgggcgaaacggacagtgagaaggcgtttctgctggatcctgcatcagctggcgacgcgctatccgcgcacgccaggcaactggcctgcggtatttcgttttatcggggagcttgccggcacgttgcggcagaagggcgtgtttaacatgctgctgtcagacggccgttatctgatggccttttgctccaccaatctttactggatcacccgccgcgcaccctttggccgggcgcagttactggatcaggatgtggaggtcgattttcagcagcacaccacgccgcatgacgtggtgacggtgattgctacgcagccactgacggccaatgaaacctggcagcggattgtgccaggtgaatgggcattattctgccttggagagcgccaggaatgaacgtgaagcggcttcgggactggctaaaaccggtgccgggctgctgttcatcacatacttaccgctggcgacattaaccatcggcggctggtgatatttggcaaagtaagcgtatcccggctgcagctgctgccagaaactggcataggtggagtagcggtgacgctgcatattgctgtcggtcatgcggaatggatagatgctgatgctgataccctgctggccgttacgcagggcggcattcacatacgtaaaaatctcatccatataggcgttagtcatggcatagcagccaatcgacttacagtcgccatggatcatcaggtaattgccgctgtagccctgattacgatcgtactgattcggaaagccgatgttgatcgcgcgataaaaccggctatccggcttcagctgattcagcttcacgttgtaaaaaccttccgggcttttgaaatcgccttcacgacgtttcgggccgaggccgccagaaaagttacagatgcggtaggtgtccagcaggcggtattctttaccgattttgccgtagagtttcgagcgtgcgttcttccttgaagatctggatatagaccggggtgccaagtaactgcttctttaattctttgctgaccggtgccgttgagacgggttcgggtgtcattgccatgctgagggctggcagtaaaatcatcgcaaacaggagtgcgattttgcccatgctgtgtgtaccttgaggtgaagagaacatgacgcaaaatgtgcgtctctgtttgcattatcggaactgtccgctaccgcagcgcaacattaaacattgtctgtttttttagcaagacggcgtcagccaaattcgcgatttactgaaagatattcggccagaaatttgtaaactttaatcgtcagcgcgacaaatattgcagttacccctgccaactgtatacttatccagtgccggagggggtatgcgtaaaatcattcatgtcgatatggactgcttctatgccgcggtggagatgcgtgataatccccagctgcgcgacatcccgatcgccattggtggcagccgcgaacgccgcggtgtgatcagcaccgccaactatccggcgcgcaaatttggcgtgcgcagcgcgatgccaaccggcatggccctcaagttatgcccgcatctgcgtctgctgccaggacgctttgacgcctataaagaagcctccgcgcagatccgcgacatctttacccgctatacgccgctgattgaaccgctctcccttgatgaagcttacctggatgtcaccgacagcccccactgtcacggctctgccacgctgatggcgcaggcgatccgtgccaccatctaccgtgaaaccgggcttaccgcctcagcgggcatcgccccgattaaatttctggcgaagatcgcctctgacctcaataagccggacggccagttcgtgattaccccgccggagatgtccggttttctgctgaccctgccgctggcgaagatccctggcgtcggcaaggtctcggccaaaaagctggaagagatggggctggtgacctgtggcgacgtgcagaaggcggacttagcgctgctgttaaagcgctttggcaagtttggccgggtgctgtgggagcgcagcaatggcattgatgaccgcagcgtgatcgttgagcgcgagcgtaaatcgctgggggttgaacggacgctggcggaagatatcagcgactgggatgcctgcctggaaattatcgattttctctacgccgaactggaacgccggctgacgcagatccgacctgacaagcaggtggcgcgacagggcgtcaaactgaagttcagtgattttcagcagacgacccaggagcatatctggccggtgctgaataaagaggacatgattgccatcgcccgtaaaacctgggatgagcgtcgtgccgggcgcggcgtgcggctggtgggattacatgtgactatggtggatccccagctggagcgtcagctgctgctgggtctgtaaccgtcagcctcaccgaccggcaaggctgacatccgattacttcttatatttcgccgccagggtcgcaaaccacggggcaacgaaatcctcattgctgccccagcccggaatgatcttgttcagtgacgcgacgttcaccgcgccaggctggctgttaagctgctgctgagagatcgatgccgctttaaactgataagtcgctggtgtctcttcaccggcaattttcttcgccaccagacgcatattcaccgcgccaatagttttaggatccaccgctaccgtctgcacccacgggctgtttttctcgcgcatcagctgcaaatcctggttcgaaacatcaatgctgtagagtttgatctcggtacggccattctcctgcagcgctttgtaagcgccctggctgaaggcgtcccaggcaccccagatggcgtcgattttgcctttcgggtatttcgccagaatcgcgccaattttattggcggtgtcgccctgaacgtcagttgaaaccgcaccaatcgactcaagctgatgaatgcccggattctctttcagcagtttttcatacaccacctgacggcgttccatcggcgggaaaccggcaacccatagcttgacgatgttcgccttgccgttgaaatcatggatgagctggcccagcgacaactgcgccagtgaagcgtcatcctgcgcggtgacggtgacgcccgggatcgggctatccaccggcgtatcaaacaccgacagcttaatgcctgcatcggcaatgcgcttcaccagtccgctggcgtagggcgctttaccgtgcgacagcacgatgccgtcatatttctggctgatcgcctgattcacgaaatcctggaagcgcgcatcgtcgccgttgctgagaaaggtgctgaccttgaagccaagctggcgaccctgctgaatggcaccggcaacaaactgggtggtgttgtcatcggagccgagattgcggatcaccgcaatacggatcgggccatcatgactggcgatagccgcaggcaccggcgtgacggtatccgcgaaggcggcgctggcgttcagcaggctcagggccagcagcgagagtgttattttttgcattgttatcaactccggtaaacgcgcctcagcggcgctggatataggtgatcgccagtgctaaagccagcaccagccctttaataatgtccatggcgtagtagggaacagagagcatcaccagaccgttctgcagcacgccgaggatcaccgcaccgaccagcgtgcccagcgcattcggcttgccggaacccgccagtgagaagccgatccacgccgcagcgaccgcgtccatcaggtagccgctcccggcattgacctgcgaggagccgatacgcgaggcgagcagaatcccgcccagaccggccagcagtgaggcgatcacataagccagcacccgatagcgggtggtgcggatgccggagaggcgcgctgcttccggattgccgcccagcgcatacatccggcgaccatgtttagtcagggagagcgccagctgcgcggcgacggtgacgaccagcataatgatgacgatggtgggcacctggccgagcaggccaaacgccgccggaatggtgccttccgccatatcaccgctcggcagcaccatgttctcggtgatcgatccgccaaagctgtaggtcatcgccacaccctgaatcacgaacagtgtcgccagcgttgccagcatgtcggggatgcgcaggatcacaatcagaaaggcgttaaacagcccgaccagggtgcagagcgccagggtgagcaggatggcggtggtagtgccgaagccgtaccagacaaacagagaaatcaccagtgcattggccagcgaggcggtcgatccgaccgacagatcaaagccgccaacggtcagcgagatcgagacgccgatagcaatcaccgtgacaatggcaattgagcgcagaatattgatgatgttgttgggttcaaggaagctgtcggaggcgagaccaaaagcggcgatcaggatcaccaccgtgagcaacatgccccatttatagagaaagtcgaacaactggtgacgccacggcgaggctgtcagattcaggctggtttctttgctgctcacgcaggggttcctccggtggaatagagcaaaagcgtctcttcggtgacgtcgcgtgcagccagctcggccacaatgcgtccatcccagagcacgcaaatccggtcgcataaaccgaccagttcagaaaactctcccgacgcgtaaatgatgcctttcccctcgcgcgccaggttatcgatcagggtgaagagttcggttttggctttgatatcgacgcctttcgtcggctcatcgaaaatcagcacgtcggcgttgttgcgcagccatttgcctatcgccactttctgctgattgccgccggagagacggcgcagcgtctgtgccggaccggtggtgcgcacctgcaactgctggataacctgctccgcccagcgccacgcctggcgatggccaaacaggctccagcgcgaaaagctgtcgtctgcgctgacgctgaggttcattgccaccgactcatcaataaagatcccctctttgcgccgctcctccggcaccagcgccatgcggcgactgacggagtcatgcggcgaaacggggctgccacggctggccatgcagttcaccgcgactgacgcggcttttgctggcaccaaacagcgccttacagagttcggttttaccggcaccggccaggcctgcaatgcccagaatttcccctttgtgcaatcgtagcgagatatcctgcagcagttgctcatcatgaagaccgtcaatcgccagcagcagcggctgagtctgctgcgcacgacgggccgggaagatatcggtgagctgatgccccagcatcttctccacgatctgctcaccgctcagtgccgccatcgggccggtttcgatcaaccggccatcacgcagcaccgtcagctggtcacagattgctttcagttcatggatgcggtgagagataaacaccacgccgatgccgctggcctgcaggcgacgcaccacagcaaacagccgctcactttcatgctgatccagcggggcggtgggttcatccagaatcagaaagcggcagtggtgcgacagcgcgcgcgccagcagaatttgctgcttttcagccagggtacagcgctccaccagccggttgacgtccagcgccacgtcgagctgagccagcagcgcccgcgcctgacgccgaacctcgccccagcgatagcggtggccaggctctgccagccgatccagcagaatgttttctgcgacgctgagctgcggcaccagcgccacgtccacttcctgctgaaccagatggatacccagccgtttcgcatcacgcggcgtgcggatggagaccggctcaccatccagcaggatctcgccgctgtagtggctgtgcgcaccggaaaggatcgccatcagtgttgacttgcccgcgccgttagcgccggtcagtgcatgtactgaatggccgtcactgcggaaatccaccgacgatagcgcggcaaacccgccaaaagcgatggagatgttacgcatctcaaggcagtttaaccctggcatgtcattactctcctgaagaaacactggccgcattttttcctgaaccttcaggcgcggcaacagccgaaagcgcataagctagcacgaaatcttattagccatccagacatctggacataatggcggctgtgaccagcgaagcgcgggaaagcggcggaataacggggtaaaggacggaaaaggcagcgaattatgctgggggaaagtcacaggcataaaaaaaccaggccggagcctggtttactttttttgtgacagaattacttttctggcaccacattcagcagggtggtcagcagtttccagtaaaggccaacgctttcgatgtgaacctgctcatccggcgagtgcggcccggtgatggtcggcccaatcgataccatatccatctccggatacggttttttgaacagaccacactccagaccggcgtggatcacctgaatgttcggggtcttatcaaacagcgcgatataggtctgacgggtcagcgccataatggcggagtccgcatcaggctgccagcctgggtagccgcctttcgctttggtctgtgcaccggccagctggcccagtgaggtcagcatctgcaccacataatcgcggccggtgtcgatcagcgaacggatcaggcagttgatctctgcatgatcggcttccatggtcaccacaccgatattcagtgaggtttctaccacgcctttcgccacgtcggagttgcggatcacaccgtttggcatgctgttgagcaggttcaggaagcgatcgcggctgtcagcgttcagcgcatcaccctgatgcgccagcggctcagtgaccagtgcgatgttcggctctttgatgccgtgctcatttttgatggcgctcaggaagtgcgccgccgctgatttcagcgcatccgctttgtggctctcgaccgccacggtagcgaaggcttcacgcgggatcgcgttgcgcagcgtaccgccgctgaaggccagcagacgcagatccagttcagcagcgtgtgccgccaggaagcgcgccagcagtttgttggcgttgccgaggcccatatgaatatcggcaccggagtgaccgccacgcaggcctttcagcgtcagcttcagggtctggaattcagcaggcaccgcttcacgggtcagtggcagggtggtgacgaagtcgataccgcccgcgcagcccatgtagatctcaccttcttcttcggagtcggtgttgatcaggatttctgcctgcagccagttgggttgcagaccgaatgcgccatccataccggtctcttcagtcatggtcagcagcacttccagcgggccatgcgtcaggctgttgtcagccagtactgccagcgcagaagccataccgatgccgttgtccgcgcccagcgtggtgccgcgcgctttcacccactcgccgtcaacccagggctgaatcggatctttggtgaagtcatgaacggtgtcattatttttctgcggcaccatatccagatgcgcctgcagcgcaaccggggtacggttttccatgcctgcggtggcgggcttacgaatcaggatgttgccgacctgatcgcgctcacaccagaagccttgctctttggcccagccgacgatgtaactcgccagcgcttcttcgtgaaaagagggatggggaatagagcagatcttagcgaaaatatcccacagcggctgtggagagagttgagacaattcagacacgacaggtctcctgtgtcagtgtaccggcgaggccggacatcgcgagtttccagtgaaaaatcgccgtcagagaatctgacgagccaggcccgagaatatcactgttttctaccgggtgcgctctcagacgcgctaaaaagccgcaaccagtgcgcgggtgctggtttttagtgcgtcaactccttataatctcgcgcaaccttttccccgttgcacatttttacgccacctcggttggctgggatttctattctatgagcgaaaaatacgtcgttacctgggacatgcttcagattcatgcccgtaaactggcccagcgcctgcttcctgttgaacagtggaaaggcattatcgcggtgagccgcggcggtctggtaccggcttcgctgctggcacgtgaactgggtatccgctacgtcgataccgtctgcatctccagctatgaccacgatcatcagcgcgaaatgaaagttctgaagcgcgcagaaggcgacggcgaaggctttatcgtgatcgatgacctggtggataccggcggcaccgcccaggcgattcgcgagatgtacccgaaagcgcgtttctgcaccattttcgctaaaccggccggtcgctcactggttgatgattatattgtcgatattccgcaggatacctggatcgagcagccgtgggatatgggcgtggtctacatcccgccgattgttaaaagctgattgatatgcatcagacaacgcccggttttccgggcgttgtgctttctgtgcctcgcaccccgaattgccgtacagtacacttagccatcgccgtttctgttgcaggagaagtgagtatgtcgagcaaaaatctcagcgaggagttgttcaaaccgcgctttaaacatcctgaaacctcaaccctggttcgccgccaccatcatgctacttcggatgtccactcagccctggatggtgacagccagcgtggctggtatcgtatgctgaataagctgatgtggacatggcgtggcctgacgccgcaggagatcagcgaagtactggcacgtattgccatcagcaatgttgaacatacggatgagacgctgctcgacactgtaatcggttttcgcggcggcaactggcatttcgaatggtgtaaacaggcgggcatctggcagcagaaagcgctggaggccaccgacgacagagaggcgggcgactactggctgcacgcggcgcatctctacagcgttgcggcctatccctatataaaaggggatgagctggccgaccaggcgcagacgctggcgaaaccgcgcctatgaagaggcgactcaacggctgccaggcgagctgaaaccgctgacgttcgccattcagggtggcagcccggttaacggctttctgcacatgccgcctgacgttgaagcgccttatcccaccgtgctgttctgtggcgcgctcgactcattacagagcgatcactatcgcctgttccatgattaccttgcaccgcgcggcatcgccatgctgaccattgatgtgccgtcggtaggcaactcggtgaaatggacgctaaatcaggacaccagctttctgcatcagcaggtgctgcgcgatctgaaaaacgtgccctggatcgaccatacccgcgtggcggcgtttggttatcgctttggcgctaacgtggccgtacgactggcctatctggaatcgcagcggctgcgtggggtcgcctgtcttggcccgattgtgcatgcgctgctgacgcagacagcgttgcaggatgagatcccggatatgtatatggatatgctggcgagccggctgggcatggcaaccgcttctgacagtgcgctgcgtaccgaactcaatcgatattcgctgaaaactcagggattgctgggccgccggacgccgacacccatgctgtcgggctactggcaaaacgatcttttcagcccggaagaggagagcaagctgatcgctaactcttcgtcagatggcaaagcgttgctgattccggtgaagccgatgatggccagtttcgacaaggcgctgaatgaaatttgcgactggctggagaagcgtttaaaaaggtaactggcaaaatttacagtatttgctacaactagtagcggaattcttccgggctgccgttaagcgaaacatgacatcccctggccgtccggaaaatcaaggctgtatagcggtcaaaatctatggagattcagcatgacgttaccaagtggtcatccccgcagtcgcctgcttaagcgctttacggagcttgggccttatattcgcgatgggaaatgtggcgaaacccggttctttttcgactgcctggctgcctgcgttaatgtgaaaccggcaccggaaactgcgtgagttctggggctggtggatggagctggaagcgcaggctgaccactttacctatgtctaccatatcggtctgttcgataaagagggtgactggtcggtggcaaccatcaaaggcaaagagaatacggcgcgcgtggaagagaccttacggaatttccatacccgtctgaaagcgatgctgaaagagttcgagctggatctgattccggccagcgatttcgatgagaaaccggtgaagctgagtgcctgattgggtgtttagagattaaagggtgagttaaaacgcttgcccacaaactgctgacaaatctcaagtagggtgaatctggcagcaacgaataagctcaacacgcagggaacacgggcagaagaggaaagcgtcccgcgccagggacggcgcgggccgagcctgtcaaggatgacgtcttttgcgtctttccgatctgaccgtgttccctgcgccagctcgatctcatagcagagcgggccagatgctgttaacaagcaaagggcgcgttgaaaaacgcgccctttttcatgctcacacattctgtagcttatgctgtgcggcattagcctgaaatcagaactggtaagtcacacccatcgcgaccacgtcatcgttgttaatcgacagcgcgttgtcatcatccagctggttgattttgtaatcaacgaaggcggacatatttttgttgaagtagtaggtcgcgcccacgtcgatatatttcaccagatccgcatcgccgataccgttttcgatatctttgcccttggtctgtacatagccaatagaaggacgcagtccgaaatcaaactgatactgcgccaccagttcgatgttctgcgctttgttggctgcgcccgcgacggtagcaccggtgttacggttggtgccgctgattggtgtcatgttgcgggtatcggtatagatcgccgccaggtagacgctgttggcatcatacttcacgcctgcgccccaggaatccgcacggtcaccgccgccataggcacgtgcctgctgctggttggtacggtcagaagaggtgatggcactcatcaggctcacaccggaatcacccagggcatagcccagtgaggcaccgtagccgtcgccattctgacggttgatgtcggtgcgggtgttggcgctggtggcgtcgtttttaccctgatactgcaacgcaaacttcagcccatcgaccagaccaaagaagttgttgttacggtaagtcgccacaccggtagcgcgctgggtcataaagttatcggaacgggctgtaccgtcaccgccgaattccgggaacacgtcggtccaggcctcaacgtcatacagcacaccgtagttacgaccgtaatcgaccgaaccatactgcgagaatttcagaccagcaaacccaaggcgggttttgttgccattgttggcgtcgctgccctcggagttattgacgttgtactgatattcccactgaccataaccggtcatcaggtcgttaatctgtgtctgacccttaaagccgatacgggtataggacttgtctccatcctggctggcattatcgctgatgtagtgctcagctttaactttgccgtataagtccagtttgttgccatctttgttatagatttcggcagcctgcgcggcggatgccagcgtcagcgtggagaggatcatggccagtgtgcttttcttcatttgctatcaatcccaatgtgaacgccgtaaaaaaatgaaagtttttgtaaagcacggactttttacccgtcggcgatgaactttttatgacacttttcatgatttcttgttaactctgaacttttggtctacgtccttgtccgcgtaaattcgtgcttttcccccgctggctgttggcttccttatcgactcctgttaaaacgtcctttcgtaaaaatttttcactacggcaggaaatatgagtggcagtcagaccttagtggtcaagttgggtaccagcgttctcaccggcggctcccgccggctgaatcgggcgcacatggtggaactggttcgtcagtgtgcgcagcagcacgcggcgggccaccgcattgtgattgtgacctctggcgcgatggccgccggacgcgaacatctgggttaccccgaactgccacccaccatcgcctcaaagcagctgctggctgcggtggggcagagccgtctgattcagctgtgggaacagctgttctcaatctacggtatccatattggtcagatgttgctgacccgtgccgacatggaagatcgcgagcgcttcctgaatgcccgcgacacgctgcgcgcgctgctggataaccacattgtgccggtgatcaatgagaacgatgccgtcgccaccgctgaaatcaaagtgggtgacaacgacaatctctcggcgctggcggcgatgctcggcggtgccgacaagctgctgctgctgaccgaccagcagggactgttcaccgccgatccgcgtaacaatcctgaggctgagctgatcagtgatgtccatgtgattgatgatgcgttgcgtgccctggcgggcgacagcgtatcgggtctcggcaccggtggcatgtcgaccaagcttcaggcggcggatgtcgcctgccgcgccggtatcgatgtgatcatcgcctcaggcagtcgcagcggcgtaatcagcgatgtcattgacggtaagccggtcggtacgcgctttcatgcgcagcaatcgccgctggaaaatcgtaaacgctggattttcggtgcgcctccggcaggtgaactcaccgtcgatgatggtgcgctggcagcaattattgaacgcggcagttcgctgctaccgaaagggatccgtgctatccaggggaatttctcgcgtggagaagtgatccgtatccgcagtttgcagggcagggatatcgcgcatggtgtttcacgctacaacagcgacgcgatgcggatgattgccggtcatcacagccagcagatcagcgaaatcctgggctatgaatatggcccggtggcggttcaccgcgacgacatgatcgtcagttaaggagcggacaatgcttgaagagatgggaaaagcggcgcgcgccgcagcttacaccgtggccgatctgtcgacggcagagaaaaatcaggttctgatgactattgccgaccgtctggaggcggaaagcgcagacattctggcggccaatgagctggatttagccgatgcgcgtcagaaacggcatgagcgccgcgctgctggaccggctgacactcaatccgcaacgcctcggcagcatcgccagcgatgtgcgccaggtctgccagctggccgatccggttggacagctaattgacggcggtcagctcgacagcgggctgcgcattgagcgtcgtcgcgtgccgctgggcgtggtggccgtaatctacgaggcgcgtcccaatgtcacggtggacgtcgccactctgtgcctgaaaaccggcaacgccgccattctgcgcggcggtaaagagacctggcgcaccaatgcggccacggtacgagtgatccagaacgcgctcaaacagcacggtctgcctgcggcgatcgttcaggcgatcgaaaatccggatcgcgagctggtgaatcagctactgaagctggatcgctacgtcgatatgctgatcccgcgtggcggagccgggctgcacaagctgtgccgggaaaactccactattccggtgatcaccggcggcatcggcgtttgtcatatctatattgatgagacgatggagatcgaaccggcacttgatctgatcgtcaacgccaagaaacagcgtcccagcgcctgtaactcactggagacgctgctggtggatcaggcgattgccgatcgcttcctgcccgccttcagcgcgcgtatggcacaggaagcgattgcgctgcatgctgacagcaacgtgctggcgcagctgcagcaaggcccggcatcggtcacgcaggtgaatccgcagcagtacaatgatgagtggctgtcgctggatcttaacgtcaaattagtggcggatatggatgaggcgatcgatcacatccgtacgcacggcacgcagcactcggatgccatcctgacccgtaatacccgcaacgccgcgcgttttgtccgtcaggtcgactcctcagcggtctatgtcaacgcaagcacccgcttcaccgatggcggacagtttggcctgggtgccgaagtggcggtcagtacccagaaactgcatgctcgtggcccgatgggattagaggcgctgacgacctataaatggatagcatggggcgacgatacgctccggccataactgccataatttttaacaaagcgggagtctttcagagactcccgttttttttagctccattttccggtccagtgaaagatagagttttctgcgcatcagcttaatttccgttccggtctcgtcactactggccattattctggctgatattcacgcaattttttacggaacattcctgaaagccggggctgtacgcggcctgaggcaatattttttgtccagccgcgggctgaagcggataatgattatcaggaatgcttgataaagcggttaggtagtaaacgagcggtaatataaaatgaactggtagcaataatgaaaataacatccagtatctcttctatggctgattattaactaatggttaaaaaagaaagtacaagacaagctttcaccgccaggctgatagcggcctgtgagagtgccggcattgccggacatggacgaaacaaacaggttgccagggctctgcagcagcaaggctgtaagatttcaacgccgggagtgtggaagtggtttaacgcgcagtcagtgccggatggcggcaatttactggctctcagccagctgctgggcgtcagggttgagtggctgcaatacggtatggaacaacctgctgaaccggtgacgctaagtgcgctcaccggtcagaagaatgtgtttcggattgatagcctcgacattggtcagcgaagtgctgcaggcctgcccgcgcgtgatgagtttgtcgagactatccaggcgatcgaatatggtctggatgaggcgcgggtgctgttcaacgggcgcccggcggaaaacatccggttaatcgctatcaacagtgactccatggctgacacctttgcgccgcgcgatcagctgtttgtggatatcagcgtgcggatgttcgacggcgacggcatctatatttttaccctcgatgagcagctctatctcaagcgcctgcagctgcagcataagaaaattgctgtgatatcagataataagcgctatgaaacctggtatctcaatcatgatgacgtcaccagcctgaaggtactggccaaagtgatcatgagccaggcgcgacattatcaaatcctcggttaaggccacttctgccggttttttcaggaaggctgaaaaaaaaataatcggcataaattcataaatttaaccagcggtaaataaaaaattaaccaacagtgtttgataaagcataagaacctgttaataatttggatatggatgaacgaagcagttctttcagggacgagccgctcttaaacaattgaggcgctgcacaagcgcgaatcataccaccacaaagttagtgaactttgggatggggtggatgcgcaaaatgcagcgtcgtcagatgccgtttatttcccctcgcttactttccacctgactgctaatgcagccgggcggtaagcgtgcgaccgtgatacgcgacattcgggcccgttcggtttcgccgaaagctcgcgcctgccaccccatcgccaaagactcattcacaggaggagttatggcgataattcactatggcaaaagcgtttttataggcaacgcacgtactcgtcgccaccggcggcgccaacctctcagcagcctgacacagagcatcgacgaggccctgaacttcccaactgaaacacccaccctgagacgtgcagagcaaatctgccagcgtcaggtcgccccgcgcgttgaccgcgcaattactgcaccccgcgtcaccagtcaggaaacacccagtttcgacaattgctgtcttccgcacgttcatctctacgccgtgagctgaaacgcgcagaaaacgcatttttccgttccggctaactcttcgctttctccagttctcactgggcgcaatttgctgaattactgttcagttttgctgcagggtcagtaaggccttctgctgcgccgtgctgagtaatgatcagcgagcgttatgtatttcttttcacaaggctgagttgctttaacccgtcattgaggagtcgttatgagccagataatcgcagtactgaattttgaagaggggtatgtcgacacgccctatctcgacacgctgggctttcccacggtggccggcggcattcgcattggacccaagggggcgtctctgagtaattacgctttccgcgtgccacggcgcgtcggtgatgtctggaagcagtgcattcttgaaaacaaaattcaggagatgcagggcagggagctgctgcgtaatgcgctggcgaagtgcaacgacgcccgcaccgacgtgctgctgagcatggcttatcagctgggcgtcgagggcgtcctgcagttcaaaaacatgctcagcgcgatcgtggctgaacagtttaatgatgcggctgacgcgatgatgaacagcctctgggcccgtcagacgccgggccgcgccagacgtcacgcggagatgatgcgcagcggaacctatgcggtttacagggggttgctatgagatggctcatgtttctcaccgccgtgctgacggcaatcatcattctgctgctgctgcagcgctttaccaccctccagtttgtctctcatgcccgtctgcttttcaaaacctggtctgtctggcttgcgtcgctgggttccatgctcagcgcctgggcgcagtcgtttccttcggccgccgttgatgcctggagcgcactgcccgaagacgttaaagcgattctgccgcacaactacctcgggctggtgggcgccttcatggtggcgatgggggtgattgcacaatttgttcgtcagaaaaacctgctcaatgcgaaggagcagtctgaaggagcgaagccatgactctgattaccaccttactgggcggcagctggcactggatcgccgcgctggctgcggtcatcgcggcgctgggcgccagttatttcggcggcaagaaaatcggcaaagtgcagcaaaaagcgcgttctgacgtcgataacgcgcaacaggaggcgtcccgcgtcaccgcggtagcgcaacagcaacaacataatcgcgaggaggctaaccgtgtggcgactgacaaccatagccttgatgacgctgctgctcgcgacaagctgcagcagtcgaaataccacaaaccctgagccggtggcgatcaccgactctgcctgcgtacttttttcccctctttatacctacggcgatgacgcgcaaaaaatggacgttcgtacggtgcgcgccatcaacacccacaacgacatgtgggactccctttgcggccatccggctgcggctaagtagtgcgctgatttcagcgcgatatctctatgatcctgaggaggattctatgatcgaagttaactcttttgctgaactgcgtaccactgttccaccaaaatcaggtgaagtcgcgagccttaaacgctattacgataaggattccagcttccgtggtggcgcagactttgttggtttcctcagcaccactccgctgaaagatgatggcggtacggtggcggtgggtaacggtttctactggaagcgcaccatcaacgatcccgccgaagtaaacattctgcactttggcgcgaaaggggatggcgtgaccgatgacactgaagcctttaagcggatgctggcatggacacagtcttacaacgcctacgcgaaagccattccggtgcgttttccggggggccgcttcctgatttcacccatcgatatcagcgatacggagttgtcgttttttggtctggcaggcgatgatatcgagctcggctcggcaccgcgcaccaccattgtttctgataaaagcgcgaataccgtgtttaaggttaatgcgcgtcgaatcgtcattaaaggcatctgctggcatggacaggctaacgccgggactgtcgacaccgcggccaaagtcaccgtcacgcctgaacagtgcagtaacacgcagccgttctttgaaaataccattgtcggaggccagatcgtcaatatcttctgcttcaaggcgcaaagtaccgggggaaccgtctttaagctgcaggatacgctcgacagtaagttcgatcagatttacagctccaataccttttcacgggtatttgatgtcggctggtcaaacacaccgaaggggaactgggaccactcaaccgccattgagctgtgtaatgccaacttccagtcgggctatggcgacgcgacgctctatatgccacgcgtcacacaggggctcatgcgtaacgtctggattgagcacacgactaacccaggagatctgtcggatggcggctggaacatcgaaacgctcaacattgaagattgcggcacgccgctcaatctcaataatgcccgcgtggtgatgcgtcatatcaacctgcaggcgggggcgaaaatcaccaatgatctggccggaagtaagtggttatcgaccttcgaatatggctatcgtcgggatgagaactacggcacgttcatgaccggttcgctgcgtgccggctactacagcggctataaagtggtgaacaacaccgataccgacaactggtatcggctggggcagctctatttcccggcgcctaaccagcaatgggtaatggagctgatcgggaaagcggatgcgaccacgccctccggcaccgccggtttcgccggttaatgtggtgggcaccggtaaaaccctgatcaacctccagcgactggagacggtctgggcggatgcttaccatatgggtcagccttccgtgctggacattcgttatggccgggtagggaccacctatgccgtaatctgggtcaagctgagagcgaacagcggcgaaaccatgttcaacctgaagacgacgggtccgacccgcttcgataccggttcctgctcgctgttccaggctgatatgtcggtggttacggacatcaccaaaatcagcaacctgaaacccgctgcacgttttggcatgcacaacgggctggcgggcatcggggccaacgaaaaaggggtggttacgctggctaccgcagcgggtacgccgaccaataagaccgctccgaccggttttgtgctgatcaatatcaacggcgttgaccgtaaggttccttactacgattgatgatcggcatgttttgggcgaggctccggcctcgcccttttttgatctgacattatctccgcttctttttacgtcgccagaaaagtcaccgctgcactgtgaagccagacagtctccctgacacagcctttcgccttcatcctcgtcaacgggctgattgcgattaatttgaattacggcttgcgtcactttaagaagtgtggcctaatgaatcgtcggtttgattaacagacactatcaaagtaagtaaccaaagcagttctcatctctaagtttgtcgcgagacatcccttctttttgagtcttctcttacgttctgattaaaatctgttctcaggccattatgtatgccggaaggctcgatatattaaggatttaagcatgtctaacaaaattcgcggtaccgttaaatggtttaacgcagagaaaggcttcggtttcatctctcctgcagacggcagcaaagatgtattcgtacatttctctgcaatccagggcaccgatttccgttcattagatgaaggtcagcaagttgaattcacagtagaaaatggcgccaaaggcccagctgctgcgaacgttgttggtctctaaggactgaaaattacttttaaatgtcctcactgtagtggctcacagtttcgtacatcacattttgatgttacaagagccaacccgcatggagcgaaatgcattttctgcaaatctgtcgtggttcaggtgaacctggcaaggattgcaattcagagccagcttcgcgctctctgattaaggctagtgagctttatagcgttgttgcatttacagtaataaaaggctgcctctggcagccttttttgtttctgcgtttctcccttctcaaacctcacgcttttttccttgtaacctgcctgtttaccttcattttcgctgtttagttgcaactcccttgtataacgttcatcgcttcccgcttcccgcttcccgcttcccgcttcccgcttcccgcttcccgctctgttgcctgtaacctatccgcccttatcgtcaccattcttaaactggcccgccgaagcaggccgttgagagggattaacgcagtacgggttgcagtgagagcttgccggtattaaagacgctcatcgcctgtgccatacgctctgcctgatcctgcagcgcttgtgaggcggctgacgcttcctgtaccagcgcggcgttttgctgcgttaccgcttccatctgcgtaatcgcctgattgatttcattgatgccgctgctctgctcgctgctggcaatggtgatttcgctcatgatgtttgccacgctctgcacgctgttcactacttcgccgatagttgaaccggcgtgtgttaccagcttgctgccttcatcgactttagcgacggaatcttcaatcagtaccttaatctctttggccgctgaggctgagcgctgcgccagattacgcacttcactcgccacgaccgcaaagccacgaccttgttcacccgcgcgtgccgcttcaaccgcggcgttcagggagagaatattggtctggaaggcgatggagtcgataacgctgatgatatcgacaatttttcgtgaggagagggcgatcgcttccatcttctcaatgacctgctccatcaccacgccaccttcacgcgccacgctggaagtggttgaaaccaggtgattggcttcacgcgcgttgtcggcattatgtttcacggtcgacgtcatctgctccatggcagaggcggtctcttccagcgaaactggcctgctgttcggttcgggtcgaaagatcaaggttcccgctggagatctgattagaggccaccgcaatagtgtcggagccggtacgcacttcagtcacaatcgacagcagattatcgttcatccgttgcagcgcctgcatcaggacgccggtttcatcgcgtgaggtcacctgcatttgtgaactcagatcgcctgcggcaacgcgttcagcaacgtcaaccgctgcaaccagcggacgcacgatagaacgggtcaggaagtagcccagcagaatagacgccagaatcgccagcgcggagaaaatcagcgtaatggagatagccgactgaccattttccacaataccctgaccttcactgcgcaactgtgcgtcctgagagttggcaaaatccacggcatcctgaaggaatttgttctgggtggcggtcatcgatttcaggacataggtgctggcagcctcaaaatcgcccgccttcaccagggtgatcagctctgctttaactttctcaaaagcctgcgaagaggccagcagaccggcgatctttttcttgccgaccggcgtgacctgaatatcttcgatccttttcattgcgctgttggtgcgttgcgtggcttcatccagctgaccataacgcttcacattcatttccggacgtgtcgtgtcgatcaccatgccgcgcaggtatttgatctgatcgttgacgccatcgcgcacatcaaatgccagtcgtactttcacataacgatcgtcaacgatcgaggcgatcgccgtattaatgctgttaatcctggttatggatgtcacgccaatcactatcagtaacgtcacaataataccgaaggctgctgcgagccgcattcccaccttcatattcttgatactgaacatgttctcttccccgttttattattaatcaatttgttagcaacactcaggtttcctgctgttgtgcgcagtgccttgctgatgtctgtggtcacagcctcaggcaaaaaggtgatctcgcgcatactgttatcggagcacgaagttgtacctttaataatttttaagtaataacgccgggtgaataaatagtcagtaaaaatcatcagaaacggttaagtaataaccagaggaaattcagacaaaaaaaagggctgtcagcagtgatgctgacagcccgatccagacaaggatgaatggattcagaaaactaagaagtagaggcctgtccagaacgcgacgcttaacgtgacggcgctaatccaggccagctggcgtaaacggccacgcagcaccttttgacgggaaggcgtagcaggtgcaggcgtaacgggtaaagtttcaatgtgcatagtcggttcctgatcaggtcagccattccgctggctaaaaagtaaaagcgtgccgggcattcttagcggcccgcattcgcttagcgggcagtgtcgagaacgttgaaaatcacgtctgatagctcattcaactcaaacttcgccacataaccgtcggcacccactttgcgcacatgatcttcgttggcgctgccagagagtgaggagtgaatgacgactggcagagccttgaggatcgggtcacgcttgatgttgcgggtcagcgtaaaaccatccatctctggcatttccagatcggtcagcaccagggcgattttgtcgtgaatcgattcgccggcagcctgcgcttcctggctcatcaatttaattttttcccaggcatcgagaccggtgttaaacatcagcgccggaatgcccatactcttcaggccctgctccagcagctgacgcgcgactttggaatcttctgccacaatcgccaccgcacctgggcggtagttgaaggcacgcggtctggctgcttccggttcgacgccgcgcactgatgggatgatgtcatacaggatttgctcaacgtccagcaccatcgccagctcgttgctctgcttgtcactgtccaggcaggcgatgctggtaatgttgcggccgccgataccggcttcggcggtatgcacctggctccagtcgagacgcacaatgttctcaactgactctacggcaaacgcctgggtgttacgggcatactcggtgaccagcagcaggttaagaccggtttccggcacacaacccgccacggcaggcaggtcgatgaccggaatgaactggccacgaatacttgccatacccagcagcggcgaacgcatgcctgcggctttggtgatagttggcatcggcacaatttcacgcagcttgaagacgttaatgccaaacagttcagacttgcctttcagctgatcggaacctaagcgaaacagcagcagctcaaacttgttcgataacgcgaggttcgctctctcatcgatctctttctgaaaattatccatggttgcctctgcattaacgcagctggtgaaatagggtgtgaacaggttatcggcagcaaacggaaaaaggtgagaagagaagggtgaaataaaacggacgccaattaatgtgccaggattaaccctgaaggttcaacatggacacctttccaataaaggagtgtgaaatgaaaaaagtgattctggcgtcgttgctggtgatgatgagtgcgggtgtttcggccgaagagggcggatacaaagcaggcgatacgccaccaccgcaacacaagcaggatgccggctataaaggttcagaagataccggtcagacgcatattgatcagatccgcgatttccgtcagggcggatatgtgacgctggaaggttacatcgtgaacaaagagcagggcgaacggtatcagttccgtgacaataccggcaccttaccgattatcgcgccgaagaagacctttgatggtaaaacctacaccgcagaagataaagtacgcgtcagtggtaaggtacagggcaaaggggataaaaccacgctgcatgtgacccaaatcgaagagccgtaacaaaccgggcgaggaaatcttctcgcccgttttatttagtccttcagcagaatcgcccggcaggttttgcctttgattttgccctgcttgagtttcaccagcgcatttttggcctgattcgcctcaatcgccacataggcatgggtcggcgtcaggacaattttgccgatctgctcggcacgataacccgcttcacccgtcagcgcgcccagaatatctcccggacgtatcttggctttacggccaccatcaatgcacaaagtcatcatagctgcaggcagcggcttgctgctgccctttttcagcgtactggcagagacccacggcagcttctgctgcaggaaatcttccagcgcatgcgcgcgagccatctcatcggcagcaaccaggctgaccgcgacgccatgttcgcccgcacgcgccgtacgaccaatacggtgcaggtgaatttcagggtcccaggcgagctgatagttaaccaccatcgccagcgatttgatgtcgagtccgcgtgcagcgacgtcggtggcgaccagcacgcgaccactaccgttagcgaagcggatcaacacgcgttcgcgatcgcgctgctccagatcgccatgcaaaggcagggcgctgatatcacgcgcgttaagcgccgcggcgacatcatcacattcacgtttggtgttgcagaagaccacacaggatgagggctggcgatcgctgagcagggctatcagcagacccagtttttcattgtggctggcttcgaaaaactgctgatcgattgaaggcagttcgctgacatcttctgtcaccacgctcagtgcatcacgctgaaagcgggtgctgatagccgtaatgccgtctggccaggtggcggaaaagagcagcgtctggcgcgaagcgggcgtcgcttcaatgatcgtttccatatcattcaggaaacccatctccagcatccgatcggcttcatccaggaccagcgtgctgagctggtccagcttgaggttttcgcggttaatgtggtcgaggatacgacccggcgtgccgaccacgatatggggcggatgcaccagcgaatcacgctgtgcgctcatcggctgtccgccacacagagtgagaactttgatgttgcgggtgaagcgcgccagctggcgcagcacattgcctacctgatccgccagttcacgggtcggacagagaatgagtgcctgggtctgaaagcgggcgctgtcgatatggtgcagtaaaccaataccaaaggcagccgttttaccgctgccggttttcgcctgcgcgcgcacgtcgcgtccctgcagaatggcgggcagcgtagcggcctgcacgggcgtcatgctggtgtagcccatctcgcgcaggttttcgagctggctgtcgggaagcgaattgagggtagaaaaagcggtcacgggcgcggcctctgaggctgaaagtgtagggcattattgcggggcaagtctggcagaaagcacgcctgacagcaacgggaacctcgatggttagcagtatgaaactatatctgtcagagggcttaggaatagactgaagtttacgggaaaaaggtggtttatttttatagattaaccccgacttaatgtgattgttccagaatgacgatcttttgaggccagcgattatttgataagtagccgtttttaaatatttatttcattgttaatcagataaatccttaactactactccagtaatagaattaatcattaaaaaatatcaccactagtgccgataaaaatcctgagctaattgctttatatttagcgcgccatattcctggtacaacgaccggtagagggtatttgcattgagtaatcgcatccagggaccacatgaaaatgtgcttaaaatagtaggccgcgccgtactgacactgcatgttcatggagagagcttatcggctgataagatcgcttcgatgattgcgtgttatgcggaagatgagccctgtgatcaggaagatcgtcgcttatacgcgctggcaatggaactaatgtcgaatgataaatgggccaaaagcgcgtaacccgcactccgctcaggtaaatgcagagcctcccttgtggaggctctgttgtttttggggggagtgggtttgcgttgtggggcaggtactggctcccggcgctttaggtaaggtggtcgtctgtaaccgtgcctgagccggctcgatctctccgcatttgctgagaaggctcagcgcgggcgattacgcacctcgtccctgaggtgcgcccgtagccgggccaacgctttgcgttgttcaaaaacgctcccggcgtttttagtacgcacctcatccctgaggtgcgcccgtagccgggccaacgcgttgcgttgttcaaaaacgctcccggcgtttttgtccgcagccctgctgtttcaggctgatgccagcgcaaacaccggtttaccgcgcgagaaggtcgcgacgaccggcgaaatccgtgccacggcttcggcggaacagctcgccgctaccagcatcatgctcgcttcatcgcccggtactggccactggcggtcaccctgggctgtcagcggcagccgatcgtctgtggcgatcgccagcgcccgcgacagcgagaaaactcatccgatccccgatagagctgcgcatagagattcgctttttccagcatgctcccggtgccaaacggtgaccagtgatcgataacgctgtcggtgccggtcatcaccttcacgcccgctgcctgtaattgcggaattggcatggtcagcttgccgatcggcagcgtagaggcgacgctgaattgctgctccgccagcccttcgatcatcttatccagcgtactgccggtcagggtcgccagcgcaaaaccgtggctcagcgtcactttgcccttcagcgccggattctttgccacggtgtcaatcatgtactgaatcgccgccacgccagcgggtgaggtttcatgcagatgtatatccacgccgcgctgatagtcgagcgcaatctggaacatcgcatccagtgacttctccatggcaccatcgacattggtggggtccaggccgccgacatactcaacgccgtgctgcatcgcctcgcgcatcagcccatcgacctgcgagtgcagcaggccatgttggggaaaggccacaatctcgcagggaaaggcggggtgacgggctaatgccgcctgcagatgctccagactttgcaggccgctgaccgaatcgatattgcaatggctgcgggcgcgggtggtgcctttggcgtgcagcagagcgatcaacccttcggcgcgcgcctgagagtgcggcagcagttgcggaatcagcacctgttcacgcgcaatcatgtccatgatagttttgccctgacggggacgcggagcctgccacgggccgccgtagaaggttttatcaaggtggatatgcatatcctgggtggcgggcagcagcagggcatcctgtgcatcccacgacggcagggtgctgtccccctgacccgcgggtgtcagctggtcaattttaccgtcgcgcacgctgatgtcgtaacgcccggtgcgggtcgcaacgatctcatcatcctcacggataaagccctcctccagccgcacattgcgcagcagatagtgatcctgccggggcagggcggcgggctggtcgggattgatggaggacaaaggtgatggcgtggcggcactggcatggccgagaccggcggccagcaagccgcctgcggcggtccagcggacgccctgcccaaggaaatcacgacggctcggcgaagaggaaataggcatcagagactcctgcaaagtgaacaaggtcttaatctgacaaacgacgctccaccctgctgcgttattttccactgacgactattcgatatctcactgccagcgcagctggctgaaggttgccagggattccgccagctcgcgctgcagcggatcctgcggatgacgacagaacagcgccagttcgaaggtatcaatcaccggcagaccctgttccgggcccagtacccgatgttgcggcaggcggcagctggcgggcagtaatgtcagccccagaccctgcgcactggcggcggccagcgcgaccaggctggcgctgctgtaactaatgcgccagctacggcccagtgcgtcgagcgtctgacacacctcatcgcgatagagcccctgctggggaaacagcaccagcggtaccggcgtctgctcaaagcagggccactctgcgctatcgagccacagcaggggttcaggacgcgacgccagcggacgctcgccagcgggctgtttaatcagcatgatgtcgagctcttcacgctgccaggcgcgccgcagctccacctgcatgccgctcatcacgtccagccgaagttgcggatggtcgcgactgaagtgcgccagcaaaccggccgtgggcgcggcgaaatcttccggcacgccaagacgcagcacaccgtcgcgccactggtcactcagcacatcgtgcgcttccccattcagggcgataatccgccgggcgtagcctaaaagtttctcgccctcttcggtgatctgcacctgatgcgaagaacggttcagcagctctttgccgaccatctcctccagccgtcgcacctgctggctgacggtggactgcgacaggtgcacccggtcggcggcgcgggtaaagctggcggtttcgcacaccgcgacaaagcttagcagctgttgcggagtaaacatcggctgacgattcatatttccactacctggcagagtaatatttcatttccagatagtaacgactgctgccaggctggcaacttttaactgtgtggatctcagatgaagagagagaacaacctgctgctggcggcgctggtgttagccgggctcaatatgcgaccgctgatgacctcggtcagtccgttactcggcgagctgcggcagagcatcggtctgtcgccgctggcggcatcgctgttgcctgcggtgccgatgatgatgatgggtgccattgcgttagtcagcgccccgctgatgcagcgctttgcggtacgtaaactgctgctgggtggcctgttgctgttgctgctggcgctggtgagtcggctgtttgtggctgacggaggctggctggtactgagtactgtgccgggaggggcgggcattggcattgtgcagatggcgatgccgggattgatccgtcagcgatttggcagccgcagtgccggcgtgaccggactgtgggcagcggcgctgatgggcggcggcgggattggcgcggcgatctcgccgtggctgaatgggcagcttggctggcagggcgcgctgagcagctgggcgctgccggtggtgctggccatcctgctctggctgtttatcaccaccccacgtgcagcccggacggaggccgccgctctgccttcgctgtggcgtaaaacccgcgcctggacgctggcgttgagcttcggtctggtgaacggcggatatgccatctgtgtcgcctggctgcccgatttttatcatcaactcggctggagcgcgcaggcgggcggttcactgcttggcatgatgatcggctgtcaggtcacgggtgcgctgctgctgcccttgctggcgcggggccgcgatcgccgtccgctgctgctgctgacactggcgatgcagttcagcggcatgctcggtttcctgtttgcgccacaactggcaccgtggctctgggcggggattgcgggcttcgggctgggcggggcatttccgctggctctggtgctggcgctggatcatctggagcagccgcaggctggcgcgcggctggtggcttttatgcagggcgtcggctttattatcgcgggcagcatgccgtttatcgccgggcagttgcatgcgctcaccggtcacttcaccagcgtctggttattgcaggcggcggtcacgctgctgttaatcgtgctaaatctgcgtttccatccgcgcagctatcagcacgcctttccggaggtgaatcgctgattttggtccgaccaataccggcaatatttttctctggttcacactccgggaaaattcgcgcatcttctgttgccataggttaacaatgcgttaactatctgttgccataagccccgacagagcggtttggtctgaccaatccggggcagatggcaccagcgctgcggctgcgtgccacgtcaccttttcctctggagatactggcatgcagatctggcaacaaaactacgatccgcagggtaatatctggctttcaagcctgatcgcactgatcccgattctctttttcttctttgcgctgattaagctgaagatgaaaggctacctggcggccaccaccaccgtggtgctggcgctgctggtggcgctgtttctctatcagatgccggttgcacaggcgctggccgccgtggtgtatggctttctctatgggttgtggccgattgcctggattattgtcgccgcggtgttcgtctacaagatctcagtcaaaaccggccagttcgacattatccgcgcctctatcctgtcgattactcccgatcagcgtctgcagatgctgattgtcggcttctcgttcggggcgtttctggagggggctgcgggctttggtgcgccggtggcgattaccgccgcgctgctggtgggactcggctttaatccgctctacgccgccgggctctgcctgattgtgaacaccgcgccggtggcctttggcgcgatgggcatcccgattattgtggcggggcaggtgaccgggctggacagttttgccatcggccagatggccggacgccagctgccgctgctgaccctgattgtgctgttctggattatggcgatcatggatggctggcgcggagtgaaagagacctggccggcggtggtcgtggcagggggatcgtttgccattgcccagttcctcagctccaacttcctgggtccggagctgcccgatattatctcgtcgctcgcctcgctgatttcgctgacgctgttcctgcgggtctggaagccggttcgcatcttccgctttgccgatgcagaggcgaaacagggcgatccgttgctgccaccgcagaagtatcggctggggcaggtgatccgcgcctggatgccgttcctgtttctcaccgccaccgtcacgctctggagtatcccgccgtttaaagcgctgttcgccaaaggcggcgcgctctatgagtgggtgctggctatgccggtgccgatgctgaatgagctggtggcgcggatgccgcccgtggtcggcactgcaaccccttatccggccatctttaagctggatctggtgtccgccaccggcaccgccattttaattgcggcgatcatggcgatgattttcctgcgcatgaagccaaaggcagcattgcagacttttggtgaaacgctgaaagagctggcgctgccgatctactctatcgggatggtactggcctttgcctttatctcgaattactccgggctgtctgcgacgctggcactggcgctggcgcacaccggccacgcttttaccttcttctcaccgttcctgggctggctgggcgtcttcctgaccggatcagacacctcatcgaatgcgctgtttgctgctttacaggccacgaccgcgcagcagattggcgtctccgatattctgctggtggcggccaacaccaccggtggcgtgaccggtaagatgatctcgccgcagtcgatcgctatcgcctgtgcggcggtcgggctggtgggtaaagagtccgacctgttccggtttaccgttaaacacagcctgattttcacctgtatggtcggtgtgataaccacacttcaggcctacgtcttcccctggatgatcccatgagcagcaatgccgatccgctggtgacgcgcctgcgggcctatatcaccgaacatcagctcgagccgggcatgcgcctgcccgccgagcggcagctctctgcggagcttggcgtctcgcgctcctcgctgcgtgaagccatacaacagttgatcagcaacggcatgctgattagccgacgcggcggcggcacctggatccgtcagcagctggcgccctggtcggaacagcgcatcgtcgagccgattcgccagctactgcgcgacgatcccgactaccgctacgacattctggaagcgcgccatgccatcgaggccagcaccgcctggcacgccgcactgcgcgccaccgacgccgacaaagagaagctgcagtacgctttcgacgccaccctgaagctgaaagagagtgacgatcccgatctcgccgcccaggctgatgtgcgcttccatctggcgattgccgaggcgtcgcacaacgtagtgctgctgcagaccatgcgtggtttttttgagctgctgcaatcatcggtaatgcagagccgtcagcgcatgtatacccagcccgcgattttcgcccgcctgactgaacagcatcaggcgctgctcgatgcgatcctcactggcgatgccgacgctgcgcgccaggcggcgatgcagcatctgggattcgtgcacaccaccatgaaaagcctgcatgaagatgaagcgcgtcaggcgcgcatcacccgcttaccggataacgacacacgcaacccaaaggaatctgactgatgattatctccgctgccagtgactatcgcgcggccgcgcaacgtatcctgccgccgttcctgtttcactatcttgatggcggtgcctatgccgagcacaccctgcgtcgcaacgtagaggatctctcggatgtggcgctgcgccagcgcattctgaaaaatatgtcggaactgagtcttgaaaccaaactgttcaatgaaaccctgtcgatgccggttgcgctggcaccggtcggcctgtgcggcatgtatgcccgccggggtgaagtgcaggcggcgcgtgcggcagacctgaaaggcattccgtttaccctgtcgaccgtctcggtctgcccgattgaagaggtggccccgcagattaagcgtcccatgtggttccagctctatgtgctgcgtgaccgcggctttatgcgcaatgcgctggagcgcgccaaagccgccggttgctccacgctggtgtttaccgtggatatgcccacgccgggcgcgcgctatcgcgatgcgcactccgggatgagcggcaatcacgcggcgctgcgtcgttactggcaggcggtcacccatccacagtgggcgctgaatgtgggtctgcaggggcgccctcacgatctggggaatatctccacgtatctgggcaagcctaccgggctggaagattacatcggctggctggcgaataatttcgatccctctatctcgtggcgcgatctggagtggatccgcgaattctgggatgggccgatggtgatcaagggcattctcgatccggaagatgcgcgtgatgcggtgcgctttggcgccgatggcatcgtggtctctaatcacggcggacgccagctggatggcgtgctctcctcggcgcgtgcgctaccggccattgccgatgcggtaaaaggtgacatcgccattctggcggacagtggcattcgcaatgggctggatgtggtgcggatgattgcgctgggcgcagacagcgtgctgctgggacgggcatttatctatgcgctggcaacccacggtcagcgcggcgtagaaaacctgctgacgctgattgaaaaagagatgcgcgttgccatgaccctcaccggcgcgaagtcgatcggtgaaattacccgcgattcgctggtgcaggcggaagcgttactggcaccacagagcacaccgccacgtccccgcgcggtgagttgagcctgcgaaaatgaatgtattgtctatacttagcttctttaccaacaggaggaacgacatgaccattcataagaaaggttcggcgcattgggaaggcgatatcaaaggcaaaggcaccgtcagcaccgagagcggcgtgctgagccagcagccttatggctttaacacccgttttgaaggcgccaaaggcaccaacccggaagaactgattggtgcagcgcatgcagcctgtttctctatggcgctgtcgctgatgctgggcaacgcgggtcatccaccggaaagcattgataccacggccgacgtgtcgctggataaaaaaggcgatggctttgccatcaccaaagtggcactgaccagcaccatctctctgccaggcattgatgagtcgaccttcgacgagatcatcaataaagccaaagcgggctgcccggtttctcaggtactgaatgcggaaattacgctggattacaccctgaacaactgatgccggtaacgggtcgccttttggcggcccgggcgttatgctatgcctcaccggtcctgttgctgaccggaacagatgcgccttctggcgcatcttcgctttctgaccagaggaaactgaggtgacgagataccgggcagccaaaaagtactggaagatggtgctggttctgttgtgcatctgtggcgcgctgctgctgattcgctgggctgccatgatctgggcctgaacagatgaaggggattggccgccacacgctgggcatattattaatggtgattattgtgctggaagcggttcactatctgcttactgcctcatggctgccgtggcgataaacgcgctcagacaaaggcatcctcgcgccttttagaccgcacatcgctgcgcgcaatgcgataagccttgcgcggatcgcctaccacaaactcaaaggttggcgtgtagtaaaatggcagccagccgccatagctgctctcccactcccaacggacggggcagggccacagaatgccatcatacaaaagatagtaaacccagcgtccaccaggacgacgggggcgtgatgttttcatgggattcacaacgataatggttaacaacagcttatattttgtacgctaaagcgtcagcttgcaacgttacagccctgctttattgaacctggccctgaattagcgatgtacttcgccgcacagcagtaccacattcggtctgactttatgaatgcggttcgccatcgtttcacagtcgaccttcgtcggatagatgcgctctgataccggcagcgcctcgcaggcatcgtagccgcatgcgctcactaacaacacaaatcctatcaacatagatcctctcctttacacggtctggtggtccggactgtggtgctttttatccctttttaacatccagtatagacaaacgtgccggggcggcattgtcagtgtgagctatggtccgccagccagggtgtgatgcggcggcctgtaaggtgtgtcagaaggggcgggcctggcgctagcctgcgaaataccaggcgggcagcagcgcaatcaggttattcagcgtgtgcaggaagatgggcagcgccagactgttactccgcagccgggcgtaacagagcagtagcgaaaacagcgtcagggcgataagggtctgccagtgcacatactgcgtatgcatcaccgcaaacagcagtgaggtcagcagcatacaggcaaagcggctccgtggcgcccacagcagaaagccctgcaacagaaaaccgcggaacagcacctcttcaaacaccggtgcgagcagcacggcggtgagcagcaggatcagcagcgaattacgtccctgctgggcctgcatcaccagccatccttccggctgcatgaactgcatctgtgcggccatcagaacaaatagcgcgccagtaaacagcagagtttgcagggtgcagagttcacccagcggcaggtctgtacggcgctggcagtaaaagcggtaaagcggatagataacagcaaattcaaacaggcagagcaccggcaccagcaggccgtcattacgcagcacgctgtaattagggaacagcgtgatcagcatagtaaccaggtaatagaccacaaagctgccgacgtagaacagcgtcagtgtcactctgtcggaattggtattcataggcgactctgccagcgaaggttagcgcatagtagcaatgcaccagatcgctgtcgagtcagcctgtaacacaatatttaagcgcaaaatgttaaccgcagactaaacacccgcgcgcgtgagccgataactgaggaaactaatctggtcagcactgcatgttgtattgcaggcccgtcatctcaaactctgactgtgtagtgagcactcttaatgacttctaaccctccggcgccaccctcgcctccattcagtcatgccgctgaagaccgcactgtccgctttacgcggcgcagcctgcgcacgctttcgctgctgctgtttggcgtgctggtgctctcgatgctgatggtgctgacgattgcgcagcggcaaaacagcgtatcggttgagcatgaccagttgctgatgcagcaggcgtggaaaaatcgtcaggaggcgatggtcacggatatccgggattatgcgttctggggcgaagcctggcgcaatctccatgtcagggtcaacaaagtctgggcttatgacgaagagaaactttggtccgggcctctacgaagagtatcactatgagggcgtattcgtggtcgacggcaacggtcacaccacgtacagcgtcattaatgggcaactggtggatacgccgctggaagcctggctgggaaaagaggctccagcgctgattgcggcggcacgtcagcgcaacgacgcggcgataacccgtgatgcgctgattaatcatctgcccgccattgtggttgccgcccccatcggcagcggcaaactgacgaatatgccgccgatagcggggccagcgtcagtcatggtgtttgtgaatctgttcacccctgccaaattacaggcgctgggcgccacgctggatgtgcgcgaactgcgcctgcccgtcagtgcaggggatgccctgcgtgaaccgcggatggtgcaaccgttacccggtggcgatctgattgtgctgcgctggacgccaaagatgcctggcatgggcctggtctggtttctgttaccactactgatgctcatggcgatcatcattggcataatcacccatcgcgtcagccgccatgcgctctctaatgcgattctttctgaccggcgctttgccctgctggcgatcagtcagcaggagctggccaacagtgaagcgcggtttcgcgatctcgctgaggcggcgtcagactggatctgggaaacggatggagagggccgcctgatctacctgtcagcgcgctttcaaaccgtgaccggccacgatattacacactggctgggccgtcacatcgatcacctgctgacgcatcccagccattcgctggtcgcctggctgcagcgtcaggaggaggaggggcaacggatgccactgcgctgtcagtttatgtcggcgcacggcaaccgccgtatcggccagctggtcgcgaaaacaatctggcatgatgcgcgacgtatcgggtttcgcggcacggtgtcggacatcactcagagcatggaagccgaggcgcgcattcattttttgtcgcgtcatgacgtcttaaccggcctgtcgaaccgcgtacagctgcaggagtttctgacgctacaccttgagctgcctgatggcgctgcgccgctgacgctgattaccctcgatctcgatcagttcaggccgattaatgaaacctggggccatgcggcgggcgatgaggtgctgagccagatagcgcagcgtctgaagcgctgtatcggcccgcaggagctggtggcgcggctgagtggcgatgagtttgtgctggtattgcgtgaaacgaaccgtgagcgggtcgatcagcgttgcgcacagctggtgcacgaggttcagcagcccatcagcaccggccagcatgtccactatctcaccgtcagcatggggattgcctgtgtaccgcaggatgccagccatccggaagcgctgctgcaaatggctgatatcgcgctgaatgaagcgcgcgaagcgggacgcaatcagtgggtctggtatgccaatgagatggccagtcagcgtgaggataagcgtgaaatggcgcggcggattgagaaagcgctgaagaacaatgaatttcgcctgcactaccagccccgctatcaactgctgacggggcagctggcaggtgccgaggcgctgattcgctggcagattgcgccggatgagtggattacccccgatcactttattccgctggcggaagagagcggtctcatcgccaccatcagcgactgggtgctgatgcgcgcatgtgaggatgcgctgggatgggggggcgatcgctatgtttcggttaatatttcgcccatggagttccgcaccagcgatttagtgcagcgggttgcagatgtgctggctaaaagtggcctgccggctacccggctggagctggagatcacggagaaacgtgacctttgaacatccgcagcatgcgctggaggtgatgcagggtttacggtcgctcggggtaaggttaaccgttgatgatttcggcaccggctatgcggccctgggctacctgaagaccttcccgtttaatgggctgaagatcgatcgctcctggatgaaagatttcccggagtcgcagcaggcacaatcggtggtcgcggggattattgcgctggcacgcgcctttgccctgacaattacggctgaagggattgagacagaagcgcagctgaatcagcttaaacagctttcgtgcgaagaggggcaaggctacttcctcggtcgaccgatgccgctggctgcattcagtacgcttctggaaagaaccgcgcagaaccaggctgaacccgtttaacggactttaaccgccacggcggtcatcagcattgcgcagacgacaaaaataatcagttccatcatgacctccacagggctaagactattcttaatattgtagtggtccgctgtgctttttttaggcaatgagtgcgattaatcttaaaagatgacctgtgcggcgacccgtttaatgctgctgtaacaactttactttttaggggttcaggtcagcaggtgcgctttgctactcttggggcagggttttacacgtccaacaggagaataaacgtgaaattttatggaaaagggctgctggtagtcgggctgtttgcattaaccgcctgtcaatctgcctctaagcccgataccgccagtgtggcgcaggatcccgaagctgaccgctgtggtgcctctcagtttcagaattatgtcggtaaaccgttaaccgcgctgcagggtcagcacttcgaacagaaggtccgcgccattccctataattctgccgtcaccatggacttcaaccttaaccggctgaacttcctggctgacaaaaatggcaatatcagctcagtttattgtggttaatggcaaagatgtcataggtttgtcataacggcaggcgaggatagcagcgcgtttaagaaacttcctcgtcacacaatagatagtgctcgtcttgtttattcccgccccggcgggaatttttttagcggcttcgggccgtaacaggagcagagaagatgaaacgcataatcggggcacttctgcccgcattgttactcagcagcacactggcgcaggcttccagtgaagaggcctggcaaaagagccgtcaggtgatggtgcaggcctgcattaacgccagtcatctgagcaaagtaaaggtgctgggcgaggcgatcgagtatgacgacaatacgggctacagcgcactgttgctggagggacgttatccccagccgcagatgaaaaataagcgtggacgggagctgtgcctgtttcagcgcagcagcggacgagccagtatcagcgaagcggataaattgcgctgggtgaagtaggtggtgggtttacgcctccggctgcgtgtcgatcaactgcgccagcagggtgcgataacgctgcaactgcgtctcgtcgccttccacttccagtttatcgataacccgcgcaataagggctttattggtggcgggtttctcccgcttccattatttcacgcagaatcaccgccagcagatcggactcaggcggtatccgccagtccgggctgttaaaatagtcgctgatagcacggctggcgctgtcaggttgtactctcattacccacctccgctaaaacaagaccccctcccttacacctgagcataagggcgtttaaccatgaaataagctggttcgcctcagcgtagccggacggtctgcaccgttttttgcggaggatgtcgcgccgattaaaaagattgctataccgccgcggctggcggttttttaaacatagaagcggggtgaagagttgtcagtaacagaatgacatatttttctatattgacgggccggattgagggatatcgggtctggccagaccatcgcccgcgtgcttcgcgctaaaaacccggtgggctggaaaatttgcgccggtgattgcgctgaatcaaagaggaaaccggtcttttgccatttgtgccatgttttgtcggtcacgctgagaatagccgcgttagactgaacattccctctctttaaaatatctgctcatgccacgcactatagaaccctggaagataaacctgatctcggtctggtttggctgtttttttaccggcctggccatcagccagattatcccgtttctgccgctctaccttgagcagcttggcataaccggtggcgaatcactgagcctctggtcgggtctaaccttcagtatcacctttgtggtttcggcggccgtagccccgctgtggggcagtcttgccgatcgtaaaggccgtaagctgatgctgctgcgcgccgcttttggcatgggcgtggtaattctgctacaggcttttgtcaccgaagcctggcagttgctgctgctgcgtgccctgatggggctgacctccggatatattcccaacgccatggcgctggtggccgctcaggtgccgcgtgaacgcagcggctgggcgctgagctgtgtctcaaccggtcagattggcggggtgattctggggccgatgctgggcgggctgctggcagactgggtcggtttgcgtacggtgtttattgtcaccgcagcgctgctgatggtcagctttctggtgacgctgttcctgatcaaggagaccggttacaccccggtgagtaaaaaggagaagctcagcggacgcgaggttttccgctcgctggataatccaaaactgatgctctgcctctttttcaccaccatggtgatccagatgtgcaacggatcggtgaaccctatcctgacgctctttgtgcgggaaactggcacccaccgctgagaatatcgcttttcttagcggggtcattgccgcgctgcctggcgtctctgcactgctggccgcgcctcgtctgggacgactcggcgatcgcatcggtacgcagcgtatcctgctggcaacgatggtcatctcgctgctgctgtttatcgccatgtcgtttgtcaccagcacgacacagctgggggtattacgttttctgctgggctttgccgatggcgcgatgatgcccgcggtgcaggcgctgctggtgcgtcactcgcgtgacaacatcaccggccggatcttcggctataaccagtcctttatgtatctcggcaatgtcgcgggtccgctgctgggcgccgcggtgtcggcggtggccggtttccgctgggtcttttttgccaccgccgtggtcgtgctgattaacgtgctgtttctgaagcgcttttaccggcgtccgaagacagatctgcccgcgtcggctggcaaatcgtcagttcagcctgccagcgctgctgagtcagtaaaaactcaggactgacgctggggctccaggagtcatcgccgccgacacccatgtggcaggcatccagatgcagccagcagcccgcttccggacgcagatggtggcggtgtgatgcctcccgcaactgctccaggctaaaacggctcagtgagaaagcgaaatcgccgctgacctgccagctgccgctgtcgagctgacgggtgccgcagcgcagaccgttctcacccgggaaaacataaggcgttgagagctgatccagcggcagctcccagcgggaaaactgcgcggccagctggcgatcgggatagttttcatgcggacccagcccgagccagctcacctgttgtggtatctgcgtcagctcacagcgtaatccgatgcgcgcgggcgggggcaatccgcgcgactgctcaacggaaagctgcaactgcaattcaccctgcgcattgatcagataacgtttacggctgataaaggcgatctggccatgggcgagccagctgtgcagcgtctcaatctgcaccgcctgtggcaacgcattcgccgtcatcgacaccagctggctgctcatctggtcataacccgctgctttccagcgctcgacccaggcattgggatcaacccgttccgcttcgctggtgccgatgtcattgtcgagcggggcgcgaataaagcagtcctgaagcggtgaaagcagcgtgggctgttcatccacaaaccactgcgtcagttcgccgctgtggcgtgaaaaatgccagcgttgctgctgatgggtgatgacaatctcacgggtatcatcgtgcaggcccggtgcgtggccgctctccggctttgatggcagcgccagcgacgagggcagcgcccattggtgccaggcgacacgccagtcagcggcgctccattgggtcggttgaatctgatgaaccgcgacgttcagccagcattcgccctgtaatgctggcggtgacggcagcgtgatccgctgctggccctgtggagcgatatccagcggcacttctccttccgtcaccacacgacccgcctgttcgatgcgccagcgcagcacttcgttgtcactgtggcggaacaaatagtcgctgctgaccgtaaagctcagcggatcgccgggatcgacgtcaaactgccagaactgctgggcgcactgcgcctcataaagcgccggatgcggcgtgcgatcggcaaataccagcccgttcatacagaactgacgatcgttgggtttatcgccaaaatcgccgccgtaggcctgccagggttcgccctgatcgttatagcgggtcaggctctgatcaacccagtcccagacgaagccgccctgcagacgcgggaaactggcggaaggcctgccagtacttagcaaaaccgccaaagctgttgcccatggcatgcgcgtactcacacaggatgagcggacgcgtctcacccggcagaccgatccactttttcagcgaccatttcggcaccgccgggaagggctgatcttcatcaaccctggcatacatcgggcagatgatatcggtagcagcggtatccgcaccgccgccttcatactgaaccggacgggttggatcgctgctttttacccaacggtagagcgcatcgtgtgtggcaccatgtcctgactcgttgcccagcgaccagataataatgctgcagtgattacgatcgcgctgcaccatgcgcgtcacgcgttcgctataggcggcgaaccagcggggatcatcggagagccggttcatcggctgcatgccgtgggtttcgatattggcctcatccaccacataaagcccatactgatcgcacaaccggtaccagagcggatgattaggatagtgtgaacagcgcaccgcattaaaattgtgctgcttcatcagctcgatatcgcggcgcatcgtcgcctcatccaccacctgaccgcgctccggatgatgttcatgacggttggtgccacggatcagcagcggtttgccgttcaggcagagcaggccgttatcgatggtgacctgacggaagccgacatcataggcttccacctcgatcagctgctgattctcatccagcagcgccagcgtggcgcgatagaggtggggtgtttcggcactccacagcgcaggctgttccaccggcaggctgagcagggcgcgttcgggatagtgaccccgctcgtcaataatggcactgcccagcggctgctgacactgagcaatctgctggtcaccctgccacagcgtcaggcgcagcttatagcgcgagctgacgtcatctggcagagcaacacggacccgggcacgcaattcggcacggtaaaactccgggctgagccgggtttccagctgaacatcggccagatgcacctgcggtttatgcaataacgtgacgtcacggaaaatgccgctcatccgccacatatcctgatcttccagataactgccgtcgctccagcgcagcaccatcactgccagccggtttttgcccggccgcagataaggcgtcaggtcgaattcagcgggcagacgactgtcctgagagtagccaatccagtgtccgttgcaccacaggtgaaaggccgagtttacgccgtcaaaaatgatgcgtgtctgcccattatccagccaggctgcgtcagcactgaatgtgagcgagtaacatccggttggattctctgcggggacaagtggaggagtaaccggaatcggatactgcacgttggtataaatgggcgcatcgaagccgtgcatctgccagttggccggaaccggaagggtcgtagtgtccggcagatcctgcagtaaccagctggccggaaccgcttcaggctgcgtaaaataacggaaaccccactctccgttgaggctctgcagtgacgccgaggggctgtcatcccgcgcggctgcttcatctcgccagctggcgaatggcgggtgcgcatccagccgatgcagcgaggtcacgaccggattttcccagtcgcgccgggagaggatgtcactgaaagcagcctgagagagagtcatgtttatatcctgtaaatgtaatgcgctcacaatgcgcaaaattacgccgcctgtaaagtgttcaccctcccgatttgcacaaataatttgcgctgtaatccagccgggatgttgagattgtgccgccttaatggtggtaaatcgttaagtctggtcagcaaagatgaatagtcgccggatgcggaagaatctcacttgtcgccatgcaggtggctccatacactcagcccgatttcatcaccctgaggtagatatggtacgaatctttaagctggctgccgttgtggcattggttactgcattaagcggatgtattttcccgcctccaggcggcggtgggggtggctggggcggacacggcggcggaccaggccgcggatttgtcgatcctcgctaagcaaaagaccgatttcggacgggcgaaacgtttaaccatagcgttgattgcagggaaaacgtttcgctcgcaaggttagccggcatcgtctgagcagacggtgaggaatgcgggctaactcactgaaaaaagtagcggttaccctctgtttttttagccagcgtggtgataatttcagcttttctccaccgctgagataacagcatgaaaaacctgattgctgagttgctggtaaagctggctgaaaaagaggcgacagccaaagagcagatggcgcaaatcgaagcgctggagattgttgttaccgcgctggtttcgcaagctggagccgcaacaacatctggctataaccaccagtattgaaaccgcaatagacaatgtggccgatgccgaagatgaaaatgcgcaactgctgcgcaattacatcgaaaagttactccgccatcctcgtcagtaacaatcccagtgccagactggaatgggatcttcacatcactttgacctgaaacattttccgctttgcttattcgctgccagaataacaaaggacaatccactgtggagataacaagatgaaagtcggtttaatggcgatgatgatggcgggcctgctggtcagtggactggccggtgcggcggagaagaccccgcagcaggagaagatgacgatgtgtaaccagcatgctaaatcacaggatcttaaaggggatgcgcgcaaaacctttatgagtgaatgcctgaaaaaggacagcaagctgtcgcagatgtcaccgcagcagatgaaaatgaaaagctgtaacggcgaagctggtgataaaaaactggcgggcgatgcgcgtaaaacctttatgagccagtgcctgaaaaaaagctgattatccccacggccacgcaggtggccgcttctccttcccgcgcaatgctgattaaattcccttctataacagcatgttaaccttctgataagcattcatcgccaggcttcccggttcttttgccacacttactgtttgtggggatttgcgcagcactctgttttgccgcgcagcacaagacaagaaccgttaaaggagccatgtcgtgaactatcaatttaccgtcgacctgaacgatctgccccagcgccagccggttaaaaaaacgctcggcgaggtggaagtgttgctgatccgcgaaggcgaccatgtacgtgcttatcaggcgaaatgcccgcacgcaggcgcgccgctggagcagggcgcgatttgcggcgatcggctggtctgtccgtggcacaaagccgcgtttaatctggccagcggaaaaatgtgtgaaccgctggcgttagccgatctcaaacagtatccgctgcgcattgaagagggccgggtgctggtgaatccgaaagcgatgtcgcccgcggcgccgattggcagtggggcagaagcaccggtctatgtggtgctcggtggtggggcagcgggcagcgcggcgctgtggcgtctgcgccatgaaggcttcaaaggccgcgtgattctggttgagcgggaagcggatgcgccttacgaccgcaccgcgctgaccaaatttgtgccgtcgggcaaaatggatatcagcgaggtgccgcagctgctgaaagcggatgtgatggaccacgttgaacggcttcaggctaccgtgagccgcctggatgcccagcagcaacggctgatctttgaggatggcgagacgctcgccttcgacaaactgctgatcgccagcggcgcgacgccagtccgccccgatttgccgggcagcgatctcaatggggttcatctgctgcgcagcaaagcgcagaccgatgagctgcttcaggcggtggatgccagccataagatcgtgattatcggcaacagttttatcggcaccgaactggcgtcggcgctacgtaatcgtgacattgacgtgacgataatcgcccgacaggcgttgccctttgctaaacagtttggcgatcagattggccgctatttctatcagctgcatgagcagaacggcgtgaagtgggtgcagggcgagatcgaagccttacagggcgaccagcgggtgagtggcgtgcagctcaagggcggacggttgctggacgcgacggtggtgctgtttgccaccggggttaaaccggctaccgactttatccacgatctcccgctggcagaggatggcagcctgcaggcggatgagcagttgcgggtcgctgacaatatctgggtggcgggagatatcgccacgtatccgtcggcgcaggggccgctgcgcattgaacactatcgcgtcgcgcatcagcagggacaaaccgccgcatggaatatgctggaccagaccgtcgcgtttgatcgtgtgccgttcttctggactacgcagtatggcacccgttatgagtatctgggccatgccaaagaatgggattcattccagctgctcggctcgctggaggataaaaagtttatggcgttttatggccagcaggggaggctggcggcaatctgctcatgcggcatgtatacgctgaccgctgagctggtggagcggatgcagcagccgatgacgtttgccgacgcggtggcgctctgtcaggaacagatccgttaatatcagttaaggcggaggcaaggcgggccagcgtacggggccgccttgcgcaacaacactcactctgttagctgcggctcagtttctctgacttcgccatgcactgcagcatcgcttccatcaccgccgagcgcatgcctttctcttccagcactttcaccgcttcgatggtggtgccgcctggggagcagaccatatctttgagttcagccggatgttttccggtggtcagcaccatctgcgccgcccctttcaccgcctgagcagcaaactgataggcctgagcgcgtggcatgccacccagtacggccgcatcggccatcgcttcgataaacataaacacgtaggccggcgcagaaccgctgacgccgaccacggagtgaatcagatattcatccaccacggccgctttgccgaagctctcaaaaatcgctatcacctcgtcgatttccgcctgctcaaccagcacgttgggcgtgaccgaggtcatgccttcgctgaccagcgagggtgtattcggcatcgcacggacaattttacgatcgtaacccagcaccgatgagagcgaatcgagcgtcaccccagccgcaatcgacaccaccagcgcctcttttttcaggctgcctgtcagctcttttaagactttcagaatgacattgggtttgaccgcgccgaacaggatgtctacttcacgcgccagcgcttcagcgctctccgctgcgttaatgccatactgctctgccatcgcctggttggtctctgctttgcgatcgtaaacgaagatatcagacggggcgattttgccgctgttgaccagtccgccgataatggctttcgccatatttcccccgccgataaacccgattttctttgccagcatcgccatctccttaggacattattcgtttttctcagtgagctagcttacttcagccagcctgaataacaagtcagccgggcgcaggctggaaagcacgccgcaaataaaatttgccatttaaggggaacccggcaagatcttactcttctctgactgtaaggaatcatgatgtttatctgggtcgatgccgatgcctgtccgaatgtaatcaaagaggtgctctaccgcgcagccgaccgcaccgcaactaccatcacttttgtggcgaaccagtttctgcgtgtgccgccctcaccgtatctgcgcaccctgcaggtgcctgccggatttgatgtggcggacaatgagatcgtcagacgttgtcagcccggcgatctggtgatcaccgccgatatcccgctggcagcagaggtgattgagaagggtgcggcggcgctgaatccgcgcggcgagcgttactcaccggcgacgatacgtgaacgcctgacgatgcgggattttatggataccctgcggtcaagtggggtgcagaccggcggccccgcggcgatgagtccgcgtgaccgccagcagtttgcaaatgagcttgatagctggctcacccagcagaaacgctgaagttaaacgaagctgtcgtcgtcgtaatcgttgccgccaaaatcattgagatcgctgttgtcggcataattactgtcccagcctgtattctggtcgaggaaggcgttgtcgttaccgccgttaaaggtatcggcattgtcatcgccaccgttgaaggtgttgagattgtcattcacatcgggcagggggggctcattgataatgttcacaatctcttccggctgtgaatggtggaacatgctggtcagcatatcggccatcaccacaccgcccgccacacccacagctgtctgcagtgcgccgccgaggaaaccggtgccgcgtggtgcaggcgcttgtgcaggcgcatattgcggctgagccggttgctgtgccgcactgttccacggtgacgattgctgttgctgctgcacaggcggctgctgacgcgaaccgctgccaaacagcccggacagaaagccgccgctgctctgtgcaggttgctgctgctgttgctgggccagctggctttccagcgccgatactttctcattgagttttttcagcgccgcttcctgaatcaggatcgcctgtgccatgtagtaaggcgcgcccggctgcgcctgcagatgctggttaatcagttgtttcggcagcggcatcgcgtgccacggtctggctttcagcctgtttcagacggctgaacagcccttcgatcagttgttgttcttcgcgttgcatgatgactctcctgtggcgattgttaccagtatatgtgggcgccagcgtgaaaagtaaaatcggggcagtaagcaaatattgccgacgcattttagccgctcttttgcggagtttttatcgctctgttacggccctgatgcacaaaacgtgcatgcatttccccttgaaaacacaaagattgtcgctgttcaggggacgaaaatgcgtaaatcgtgcctgacaggtagaggccataataatttccagttattatgcgtcgcattaataagctcaccatgcagccgcatcgcgcggtcaggcggaggaacggccctgatgtcactacccatctttttgattggcgctcgcggttgcggcaaaaccacggtcggcgaggcgttgtcgcgggcgctgggctacgcctttacggataccgatcaccatctgcaactcagcacgcagcggagcgtgacggagattgtggcggaggaaggctgggaaggtttccgcgcccgtgaaacggaatcgcttaaagcggtgacggcgcccggaaccgtcattgccaccggcggcggcatgattctggctgaagagaactgtcgttttatgcaggagcagggccaggtgatctggcttagcgcgtcccccgaggtgctggcagagcggctggaaagtgaacctgaagcggcccagcgtccgaccttaaccggccgtccgattgctgatgagatgagtgatgtgctgcgtgaaacgtgcgcatctctatcaggctgcggcccatcatcaggtgaatgcgatgcaatcgcccgagtgcgtggtagaagaaattctgctgtcactctctctggcgcgcgccagctaaccctcagatttttcccgctttgatcccgcttcagacggcattgtctatacttatcctatgacaggcagcggcctgtcctgtggaatgttattcagacaagagggacacagtatgccgaccagaccaccgtatccacgtgaagcgaaagttgtgcctgttgaaaagggcactgaaggtaataaagtaacctcttacgaattgcgtgctgatcatcccaaaccgaattcattaatcagtgagcacgaaacggaagaagaagcgcgtgacgctaaagcgcgctacgaagacgttgaaaaagagtaaagcttcattgctggcagggacgccagcctgttacaccgcataactgcttattactgacccgcctgacgctgtgcctgaaccacgcctctttttactcccacctgaagtcgatcgggttatttaagaagcgaaattgacgcagatttactgtcgaatgctctctgcgtatgcttctgttctgcactctccttgtctcaccagataaagccccgctaatcatttttatccccttattttctctgctgccgatctctgtgtgagtcaaattgtcgcttgaccgattcagcgccacgttttattttcatcaaaccaacagaggaacttagttccatatagtggaacacgtaacatgaccacacttgaaaatgctgccgccgtacttcgattgtttcagcacaaaggtgtgacgcaggggcatgttggtctctcattcagtgaggtggttgaggcgttaaacctgccaaaaagcaccgtttcgcgtctgctggccaccatggaaagtcaggggctgctggagcggaatgcggatacgcgcggttatcacattggtcgcgtattgctggctgctgccggacattatctttcggcaccgctggttgacagcgtttcagcggcgatggtcaggctggctgcgaagaccggctgcatgggttacgtgtcgaagctcgacgggcgggaagtattagtgatgcgtatgtttcatgggcgtcactttacgcagatggtcacgccgccgggcagtcggatgccggctgccgcgacctcaaccggccgggcgctgttagcgcagttaagtgatgaagaggtgctggcgcgcttccatgatcaatggcaggtcgcatcagcgaactcgccgcaaagtcctgaggcactctgtgccagactggctgagatccgccagcagggctggtcactggcccgaaatgaatcgctgccaggcatcagctcgctgtcagttattgttcataacaaacatcatggcgaaacggtggcactctgcctgtcgtttccgtctatggagtctgaaccgggtttcccgtcagagctccttgaagcattacgcgcaacggccactgagatgaccgaaaaatatggcgcgtaacttcacaccgtttttatcggcgtagtactttcgccacaccagggaaaacaaaggccttcgggcctttttctttcaatctgatcgccacgttttacgcagcactccggttgcctgtgtctgtctctcattgcctcctgtatcggttcagcctccggagggacgaccatctgcagtggctgttgcaatctctgtgcgcatcagagcagtgaaactgataaccggcgtaaaccggccagcaggcgggtagacgttatttcatttcttctggacaaggactggcggggacatatggaacgggtaaatccgattaagcacgttggcgtggcactggttttaattcttctctccatcgcgggtgccattattggcattcagctgattaccaccattggcgtaacgcctaacacctctattatcggcgcgctgtttgccatgctgctggcgcgtattccgctgcaggcatttcgccgttatcgttcaattgaaatccagaacctggcgcagaccgccatctcttcagccacctttggggcggcgaacagtctgttgatgccgattgccgtgccctgggcgctgggtgaaccgcaactggtcctgccgctgttctgtggcgtcagcgccgcgatgctgctggatgcctggctgctctatcggctgtttgatacccgcgtctttccggccagtaatgcctggccaccgggcgttgcggcagcagaagcgatcaaagcgggtgataaaggcggacgccaggcgtggctgctggtgctgggcatcgtgggtggcgtcgtcggtgccatgctgaagatcccgatgtccgccttcggcaccgcgtttatcggcaatatctgggcgctgtcgatgctcggcatcggttttctgctgcgtgcctatgcgcagccggtggccggtattgatattaatgcgctctatattccgcatggcgtgatggtcggtgccggtctggtagcgctgattcaggtcgtgatggtgattcgcagccgcaaaaatgatgcgctggtggtgagccgcaatggcaatgaggtgcagcgggcgctgggtttcggcagcgtgggttacatcgtgatttcggcgctgctggcgctggcgggcggcctgtggagtgagatgggcatcgcgatgctgctgctgtttgttctttatgccgcgtttgctgctttcgcccatgaactgattgtcggcattgccgctatgcactccggctggttcccggcctttgccgtggcgctgattacgctgattatcggcattctgatcggcttcccaccgctggcgctctgcctgctctgcggctttaccgccgccaccggtccggcgttcgccgatatgggttatgacctgaaggcgggctttatcctgcgcggcaacggtgccgatctgcagcaggagctctggggacgtcgtattcagctcatcgcagctatgatcgcctttgttgtgtcgattccgctggtctggtacgcccataccttcttctttgctgacaacctgctgccgcctgtagcgcgggtgtatgccaaaaccattcaggcgggtgctgagccaggtatcgccggtaatctgctgatgtgggcgattccgggggccattatccagctgatcggcggacccaaacgccagctgggcgtgctgctcgccaccggtttattaattaataacgccatggcgggctgggcagtggtggtggggatcgccttacgcattgtaatcatccggatctggggcgagcggggccggtcgcctatggaggtgatggcggcaggctttattgccggtgatgccctctacagcttctttcattcgctgtttgccagcagcagcaagaaataaaggataaagcatgagtttgcagcagaccctggcggtttttgagttactggatagcgcccacattgacggacagcaggtggtggatctcttcgcggcgtatcctgatgttgatgcccgctttacccgtgtctccggtcccaaaggccgcaccgattttgtgcgcattgatattccggggacgcagggcaaatcaggcggcggcagtgcaccgacgctggggattattggtcgccttggtggcatcggcgctcgtcctggtcgtatcggcatggtgtcagatgcggatggcgcgatcgcggccgttgccagcgcgcttaaactggcgcagatgcagagcaaaggcgacaggctcgatggcgacgtcatcattaccactcatatctgcccggatgcgccaacgcggccgcatctgccggtcgatttcatggactcgccgattgacgatatcaccatgaatgataatgaagtggtggcgggtgtggatgcgattctgtcaatcgacaccaccaaaggtaaccgcattatcaaccacaaaggctttgccctgtcgccgacggtgaaagagggctacatcctgcgggtttcggaggatctgctgcgcatcatggagatgaccagcggccgtccggcggtgacctttcccatcaccacgcaggatattacgccttacggcaatggggtttatcacctcaacagcattctgcaaccttctaccgccacggatgtgccggtggtgggggtggcgatcaccgccgagtcggtggtgccgggctgcggaaaccggcgccagccatgaagtggacattgcggcagcggcgaagtttgccattgaggtggccaaggagtttggtcgtggaacctgtcacttctacgacgccgaagagtatgcgcggctgatttcactctatggcagcctggcgcatctgcgtcaccggaatcactaagatgacgaaaccactggtaacgctgactatcggccagtctccgcgcagcgatattctgccgctgctgcggcagcatctgccggatgcgctgaccgatcacgccggtttactggatggactcagcgcggcagagattgccgcacgcttcgcgccagcagcgggcgaccgggttctggtgtcgcggctgcagagtggcgaacaggtgcggctggcggcctcgaaagtggagcagggattgcagcgcaaaatcagtgcgctggaacaggcgggctatgcgatcattctgctgctctgcaccggtgaattcagcaggctccgtacccagcgtgcgctactgctggagccggatcgcctgattccaccgctcatctgcgccatggtgcagcagcagcgggtcggcattgtcgtgccggttgaggagcagattgttgagcaggcaggtaagtggcagcaactgcccgcgcagccctgctttgcggtcgccagtccctatcagggcgatcaggcaaccttcgccgatgctgcaaacagtctgaaagcgcagggcgcggcgctggtggtgctcgactgtatgggttatcaccagcagcatcggatagtgttacagcagcggctgggcgtaccggttctgctctctaatcagctggtggcgcgcctggcggcggagttgcttccctgagtgaagagatcacaaacggccatcatttcgcgtgacagatcagcgggttcccttctacactgccagacacacaacatgtgctctggagaactattatgctcaacgtaagtgagtattttgacggaaaagttaagtctatcggttttgacagtgcgagcaccggacgtgccagcgtgggcgtaatggctgaaggcgaatacacattcggtaccggccagccggaggagatgaccgtggtcagcggctcgcttaaggtattactgccaggtgaaaccgagtggaaatggtttgaagcgggttcggtgtttaacgtgccgggtcacagcgaatttcatctgcaggttggcgagccaagttcctatctctgccgttacctgaaagattaaaaaaaatggccgcttagcggtaatgctggtcagttaagattagatttgtaaaggctgtcacggtcaaacgtggcagcttttttgtcagggcgagcgtgccgcagtgcgggccagcgcacctctgctgctgccgggccgtcctcgcgccgctcacgcggttccttcggctttgacgttgtgccgacgaaccgttcggggatcggccctccctggccggccccgaactgtccacgcttcccggcgtggacttctggcccaccgtcacgcctcagcgctgcggatagccctttcagcagcagaggcgctcaggcctccactctcgtgccctttttaacagcacgcaccagaagcttaagagcagactggtggcgatcaggagcaggcaatccgcagcgctgaacagaatgagtctgccaggagagcccgcaggacgcgggcgaaaggcggggcggcacaggatgtgccatccccggcggtccgtcaggcaggcgaatgaagtgaaggaaccgcgaagcggcgcgaggaccgccagcccctgagcggcaccagactgcgttatcacctttcgcttaactgactgacattaccgcttagcggccctttttttggcgaatatcgtctgtcaggatgattctgccggtgactgattaacgctgggcttcgccgcccaacgcttctaccagattgctggtcagtgcggccagtttcgctggtcatcagaataaagtccgcatcaaagcgctgtgcaaaatcttcgcggtcaatatcgtcgttctggtcgcgcagcgtgtcgctgaacttcagacgcttcactgaaccatcatcggccagcacgaactgaatgcgctcctgccagtcgagcgccagtttggttaccagcttgcccgcttcgatgtggttggcgatctcatcgcacaccagatcctgtttcttgcagcggataacgccgccatcttccagcagcgctttcagctccgcttcatccatcagggcgaatccggcaggcagctcgcctgaacgtacccattctgtcagggtcagttcaatcgggctttccagcgtcagcggcaccaccggcagtgagcccaggcttttacgcagcagcgcaagggtatcttccgcttttttagcgctggcacagtcaacaataatcagattgttgaccgtatcgatccagaggtaggtctggctgaaacggctgaaggcgcgcggcagcaggctgtgcagcacttcatctttcagcgaatctttttcggtctttttgagcttgcggctctgctcagattccagcttgtcgattttcgcttccagcgcctgtttcaccaccggcgaaggcaggattttctcttctttgcgggcgcaaatcacaatctggcctttgttttcatgggtcagcgcatcgctgcggttgcccatcggcgagacccagccggtcttgctcatatcctgactgccacacggtgaaaacgtgaaggcgtcgagctgcttttccatctcatctgcggacagcggaatgtcacgattcagacgataaaccatcatatttttaaaccacaacatcgggattccttaccgtggcgcgatcgggcgcacaagtctgcgagagtcagcgcgcatgatagcgaaacatcggagtggtttcattgcctttccggcagacgccttttactgtatctctcacctgaacgaataacgaggacgtaatcttgcgcataggcatagatctgggtggcaccaagacagaagtgatcgcattgtcggataagggagaggagctgttccgccaccgggtgaataccccgcgtgatgactatcaggcaacggtgcaggcgattgtcgatctggtcacgctggcggagcagaaaaccggcgcaaccggcacggtcggcctcggtattcccggcacgctttcgccctacagtaagcgggtaaaaaatgccaactccacctggctcaacggtcagccgctggataaagatctggcgcaggcgctgaaccgggaagtgcgtatcgcgaacgacgccaactgcctggcggtgtcggaagcgatcgacggtgccggtgccggacagtcgctggtgtttgccgtgatcatcggcaccggatcgggcgccggtgtggcgatcaacggtgagtcgcgtatcgggggcaacggcaatgccggtgagtggggccacaatccgctgccgtggatggatgaggatgagctgcgctaccgtcaggaagtgccctgttattgcgggcagcagggctgtattgagacctttgtttcaggcaccggttttggtatcgactatcagcggctgagcggcgtacatcgcaaaggtgcggagatcgcctcgctgctggcgcagcaggatccgatcgccgaactggcgatgagccgctatgagttgcggctggcaaaatcgctggcgcaggtggtaaacctgatcgatcccgatgtgattgtactgggcggtgggatgagcaatgtggatcgtctctatcagaccgtgccggtgctgatgaagaagtgggtatttggcggggagtgtgaaacgccggtgctgaaggcgcagcatggcgactccagcggcgtacgcggtgcggcgtggctctggccgcttaacggctgagttacccgagcatccgctgacgattcagcgccagagagacccggcgctgaatcgttaacccacggcactcacccgcgccgcttttattcgccgaccagcatactgtcctgcggcgcccgatcgcgctgcgctttggtggcgaggaagtaaagatagcctgccagcatgatggcgaaaaacagcgcgccaatcaccggattaaaccacagcatcgccagcagacagactaccgacagcagcagggcgatgcccggaacaatcggatagcccggcgcgcggaaactgcggaccatctccggcgcgctgcggcgcagtttaaacagactcagcatactcatgatgtacatcactatcgcgccaaataccgccatggtgatcatcgccgccgtcagcgtcatcccctgcagattaatcacaccatcgctgtaaattgccgcgatacccagcacgccgccgagaataatcgcccgatgcggggtctggaaacgcgacagtttggccagagaaggcggcagatagcccgcgcgtgccagggcaaaaaactgccgcgaatagccgaggatgatgccgtggaagctggcaatcaggccaaacagtccaatccacaccagcatatgcatccagttagagtgttcgccgacaatcattttcatcgcctgcggcaacggatcgttaatgtcggcgagtttgcgccagtcgcccgcgccgcccgccatcagcatcacacctatcgccagcaccaccagcgtcagaatcccgctgatgtaggcgcggggaatggtccgggtcggatctttcgcctcttcggccgccatcgccgcgccttcaatggcaaggaaaaaccagatggcaaaaggaatggcggcgaaaatgccggagaaggcgggcagtccgaagctgtcactgcctgcccagccgtgcgcggcaaagttcgccaggctgaagccgggtgaaaccacacccataaacaccagcagttcaatcaccgccagcaccgtcacaaccagttcaaacatcgccgccagttttacgccgagaatattcagcgtcataaacaccaggtaagccccgaccgccgcagtcttcgggttcagttcgggatactgcacgttgagataagccccaatcgccatggcaatcgccggtggcgcaaagacaaactcaatcagcgtcgccagaccggcaatcagtccgccggtttcgccaaaggcgcggcgactataggcaaatggcccgcctgcatgggggatcgcggtggtcagttcggtgaagctaaaaataaagcaggtatagagcgtggcgatcaacgcggtggtgaccaggaatcctagggtgcccgccacagcccagccgtaactccagccaaaatattcgcctgaaataaccaggccaaccgcaatcccccacagatgcagggtgcccagagtgggcttgagtctgtttgtcattctgttatccccgtcgttgttggtctcacgcggcgttacaccgccattacgctacagtaaggggataatgccgttgcattactcgccacgacttgacgcgggcgcagtgacttctgtcctccacggtcaactcacgggcaacaaccgggccagctgcacgctgcggtcaactttgtctcttccggagtcaagcagctcaccttccggcaacgcatgctgagataacgcaagtgacaaggagccggactgatgagcgctaaacaatatgacaacctgactgattcccaactcaccctgatggcgcagcaggcgctggcctgttatcccgccgcgctgcagggccagctcagcctgctgtgccgctcagagaaacgccacgtttctgctgcaggcggcaggccggcgttatgcgctgcgactgcatcgcggcgattatcatcaaaaagccgacatcgtcagcgaactgctgtggctcaatgcgctgcgcgaaaccggcattatggtgccggaagcggtgccggacaaagagggcgaaaccgtgctgacgctgcggctgccggagggcggtgaacgctacgtggtgctgtttcactggatcgacggagagatgccgaccaccgacgtcgatcctcgcgcctttcagcagctcggccagatcaccgcgcggctgcatcagcacagtaaacagtggcagccgcctgcgggtttccagcgcatcatctgggatcaccacaccatgaccagcgcagagagtcactggggacgctggcaggatgcgccgaatctgaatcctgccgatcacggcgtgttagagctggcgataagccaggtcggcgcggcgatgacgcagttcggtaaaggatcggatcgctatggcctgatccacgccgatctgcggctgaccaatctgctgctgcacaagggcgaaacgcgggtgatcgatttcgatgactgcgggctaggctggtatctgcacgatctggcggcggcgatcagttttgttgagcatcatccgcgcgcgccagagtggatcgatcactggatccgcggctatgagcaggtggcgcatatcagcgatgcggagatggccatgctgcccgcgctgttaatccagcgtcgtatccagctcaccgcgtgggtgggatcacatgccgaaaccgaaatggcgcgcagcctgggatcggcgtgggccagccactcggtccgcctctgccgccgttatctggaaggtgagcagctgccggtcggcgtctgatgcaccagcggcgggcgccgctgcgccgccgcagtgccctgcgcgtaacctgcacgccgcccggacagcccgcaggcggcgcgtcgggcatcagggacctggtatggaaattgctcggataggagtaacgggtgatccacctgaattctgactgaggcgaccatgaatccgacactgataaagcccgatgcgtttgcggcctgctcggcagcggcgggggcaggcaatcacggcgtgctggcagcggcggcgaccggcttaggcgactttattcatacccagggcggcgatgttgatcgcatcttcggcatcagcggcatcgatccggagcgcctggccagtccgacgctcagcctggggctggttaactactgtcgggtgctggaagaggcggcgcgtcactccggttttgataacttcggtttgcactacggcaggcagtttaaaccgcagtcattaggcctgatcggctacatcggtttgtgctccgccacgctggaacaggcgctgcataatgtggtcaacgcatttccctggcatcagcacgacaccttaacccggctggtggataagggagagtgctggcggctggattatcaggtgcgacatggcgcgattctgtcgcgccgtcaggatgcggagctgacgctggggatgtttatgaatctgatccgccacgtggcgggcagacactgggcaccgcgcgaagtccactttgaacatccgcgtcccggccagtggcacgatcactgcaaagtgtttgatgcgccggtctggttcgatcagccgtttaattcactggtgatccccaagcgcgatctgctgcgcgccatgccggagagcgatccgatcctgttaatggtgatgcaggatgcgatccgacggcttaaccgtgtgacttcacagcagagcatgattgagcaggcgcgtttcgcaggttaatttatcgctgatgcagggtgagccggtactggaagaggtggcggataagctcggactgtcgagctggtcactgcagcggcggctgcgtgaagagggcagcagctttaccgcgctggtcgatcaggtgcgctgcgaaatggcgacacactatctgcagcagaagcagctgcccatctctgagatggcgctgctgctgggctactcggaagtcagtgcgttttcacgcgcctttcgtcgctggtttggcatcagtccgcgccagtggcgtcaggaaggtctggccagctaaccgcgcggcgcaaagccgaaccacgccggttgtccaggctccggcggcggcggcagatcacgggtctgcgccaccagctgccaggcgcgcaggcagagcgcttcatccccctgcgtctgggtcaccgcataacgtctgctgtattcctgccattccatccgtaccagacattgctgtccggcgtaacgcgccgcatcgctgaactgccggttcagtactggctgcatttgataagtccagtgacaggattggctgtcaggatatttcgacggctgacagaggtttgccacgctatcccgttgctttgccacaggttgctgacaggcgctgagcgacattgcaataatcacccccggcaacattctcatcgttatattaattaaattcatttaactggccaactttcctttaagatcttccggtctgctgccgacagtctacagaccggcatcatgaatgctatggcattactccgactgtcgacagaaccagaatttaccgccatggcgcgggttatccctgcggcagttccagctggctgtaacccagcccattcatcttgcgtactttaatctgtaccggaatgcgctccttcatcgcttccacatggctgatcaccccaatggttttgccgctggcgttgagtgcatcgagtgcgtccagcgcggtgtcgagcgtctgcgcatccagcgtgccaaatccctcatccagaaacagcgattcgatgcgcgttttgtggctgaccagatccgacaacgccagcgccagcgccagactcaccaggaagctctcaccacccgacagcgtgcgggtatcgcgcgccgcatcggcttgccaggtatcgaccacatccagctccagcagatcctgcgcccgtcgctgcagcagatagcggccatgcagccgatcgagctgacggttagccagggccaccaggtgatccagcgttaagccctgggcgaagcgccggaatttatcgccgctggcggagccaatcagatcgttgagcaggctccactgcgccagcgtcacaccatcctgttcaatctgcgtcatcaggctttgctggcgcacacgaaggctggcatcgctgtgcagctgctgctgaatctgaccctgctggctggcgttgtcgcgcagtgccagccgtaactgctccagctgttgcgccagcgcctcggcggattccggcatcgcagcgggtttcgcctgctgatggagactgagccgttggcgcagatccgccagtcgcgcctgctgctgctggcattgctgatcgagctgctgcaactgctgacgcagttgcactgcggtctgctcatccagcagcgccgcgcgcaggctggcttcatccgcaaatccggcgctctccagtgcctgctgcagcgcgctttccgcctctgccagtttgctattgagcgtctgccgctgattttccagccccgaaagctcaccctgcaggcgactgacctcggcctgcgcctgttgcagggcagtgagttgctgtgccagttgttcatcagcctgctgaacgcgggcctgtatctgctgacgggcgtgggtgacctcgcggtcgccaaacagcgcgagacgctgctggcgcatctcgctgagctgcgtctggcgctggttttgctgctgctgacgagtggtgagctgctgctgctccagttttctgcctgctgttgcagggcagtgagctgggtttccccctttaacagctgcggttgcaggtttgctagcaaccgctcactttcctgccagcgctcccagcgccgctgctgttctgtcagccacgcatcgcgatgggcggcgtcgggcagggcaaggttgtgtgcactgaactgctgctccagacgactctgcaattgcgccatggcctgctgttcctgctgctgacgctgttgcagcgcatccagcgcctgttgcaggctggacagcgactgctgcgccagctgttctgcctgcaaatgctgctgccaggcctgtgactgctgaagatagtaatcttttgcggcctgacgcgcctgttctgcggcttcctgcgcctgtcgctgttgctcaagctggctttcacgctcgctttgctgctgctcccacgcggttaaggcatcccgatcggcgagcgggaaggtaagtgccagctcactgctcagcgcctgccattgctgctcaagccgatcgagctgttgctgcatctccgcgatttcatcgcgcagggtctgctgctgcacggctgactgtttcagctgttcgctttttgccgtgcccgcttcgcgcaatgcctcggtttgttgttgcagtgcagcccggcgctgctggttagcacttacttccagcgtgctgtaggcctcaacggcgggatgcgtgcaggagccgcacagcggacagggctgatcagcggcgagccgggcgcggtaatcgctgagatcaacaatctgctgctccagcgcgcagattttttcgacatcatccagttgctgttttccgcgtttccacgtctcgcgcagggcctggagttccgcttcactttgctgatgcgcttttgcgagcgcgataagccgctgctggcgctggtccagctgctggtgcagcggctgccactgggttgaaagcagcagcagttgctgacgagccggacggctgttctgcaactggcttaatgcctgacgcagtgcggcaggcggatgctgttcctgtagcgaagttagtacttgctccgcctgcgagagcgcctggcgggcctgttgctccgcctgctggcgcggaagcgcctgttctgcctgctgctgctgttccgcctgctgggtagcgatctgtcgctgctgctgctcgcgctgttgcgccagtccggccagggtcgcttcacgctgcgccagcagggcaaagttctcctgccacaccggcagcgaagcgccccattgggcgagatcggcaagctgctggcgtaactgatgctgttcggcaatcgcctgctgccatgtctcaacctggcgcttctgctctgccaggctggcctgtgtctgatcagcatgctgctgctgtcgggcattttcctgctgctgctccgcaagctgctgctgcagtgcgctgatccgctgatccagcggcagaacctgttctgtcagcagactttcctgctgctgctgttcctgcagcgcctgctggcgggcactctgggtcgtcgcgtagtgctgttgatgctgctgctgttggctctgcgcctgctgctgcgccgacgtgagttgctgacagcggctcacgacctgctgctgtttcggtgcgtaacgcgtcgcgctgctgcagttttacccgcagcttttcagccggttcgctgcgtgcaagacgctgacgatcggcctctgccgcctgggatgcagcctgggcctgctgcagcgcgacgtcagcctgcgcatcttcctgctgtaactgctgcgcctgctgttgccactgctgctgttgctgcgcctgctgatagtgcgcgctgagctgctgttccgcatcggtcagatcggtgagctgctgttgcagcgcggcgcgtgcgtcgctatccagcagcgccatcgctcccgcctggctgcgcagcagatccagctgggtttttgcctctttgtggcgctcgtagatggcggcggaaatcagaccgtaaatttcggtgccggtcagctcctcaagcagttccgcgcgctcactggctttggcattgagaaaggcggcgaactggccttgtgacagcatcatcgagcgggtaaacctttcgaaatcgagcccggagagggtttcgatcagcttcagcttgtcaccgactttatcggcaacaatagtgttgtcagcgcagcgtgccagctcaacgcgcggcgcctgaagtttgccgtcagcagtgccgcgcgcgcggttctggctccagaaggcgcgccaggcttctcctttgatctcaaactccacctcggccagacattcggcacagtcgcgggtcatcagcgcattctggctctgtgaaatcgcgcccaggcgcggtgtctggtgatagagcgccaggcagatggcgtccagcagggtggttttaccggcgccggtggcaccggtaatggcgaacaggccgttgctggcgaaaggttcggcgcggaagtcgatgaaccattcaccgcgcagggcattgaggtttttgaaccgtagcgtgaggatcttcattgggtctcttccatggcggccagcgtctggcggaacagggtggtcatctcggcgatttgcgccggttgcagctcctcatccagcgccagccggcgggcaaagacctcctccaccttcagctcactcagggtttcgttgtcgagccgcgccaggctctgttgccgctgttcacggctgcggcggagcaacaggacttcgaccggcagcgtggcggtcagggtttctacctgacgctgcagatcgctgaggtactcctgggtggtgacttcgatgtcgagccaggtcggcttctcctgctctgccgtgctgaaggcatttaactgctctgcaatctgcgccagcgatcctttcagcacctgcatcggctgcgcctgtggcaccaacagcggcgtgaccgattgcaggccgctggtggtgagttccagcaggaagacgcttttttctgtgcccagctcgtcaaagctcagcggaatcggtgagccgctgtagcggatatgctcgctgcccgcgacgcgctgagcgcgatgaatatgccccagtgcgatatagtcagccgcgggaaacgcgctggccggaaaggcatccagcgtgccgatatagatgtcgcgcactgaatcgctctggctgacgccgacggtggtgagatggccggtggcgataatcggcagtgcatggcccagcgcctgggcggcggcgaatcgctgctgatagtggtgggcgatcgcttccagcagcgaggtctgcttgtcgcgtcccgactgacccgcccggctgcgcaggatatcgcgcggccgcagatagggaatcgcacacagcagcgcgcccggctcgccctggcgggtgttgagcagcagcacatcatccttctcctgcggggtggcgatcacccgggtattgaggcaggcgagcagctcacgcgactcattcagcgtggcaacggaatcgtggttgcccgctagcacaatcaactgacagccgctgggctgcagcgccaccacaaagcggttgaacatttcgcgggcgtagctgggcggtgtaccggtatcaaacagatcgcctgcgatgatcaacgcatccacctgatgctgttcaatctggatcaacagccagtcgagaaatgcctgatgttcggctgcccgacttttgttgtagaagaactgccccagatgccagtccgcagtatgaatgatgcgcatgatgagtccctgccgttgtgattcgcccggcgattatactggctctgcggccaaagcaaaaaattgtcgctgcgctgtcataaatgattaccagtgaggttacaggcaggttatgtttttcataaaagtgtcacaaatctgacgcataatggcgccgcgaatctcagtgacatccgtcataatcagcaggagtaataatggctaagcgcattttggttgtggaggatgaagcccccatccgtgaaatgttgtgttttgttctggagcagaacgactatcagccaatcgaggcggaagattatgacagcgccgttggcaagctgattgaaccctggcccgatctgattttgctggactggatgttacccggtggcagcggtattcagtttatcaaacatctgaaacgcgaggcgatgacacgcgatatcccggtgatgatgctcaccgcgcgcggcgaagaggaggatcgggtgcgcggcctggaagtgggtgccgatgattacattaccaagcccttttcacctaaagagctgatggcgaggatcaaagcggtgatgcgccgtatttcgccgatggccgtggaagaggtgattgagatgcaggggctgagtctggatccctcctcacatcgcgtgatgtccgaaaccacgccgctggagatgggtcccaccgaatataagctgctgcacttctttatgacccacccggaacgcgtttacagccgcgaacagctgctgaaccacgtctggggcaccaatgtgtatgtggaagatcgtactgtcgatgttcacatccgccgtttacgtaaagcgctggaagtgtccggccacgatcgcatggtacaaaccgttcgcggaacagggtatcgtttctctgcccgctactaaacggagcctttaccgtgctggaacgcctctcctggaagagattactgacagaactgctgctggtctgtctgcccgcagtgctgctgggcctgctgttcggcggtctgccctggtggctgctgctgagcgtgctgacggtgctgttgtggcattttcacaatctgatgcggctgtcgcactggctgtggctggaccgcaccatgacgccaccggccgggcgtgccagctgggaaccgctgttttatggtctttaccagatgcagctccgcaaccggcggcggcggcgtgaactgggcaatctgattaagcgtttccgcagcggtgccgagtcgttgccggatgcggtgatcctgaccaccgaagagggcaccattttctggtgtaacggcctcgcacaacagcacctgggtctgcgctggccggaagataatggccagaacatcctcaacctgctccgttatccggagttctcgcgctatcttcgccagcgcgatttcgacaagccgctgacgctggtgctgaacaacaaacttcacatggagttccgcgtcatgccctacagcgaagggcagtggctgctggtggcacgtgatgtcacgcagatgcatcagctggaaggggcgcgccgcaacttctttgccaacgtcagccatgaattgcgcacaccgctcacggtactgcagggctatctggagatgatgaacgactcggtgatgagcgagccttcgcgcagcaaagcgctgcacaccatgtcggagcagacgcgccgcatggacagcctggtcaaacagctgctgacgctgtcgcgcattgaagccgcgcccgcgatcgatctgaaagagaaggtcgatgtgccggtgatgctgaaactgctgcagcatgaggcggcaacgctgagtggcggccgtcacgacatccacttccataccgatccccatctgaaagtgttcggcaacgatgaacagctgcgcagcgccatctccaatctggtttacaacgcggtaaaccacacaccggatggcacgcgaattgatatcagctggctgcgcggcaaacagggggccattttccgggtgtgcgataacgggccgggcatcgcctcagaacatattccgcgtcttaccgagcgtttctaccgggtcgataaagcgcgttcgcgtgcgaccggcggcagcgggctggggctggcgatagtgaaacatgctctgagccaccataacgcgcggctcgatatcaccagcgtgccgcacaaggagacctgttttacctttacgctgccagcgaggttgattgtcagcagcgtgatgcaggagaatgccgttcattaatcgctgccggatctccctgatgcgcatccttcttttgttgatcgttactctgctgccgggcctggcactggcccagcccggcgcgctctccggcaatctcagcagcgtcggatccgatacgctgggctatctgatgacgctgtggggcgaagatttcagtcgccaggcgccgggcgtcaatgtccaggttcaggcctccggctcttctactgcgccgaccgcgctggcggcaggggcagcacaactcggtccgatgagccgcccgatgcaggcagatgaacgccaggcctttgaggcgcgctacggctatccgccgctggcggttccggtggctatggatgcgctggtggtagtggtgaatcagcgcaatccgctgcagcagattgaaccgcgtcagctcgatgccatcttctcgattacccgtctgtgtggcgcacacagcgtgccgctgcgctggggcgatctcggcttaaccggcgcgcagtggagcaaacggccgattcagcgctatggacgtaactccgcctccggcacctggggtttcttcaagcagcaggcactgtgcaaaggtgattttcgcagcgacgtggcggagtttcccggttcggccgcagtggtgcaggcggtggccggtaattcacgcagcatcggctacgccagttttggctttcatctcagcggcgtaaaaatgctggcggtgatgaatgatcaggggcaggcgattaccccggatgccgatgccatccgcagtggccgttatccctgggcgcgcccgctctatctctatgtgaataaagcgcccggcaaacctttgccgccgctggtggccgcgtttctgcagcaggtactttcggcacagggacagcggcgggtcagcgaagcgggctatctgccgctctctgatagtcagatgatgcaggcgcgcgccgcgctgcgttaatcccccgaacgtgaatttttttcaacatcactgaattttcttcagttgcagaagaaagccgctcatgacactctgtgttcagacatgtagccatccagatggctatttatatcaggatgcaactatttcctgccgtcattaccggcaggagagacaggagtgatcatgcaaagagaaaccgccccgttccgtgccgataccgttggcagctttctgcgtcccaccgccattaagcaggcgcgcgaacagtttgcagccggagagattgatgcggcggccctgcgtcaggttgaagatgaggcgattcgcgatgtggtggcgaaacagcgggaaaatggcctgaaagtggtcactgatggcgagtttcgtcgcggctggtggcacttcgactttttctatggcctgaatggcgtagagcgctatgaagcggagcagggcatccagtttaatggcgtgcagaccaaagcgcatggcgtgaaagtggtgagcaaactcggtttcccggcggatcatccgatgctggcgcatttccgcttcctgcagagtattgccggtgatgcggtgccgaagatgaccattcccagccccagcgtgctgcacttccgtggtggccgtaaggtgatcgacgcggaagtctatcccgatctggcagactacttcgacgatctggcgcagacctacaaagcggctattcaggcgttttatgacgcgggctgccgctatctgcaactggatgataccgtctgggcttacctctgtttctgaagatcagaagcgtgatatccgtgcgcgtggcgacgatcctgaccagctggcacagacttatgctcaggtgttgaataaagcgctggaaggtaaacctgccgatctgaccgtgggtctgcatgtctgtcgcggcaacttccgctcaacctggatctctgaaggcggctatgggccggtcgcagaaatcctgttcggcagcgtcaacgtggatgccttcttcctggagtatgacaacgcccgttccggcggttttgaaccactgcgttacattaagccaggtcatcagcaggtggtgctgggtctgattacgaccaaagtgggagaactggaggatccggcgcaggtgaaaaaccggctggaagaggcggcgcagtatgtcagcctggatcaaatctgcctcagtccgcagtgtggttttgcctcaaccgaagagggcaacagcctgaccgaagcgcagcagtggcagaagattcgcttagtggtcgatatcgcgaatcaggtctggtagtgctgtaacgttgtgcagacaggcgcgtaaaacgcgccttttgtgtatcttcaggcccgtttatgcggggatttctcgcgctctgtctattatttaggcacatcatcttgtgtgcctgctgcaaaaattaacgctatccactgccttttgaaaaaatggcggcataaccttctggttttccgatcccgtattgcctttcaccgctataaacgttttacttagcgccgttgtcgatccatccctctgtgaacagaataaaagcagcttaaatcacctgcgctttaccctgcgacgagcataatgcgctgacattgtcagcctggtcgtggtttacacgcagcgaggggacaacactaacccaacttccaccgcaacatcagtgacaggccgtatgacacatcgtttaacttcgaaggacattctcgcgctgggctttatgacattcgccctgtttgttggcgcgggcaacatcattttcccgcccatggtcggtattcagtctggcgaacacgtctggactgccgcgattggttttctgattaccgcagtcggtctgcccgtgatgaccgtgatcgcgctggcccgcgtcggcggcggtgtggatgcgctcagcaccccgattggcaaggtcgctggcatcgtgctggccaccgtttgctatctggctgtcgggccgctgtttgccacaccgcgtacggcaacggtctcgtttgagatgggtattgccccgctgaccggtgatggcgcgctgccgctgtttatctatagcctgatttacttcacgctggtgattggcgtatcgctctatcccggcaagctactcgacacggtagggcacttccttgcgccattaaaaattattgcgctgaccgtgctgggtgttgctgccctggtgtggcctgctggcggcacggttccggctaccgctgattatcagcgtgcggccttctccagcggtttcgtcaatggctatctgaccatggatacgctgggcgcgctggtatttggtatcgtgattgtcaacgccgcccgttcgcgtggcgtcgataatgccgcgctgctgacccgttacaccgtgctggcggggttaatcgccggtctgggcctgacgctggtctacctctgcctgtttaagctgggcgcgggcagcggtgcgctggtggatcaaaacgctaacggcgcagcgattctgcacgcgtatgttcagcacacctttggcaacatgggcagcttcttccttgccgcgctgatcttcgtcgcctgtatggtgaccgccgtaggcctgacctgtgcctgtgcggaattttttgcgcaatacctgccgttatcgtataaaacgctggtgtttattctgggtctgttctccatggtggtgtcgaatctcggcctgagccacctgattcagatctccatcccggtactgacggcgatttatccgccctgtatcgtgctggtggtgctgagtttcaccctcaactggtggaataagagcagccggattatcgcgccagccatgttaatcagcttgctgttcggtattgttgatgcgattaaaaccaccgggtttaaagatttgctgcccgctttcagtcagcatctgccgctggccgatcagggtctcgcctggttgccgccgtcgctggtgatgctgctgattgccgctgttgttgatcgggtgaaagggccggaacaggtgaccgttcactcgtagcagagagcactgatttttctttaaccacgggcctgcccgtggttttttcatttcacaggtacaggttgttatgcaagaaaccaacaagctcaaacgcggactgagcacgcgccacatccgctttatggcgctgggatcggcgattggcaccgggctattctacggttccgctgacgcgataaaaatggccggaccgagcgtgctgctcgcctatatcatcggcggggcagtggcttacatcatcatgcgcgcactgggtgagatgtccgttaacaatcctcaggccagctccttctcacgttacgcgcaggactatcttgggccgatggcaggctacatcaccggctggacgtactgttttgaaatcctgatcgtggcgattgcggatgtcaccgcgttcggcatctatatgggcgtctggttccctgaggtgccgcactggatttgggtgctgagcgtggtgctgatcatcggtgccgtcaatctgatgagcgtgaaggtgttcggcgaagtggagttctggttctccttcttcaaagtcgccaccattatcgtgatgattctggccggtttcggcatgatcatctgggggctcggcaatggcggccagccgaccggcatccacaatctctggactaatggcggcttctttgcgcacggcgttgtcggtatgctgctgtcgctgcagatggtgatgtttgcctatggcggtatcgaaatcatcggtatcaccgccggtgaagcgaaagatccggagaagtcgattccgcgcgccatcaactcggtgccgtggcgcattctggtgttctacgtcggcacgctgtttgtgattatgtcgatctacccgtggaatcaggtaggaacttcgggcagcccgtttgtgctgaccttccagcatctgggcattgcggcggccgcctctatcctcaattttgtggtgctgaccgcgtcactctcggcgattaacagcgatgtgtttggcgtaggccgcatgctgcacgggatggcgcagcagggacatgcgccgaaggtctttatgaaggtctcttcgcgcgggattccgtgggtgacggtggtggtgatgatgttcgccatgctgattgcggtttatctcaactacctgatgccggaaaaagtcttcctggtgatcgcctcgctggcgacctttgcaacggtgtgggtctggatcatgattctgctgtcgcagatcgcgttccgtcgcaaaattggcaaagaggctgccagtaagctgcagtttgcgctgccaggcggcagctggactgctggcgtcggcgtagccttcctctgctttattatcggtctgattggttatttccccgatacccgcatttccctctatgtcggtatggtgtggatagtggtgctgctgctgggctataagctggttcgtaaaccccgctaatctcctgttctgctctctcattcgtgggggagcagaacacgctatttcccgcgcttttatattcctgctcatctgattatttatgtgacccaatccacaatattcaatcctgttatcaggagcaaaacgcctgcctgcgaaataagtttatgtcccggtttatatccataaatgcgtattttaattggcagtgaatgtggcggatagtgataaccgggcagaaagcgataagggagattcagaggagtgagcgtgcagtcacacaggcgctggcgggcagcagtagcggggcgtgtaagaaataaaaaacggcgaaaccagtcgccgaaatactcaagaattacaggaaaatagttaataaagggatgattgacgggtctatcgtaaaacaaaacgagtggcgctgatagtcaggcgatttaaataagaaaaggtcggaatggcgttaattaacagcggttaacattattcaggccgcgttgatgctgcggcctgaatttgattagccacagactcagggcaatataaccgaaaccggcagcacagcgctgttatccagcttttttcgtagctgagtcagcgtgaattgataagggcagagcaggccgacatcggtgattctgcagtcatgctgatgccactcctgacgtaataacggatgtttatcatcaatcggttgcagctgacgaatcccatccagactctgcgcctggaaatagagccgcaaaaaacgttcgccgctgtgggtgtcgcgccagcgctccagcaccagactactgcccggtggaatgttgccgcgtgaatagcctggcaactgccagctaaagcccatcagggtgcgcaccatcgcaatattggtgtcatgtgccaccagaatcagccagcggcccggcgcgctatcggaagcaatcgcctccagcagggcgttgagcaatattgagccacggcgctgtgcctgatagagcacgtcgttgctgagatcgtagtttgcggtcagcagcggcagcagcgtggtgatctgcgcggccgaggtgatgtgtccccaggcgagctggtccaacggcaggttttcgctgtagcccagtcgcagcgtctccaccatgcttgccatcacactcagcccgtaaacgtatgtgttgccgttacgggtttgccggaacgaccagggcgcatcaaagagggggcagtcagtcgcgggcgggcagacggcggctttcagctgctgaatagcgggttgcaactgctgttgcagccgcgccagatcgcccgctttctgctgcttagccgccagctcctgagcaggatcgctctgggtgatcgtcagcttttcactctgaaacaggggatcgacttcgcccgctacgtgatgcaccggcacgccgcagccgggaaaggccccgtcagtcagcgctgcggccgtggcacgggtgcgctgcagcggactggcgcgcacgtagacctgtgctgcatcaggacagcccgcgcccagcaggccgagatggcgatagtgctcgccttgccagcgtcctttattgaccaccgcgctgtagccatgaccggtcagctcaccatcggcgctggtccactgcgtccagggttgctggctggcggcttcaatctctttgcgattgccgggggtgggcggacggacaccgtgacggctcagttcgaccaccttctccagctggtaatccgccgcctgtgacgccggacttaacagccagagagaacagaggatcagcgcgcagcggtacaggcctggcagcgtcatttactcctccagcgcgcgattaccggtcagcgctttgatttttggataaagagtcgcattggccagcaacaccgggttgccgttttttagcccctcgttgcgcagataatcattagtgacgccgcccgcttcgcgcatcaggacgatgcccggcagactatcccagggatgcatatgcgcttcatagtagccaatcagtcgcccggcggccgcccaggcgctggtcagcgcgccagaaccgatgcgaataaacatgccaccctgttcagttaagccgctaatcaggcgcgagacgctttcggcaggggtgcgactggagttgctgatgccgagcaaaccctcgttgagatgcgtcgcgctatgaacctgcaaacggctctcattaacccacgcaccctgacctgctcgtgcgtgaaacagctcctgatgattgggatcgcagaccacgccgattaccggttcgccgtcacagaccaccgccagcgagacgcaccagttaggcaggccgttgacgaagcaggcggtgccgtcgatgggatcgaccacccagataaagggcgcgccctgaacctcaccaccgctctcttcgccatagacagcatcgtcaggaaagcgctcagcgattaatgtcttaatcaatgcctcaacgttacgatcagcctcgctgaccacgtcctgcaaatcccttttgtgttccaccaccagtgtctgacgctgctgataccacgaataagcccggctggccgccgcacgggcgatgtcgcaggcgtaacggtaacgcgcgtcaatttcagaatgcgaagcggatgacatcttttcctcttatgtcttttggtcaaaacgaacggaaggcacgcctgaacaggcggtctggctgtgatatttacttaactattgttaagaaaggcttcattaagccgcagataggcagcaatggcaagatggtgcagggccgggtgaggcgctttcccggcgggcgaaagctggcgtccgccagcccggcagcagaggatcgggttttacagggttctgctggtcgccagcgccattaaacgcggataaaaaacaaaaaacagcgcttccagctgatcatagtgttgcgtgaaatcgtggtaggagtcgcgcagggctgccaggcgtggacggcggctggccatgccgtgcagcacccgctccagccgcgcgggctgggcataatgctcaaaccagcgctcgcgccacatcaccgcgttgagttcctgaaactcgatgggggtgtctgccagttgcggcatgatctcgcgctcggcggcggcagaaaagtgcaccagcgtctggccgggcgtgaagtgctgccagtgccgggccagaaaatggtcccagatgacgtccagcgtaatgggtgccacgcgataggtttcggcacggaacagctgacgggcgctgcgcacttccggcagcgcatcggtcatcacatcgagacgacggtgcatcagaatgccgtccgcgacgggcgcagaccagtgctggtgcgggttgccacgcacaaaatcggccattaaattgccgagtaaggagctgtcggccagcttagccagatggagatgagcaagaaagttcatgccgcattataggctgaactgcctttgcgcagccagttgttcagaattggtcgattttccgctaaactgtgccgcctgtttttgcctgagaaagaactctttcatgcgtgtcgccgattttgcttttgaactgcccgaatccctgattgctcactatccccaggcgcagcgcagcggctgtcgtctgctgtcgcttgatggtcccagcggagcgctgtcgcacggtgtgttcaccgacgtgctggataagctgaatccgggcgatctgctggtgttcaacaacacccgtgtgattccggcgcgcgtctttggccgcaaagccagtggcggcaaaatcgagatgctggtggagcggatgcttgacgacaagcgtgtgctggcccatgtgcgcgcctcgaaagcgccgaagccgggagcagaactgctgctgggcgaagacgagagcgtcaaagcgacgatggtggcgcgtcacgatgcgctgtttgagattgtgtttgatgatgagcgcgcggtgctcgacatcctcaacagcgtcggccatatgcctctgccgccttatatcgaccgtccggatgaagaggcggatcgcgagctctatcagacggtttacagtgcccgaccgggtgccgttgcggcaccgaccgccggtctgcattttgatgaaccgctgctgcaggcgctgaaagagaagggcattgagatggcgtttgtgacgctgcatgtcggtgcaggaaccttccagccggtgcgcgtcgacaccatcgaagagcatcacatgcatgctgaatatgccgaagtgccgcaggaggttgttgatgcggtgctggcctgtaaagcacgcggcaataaagtagtcgctgtcggcaccacctctgtccgtttcgctggagagcgccgccaaagcgagtcaggatgccctgattgcgccgttcttcgacgatacccagatttttatctatccgggctatgagtatcaggtgatcgatgcgctgatcaccaacttccatctgcccgaatcgactctgattatgctggtctcggcgtttgccggttatcagcacaccatggccgcgtaccgcgcagccgtggctgagcaatatcgtttcttcagttatggcgacgcgatgtttatcagcaaaaatccgcaggcgccgctggaaaaagtgggcgactgatttattaaccgatagccggaatcgactgagagcgactgaaggttatctgcatcggactgtttctccgatggaggctttgtgaaatttgaacttgataccacagacgggcgcgcacgccgtggccgtctgatttttgatcgcggtgtggtggaaacccctgcgtttatgcctgttggcacctatggcaccgttaaaggcatgacgccggaagaagtgcaggagaccggcgcgcagatcattctgggcaataccttccacctctggctgcgtccgggccaggagatcatgaaactgcatggcgatctgcatgactttatgcagtggaaagggccgatcctgaccgactccggcggcttccaggtcttcagcctgggcgacatccgtaaaatcaccgaagcgggcgtgcatttccgtaacccgatcaacggcgacccgatcttcctcgatccggaaaaatcgatggagattcagtatgacctcggttctgacatcgtgatgattttcgatgaatgtacgccctatccggcggactgggactacgccaaacgctctatggagatgtcgctgcgctgggcgcaacgcagtcgtgaccgttttgacagcctgggcaataaaaatgcgctatttggcattattcagggctcggtttacgaagatttacgagatgtctcggtgaaaggtctggtagagattggctttgatgggtacgctgtgggcggcctggcggtgggtgagcctaagcaggacatgcaccgtattcttgagcacgtctgtccgcagcttccgcaggataaaccgcgttatctgatgggtgtcggcaagccagaagatctggttgagggcgtccgtcgcggcgtcgatatgtttgactgcgtgatgccgacccgtaatgcccgaaatggtcatctgtttgtgactgagggtgtggtgaaaatccgcaacgccagatacaaagatgacactgcgccactggatgcggagtgtgattgttacacctgtcgcaattatagtcgtgcctacttgtatcatctcgaccgttgtaacgaaatactgggcgcgcgtctgaacactatccacaatttgcgctattaccagcgcctgatggcaggtttacgccaggccatcgaagagggtaaattagagcgctttgtaaacgagttctaccaacggacgggcaaagaagttccgcctttaacgtctgataattcatcaatgagggaaatttaatgagctttttcatttctgacgccgtggccgcagcaggcgcaccgtctcagggaagtccgtattctctggtgatcatgctggtggtgtttggtctgattttctatttcatgatcctgcgtccgcagcagaaacgtgcgaaagagcacaagaagctgatggattctatctctaagggtgatgaagtgctgaccagcggcggccttgtaggccgcgtaacaaaagtctctgacacgggctacgtagctatcgcgctgaatgacaccaatgaagtcgtcattaaacgtgatttcgtcgccgccgtgctgcctaaaggcactatcaaggcgctgtaattctttcttccctaagggaactgccgtgttaaatcgttatcctttgtggaagtacgtgatgctggtcgtcgtgattctcgtcggcctgctctatgcgcttcccaacctgtatggtgaggatccggccgttcaaatcactggtgcgcgcggaagcgccgccagtgagcagacgttggatcaaattcagtccgcattaaaacaagacaatatccagagcaaatctgttgcgctggaaaatggtgcgattaccgcgcgcttcaataatacggatgtgcagttacgcgcccgtgaagcgatcatgaaagcgttgggtgaaaactacgttgttgcgctgaacctcgcgccagccacgcctcgctggctgtcgatgctgtcagcagaaaccgatgaaactcggtctcgatctgcgtggtggtgtgcacttcctgatggaagtggacatggacaccgcactcggcaaactgcaggagcagaatgctgactcgctgcgtagcgacctgcgcaccaaaagtatcccttacaccaccgtcaacaaaatcgcgaactacggcgtggaaattcgtttccgtgacgcagccagccgcgatgcggcgatctcctggctgacctcgcgtcatcaggatctggtgatcaacagcagcggcagcgatgccctgcgtgccaccatgagcgatgctcgtctcagcgaagcgcgtgaatatgcggttcagcagaacattactattctgcgtaaccgtgtgaaccagctgggcgtggccgaaccgctggtacagcgtcagggttccgatcgcatcgtagttgagttgccgggtattcaggatacggcacgcgctaaagagattctgggtgcaacggcgacgctggaattccgtctggtaaacaccagcgtggatccaaccgtagcggccagtggtcgtgtaccgggtgactctgaagttaaagacatgcgtgatggccagccggtggtgctctacaagcgggtgatcctgaccggtgaccatatcaccgactcgacttccagcatggatgagtacaaccagccacaggtgaacatttcactggatggcgcaggcggtaacatcatgtcgaacttcaccaaggacaacatcggcaagccgatggcgaccctgtttgtggagtacaaagacagcggtaagaaagatgccaatggccgttcaattctggtgaaacaggaagaggtgattaacgtcgccaacatccagtctcgtctggggaacagcttccgcatcaccggtatcaacaacccgaacgaagcgcgtcagctctcgctgctgctgcgtgccggtgcgttgattgcgcccatccagattgtggaagagcgtactatcgggccgaccatgggtcagcagaacattactcagggtctggaagcctgcctgtggggtctgcttgcgtcgatcctgtttatggtggtgttctacaagaagtttggtctgattgcgaccagcgcgctgctggttaacctggtgctgattgtcggcattatgtcgctgttgccgggcgcgaccctgaccatgccgggtattgccggtatcgtgttaacactggcggtggcggtggatgccaacgtgctgattaacgaacgtattaaagaagagctgcgtaacgggcgctcggttcagcaggcaattcatgagggctataaaggcgccttctccagtattgtcgatgcgaacgtgaccaccctgatcaaagttatcattctttatgcagtcggcaccggttcgatcaaaggctttgctattaccaccgcaattggtatcgcaacctcaatgttcaccgcgattgtcggtacccgtgccattgttaacctggtttacggtggcaaacgcatcaacaagctgtctatctgaggagtgcgttgtggcacaggaatataacattgagcagttgaaccacgggcgtaaagtcgtcgactttatgcgctgggataagctggccttcatcatttcgggactgctgattctcgccgcgattgctatcgtgggtgtgcgtggttttaactggggcctcgatttcaccggtggtacggtgattgagatcgcgctggaaaaaccggccgatcttgaagtcctgcgtggtgatctggtgaaagcgggctttgacgagccgctggtgcagaactttggcagcagccgtgacgtcatggtgcgtatggcaccggttaccggcccggcgggcaccgagttaggcaataaagtggtgtcggtcattaaccagaccacccagcagaatgctaccgttaagcgcattgagttcgtgggtccgagtgtgggcagcgacctggcgcaggcgggtgcgatggcgctgttgtccgcgctgattgcgattctgatctacatcggttttcgctttgagtggcgtctggcgctgggtaccgtgctggcgctggcgcatgacgtgatcatcacctgcggcctgctggcgctgttccgcattgaaatcgacctgacgattgttgcctcactgatgtcggtgattggctactcgcttaacgataaaatcgtggtgtcggaccgtattcgtgaaaacttccgcaagatccgtcgcggcagctcttacgatattactaacgtgtcactgacccagacgttaagccgtacgctgattacctcgctgaccacgctggcgatgatcctcatcctcttcgtgtttggtggtgcgctgctgaaaggcttctcactgaccatgctgattggtgtgacgattggtacgatttcatcaatttatgtctcttcggcgctggcgctgaagctgggcatgaagcgtgaacatatgctggtgcagaaagtcgagaaagagggcgccgatcagccttctatcctgccttaatcgccgcagagaaataaaaacgggcagccatgtggctgcccgttttttttttgcacctgtgatcagatcagggtgcagcaggggaggtctgggcaggtgcgtcgccggtgacgttatgcacgcggacataacctgattgatccggcgtgaggccgctgagtcgcagcggtatgctcaccgcatgctggggcaacagcgaggcaggcaccgctattgtctgactcagactgccgttactcagtggtttaccggttgccggatcgagttcgccccagttcaccgtagcgtgcagggcgggcaaagggcgatcgtccattgagcgtaccgtcagggttgcccgcgagccgctggcttcagcggtgacaggcgagagcgccagtcgcagcgtgccgagctgggtttgcagtgccaccggcgtgttcgcctgcgggatcagccacgcgccttgctgcgaatggctgtttaactgcccctgaatctccagcgcgctggcctgcgtggtcaggtgctgcatctgctgattaagctgactcacttcctgatgcaactctctgacctgcgggttgctggcgctactgctgcaaccgctcagcatcaccagagagagcgccaccggaacccaaaccatcctgctcataagttatccttgtccgttattttggaatacgtaaaacctggccaggatagatcttatcaggatgagagagcattggcttattcgcttcgaaaatcttgttgtattcgttggcatttccataaacctgtttggaaattgcgctcagcgtgtcgccttttttcacggtgtaaagttctgactcggccgcgctgtctgtcacggtcaccttatcttccactttggtgatgcctgcaacgttaccggctgcgatcagaatcttctctttcagctcctgggaaaggccatcgcccgtcacggtcacggtatcgccgttgaccttcacatccactttgtcgctgtcgggtaacccgagcttgttgatgtgatcctgcagctttttattctggtcatcgccgccattcacggcatcccataatttttcaccggcttctttcacaaaattaaacagacccatacaacctccagtgtgttagtggatatacgccgtctttcggctctataagcgtagacccttttgccgtcgctgatatttaacatcatttatgctgtgcgtggtggcacaggaaaggcacggaagagattttgttgattcgcagttcgcgttacactgtctggcccatctctctcgcgtcaggaaacgtcatgcattgcccattctgctccgctgtggacaccaaagtgattgattctcgtctggttagtgaaggctcttcggtgcgccgccgccgccagtgtctgatgtgtcatgagcgttttaccaccttcgaggtggcggaaaactggtgatgccacgcgtggtgaaaagcaatgacgtgcgcgaaccctttaatgaagacaaaatggccagcgggatgatgaaagcgcttgagaagcgtccggtcagcgccgatgcggttgaaagcgccgtaaaccatattaaaacccagctgcgtgccaccggtgaacgtgagattcccagtaagctgattggcaatctggtgatggatgagctgaagaagctcgataaagtcgcctacatccgctttgcctcggtttaccgcagctttgaagacattcgtgattttggcgaagagatcgcccggttacaggattaaaccatggatgaactttatatggcgcgtgcgctggaactggcgcgacgcggccgctttacgacgatgccgaaccccaatgtgggctgcgtgattgtgcgcgatggcgaggtggtcggtgagggctggcatcagcgcgccggtgaaccgcatgctgaagtccacgccctgcgcatggcgggtgagaaagcgcgtggcgcaaccgcctatgtcacgctggaaccctgcagccatcatggccgtacgccaccctgctgtgatgcgctgatcgccgctggcgttacccgtgtcgtggccgccatgcaggatccgaatccgcaggtggcggggcgcggactgcaccgtctgcatcaggcgggcattgaggtcagccacggtctgatgatgccggaagcggaggcgctgaatcgcggtttcctcaaacgcatgcgcactggcttcccctggatccagctcaagctgggtgcctcactggatggcagaacggcaatggccagcggcgaaagtcagtggataacctcgccggctgcccgtcgtgatgtgcagcgcctgcgtgcgcagagcgccgccattctcagcagcagcgccacggtgctggcggacgatccttccctgacggtacgctggtctgaacttaatgcggagagccaggcactgcttgatgagcagcaactgcgtcagccggtgcgggtgattatcgacagccagaatcgcgtgacgccgcagcatcggctcattgagcagccaggcgaaacctggctgatgcgtcatcagcccgatcagcagagctggcccgctgacgtgacgcaaatcgctgttccgctgcgcgaacagcagctggacctggtggcgatgatgatgctgctgggacagcgacagattaacagcgtctgggttgaagcgggcgcaacgctggccggtgccctgttgcaggccggactggtcgatgaactgattgtttatctggcgcctaagctgttaggtcatgaaggacgcgggctgtgtaagctgccgggactaagccagctggctgacgcacctgccttccgtttcagtgatgtccgccaggtcggtgacgatttacgcctgaccctgacaccacaataacacggtcggaaaagcgagagcacgccgcccaagagtatgatagaatccgcccccctgcgcggggccaaccaaacccctgaaaggataagtatgaaagttatcgaagctgctgttgcaacgcctgaggccaatgttgccatcgttatcgcgcgttttaacaacttcattaatgacagcctgctggatggcgcagttgatgccctgaaacgtatcggccaggtcaaagatgacaatatcaccgtagtctgggtgcctggtgcatacgaaactgcctctggcagcacgcgcgctggccaacaccggcaaatatgatgcgattatcgcactcggtacggttattcgtggtggcactgcgcacttcgaatatgtggcgggtgaagccagctccggtatcgccagcgttgccatgaacagcgagattcctgtcgcgtttggcgtgctgaccactgaaagcatcgagcaggccattgagcgtgccggcaccaaagcgggtaacaaaggtgctgaagcggctctgactgcgctcgaaatgatcaacgtattgaaagccattaaagcctgatttttgtaaggggaattttgtgaaacctgctgctcgtcgtcgcgcccgtgagtgcgctgttcaggcgctttactcctggcagttgtcgaataacgacattgccgatgtggaataccagtttctggcggaacaggacgtcaaagacgtcgacattacctacttccgcgaactgctgtccggtgtggcgaccaacagtgcgtatctggatggactgatgaagccctatctgtcgcgtcagctcgaagagctgggccaggtagaaaaagctatcctgcgcatctcgctgtatgagctgagcaaacgtaatgatgtgccttataaagtggccatcaacgaagggattgagctggcgaaagtcttcggtgccgaagacagtcataaatttgttaacggcgtgcttgataaagccggtccacaaattcgacccaatcgcaaataaacaaaaaggccggcttgccggccttttttcatgaagggttaagcggaacgcaattatgtcttgtggtgaatttgaactcatcgcacgctacttcaaccgcagaacacgcagccgccgtgatgtcgaactcggcatcggtgacgattgtgcgttacttagcgtgccggaaaaacagacgctggcgatcagcaccgataccctggtcgcgggtgtgcacttcttaagggatatccatcctgccgatctgggttacaaagccctggctgtgaatctcagcgaccttgctgccatgggcgccgaccctgcgtggctgacactggccttaacgctgccgcaggtcgatgagagctggctctctgccttcagcgaaagcctgtttgaactgctggaatattacgacatgcagctggtcggcggcgacaccacccgtggcccgctgagcctgacgctggcgattcacggtctggtgccgcagggccgtgccctgaaacgttcaggcgcgaagccgggtgactggatttacgtgaccggtacgctgggtgacagcgcggcgggcctggcgctgctgcagcatcactgccgcatcagcgatccggcggtgcatgaagcgctgattaaacgtcatctgcgtcctatgccgcgcattctgcagggccaggcgctgcgttcgctggcctcctcagcggtggatctttccgacggcctgatttccgatctcggccatgtgctgaaagccagcggctgtggcgcacggcttaatctggatgcgttgcccctttcggctgcgctgcgcgatcatttcgaccctgagcaggtcctgcgctgggcgctgagtggcggagaagattacgaactctgctttacggtgcccgaggtcaatcgcggcgcgctcgatgtggcgctgggtcacctgggcgtgccctatacctgcatcgggcagatggcaccggagtcggaaggcttaacgctgctggataatggcaagcccgccacattccgtcataaagggtttgatcactttgatgctaaataacgacgtggcgaagagtcgcctgcggatgagcaatccctggcatctgctggcgaccggtttcggcagcggattaagcccggtcgtgcctggcaccatgggatcgctggcggccattccgtttctggtggctgatgacctatctgccgcaggatctctattcgctggtggtgctggtcggtatctgcgttggcgtctatctctgccatcgcactgccaaagatatgggcgtacacgatcacggcagcattgtctgggatgagtttatcggcatgtggattacgctgatggcgattccggttaacagctggcagtgggttctgggtggctttgtgctgttccgtattcttgatatgtggaagccgtggccgattcgctggtttgaccgcaatgtgcatggcggcatgggcattatggtggatgacattattgctggcgtgatttccgctgccatgctgtatggctttggggtctggctggcgggttaactgccgggactcctcatacagcgacagaaggtgacgcccgggcagggcgtctcctttctctgattttattcgaatcctaccggctgatgcggctgatagacctcttccagcagcgcaacttcctcgtcactcagcgtgacatccaccgccttcaccagatcctcaaactgctcagcacgcgacgcaccaataatcggcgccgtaacggcaggcttgctcagcagccaggccagagccacctgcgcccgcgttacacctttaccttccgccacctgcgccagccgctctgcaatcacggcatcattctcttcggtattgtcatagagcgacgccatcactttgtcagaggcggaacgcgcggtattttccccccacgggcgggtcagcttaccgcgcgccagcggactccacggcagcacggcaatctgctcttgcaggcagagcggatgcatttcacgctcctcttcgcgctgaatcaggttgtactgatcctgcatgctgacaaagcgatgccagccctgttccgactgcatctgcaacgcctgggcaaactgactggcgtgcatcgacgaggcaccgatataacgtgctttgccagactgcacgacttcatgcagcgcttccagcgtctcttccagcggcgtctcataatcccagcggtgaatctgcagcaggtcgacatactccatgccgaggcgctgcaggctgtcatcaatggattgcagaatattcttgcgcgacaatccctgtgacagattggtcagcgggaaatagactttggtggcgaccacgatctcttcacggcgggcaaagtctttcagcgcccgacccaggatctcttcactgctgccatctgaatagctgttggcggtatcgaaaaagttgatccctgcgttcagcgcctgctggatcagcggacggctgctcgcttccggcagcgtccaggcatggttgccgcgcgtgggtttcgccataagtcatgcagccaagacagagacgcgacacctgcagatcggtggtacccagttgaatcgttttcatggtggaggctcctgcgaaagtgcaaaggtcttagcatagcaggatgttgcgctccccgaggggagcgcagcgagaggaggttactgcgccagccagcgggcgatctgctgctgaatgccctccgcgtccagcagatagtcatgacgcacttcgtcctgcgtcccctgcgggatgaactcatcaggcagaccgatgttcagcaccggaacagccagacgtttcgccataacaaattcattgacgccactgccggcaccgcccttgatggcgccttcttccagcgtaatcagcgagtcgtgcgtggcggcgagctcggcgatcagcgcttcatccagcggcttcacaaagcgcatatcgaccagagtcgcattcagcgcttccgccgtggcggccgcttccggcaacagggtgccgaaattcagaatcgccagcttttcaccctgacgtttcaccacggctttacccagcggcaggctctgcagcggagccagtggcgtaccgacaccagtgccgcgcggatagcgcaccgcacatggaccatcctgatagtgatagccggtgtagagcatctgccgacactcattttcatcgctgggggtcatgatcaccatatccggcacgcagcgcagataggcgagatcaaacgcgccctggtgagtctgaccatccgcgccaacaataccaccgcgatcgatagcaaacaggaccggcagtttctggatggcgacgtcatggatcagctgatcgtaggcgcgctgcaggaaggtggagtagatagcaacaatcggtttatagccgccaatcgccataccggcagcgaaggtcacggcgtgctgctcggcaatcgccacatcgaaatattgtttcggaaattcgcgtgagaaggccaccatgccggagccttcgcgcattgctggcgtaatcgccatcagtttcggatcgtcggcggccatttcgcacagccagttaccgaagattttagagtagctcggcaggccttccgcgctttttggcagttcgccaatcgcaggatcaaatttaggcacggcgtgccaggcaatcggatcttcctctgccggggcgtagcctttacctttcttcgtcatgatatgcaggaactgcggccctttcaggctgcgcatgttgctcagcgtattgaccagcgtcagcacatcgtgaccatctaccgggccgatataattaaagcccagctcttcaaaaagcgtacctggcacgaccatgcctttgagatgctcttcggtgcgtcttaccagctctttgatcggtggcaggctggtcagcacacgcttgctgccttcgcgcagtcgcgcataggttttacccgacaggatctgcgccagacggttattcagcgcgccgacgttttcggagatcgacatctcgttgtcgttgaggatcaccagcatgtccggcttgatatcaccggcatggttcatcgcttcaaacgccatgccagcggtgatggcgccatcgccaataatacaggcggtgcgacgaccctgaccttcacgttctgccgccgcggccatgccgagaccggcactgatggaggttgacgagtgaccgacgctcaatacgtcatattcactttcgccgcgccatggaaacgggtgtacgccatttttctgacgaatcgtaccgatgcgatcgcggcgaccggtcagaattttatggggataagcctgatgacccacatcccataccagatggtcgaagggggtgttatagacataatgcagcgcgaccgtcagttcgaccacgcccagacccgacgcaaaatggccgctggagcggcttacactgtctaacagatactgacgcagttcatcacagagcgcaggcaacttctctttcggcagggcgcgcagctcctgaaccgtgtttgccagcgccagtgtcgggtatttagcaatatcaaaactcatcagagactcattatggaagttatttgtcgcgttcaattatgaagctcgccagcgcctgcagtgctgtagtgttataagagtgcgcagcgagcatttctaacgtatcaagagcttcctgatacaaatcccgcgctttagcttgggcattttcaaggcctaacagtgaaggataggtgctttttcccagatgctgatcggcaccctggcgttttccgatcaccgctgtgtcaccgatcacatccagaatgtcgtcctgcacctgaaacgcgagaccaatggcctctgcatagcggtcgagcagcggcagggcttcccggccagcatcacccgccgttaaggcgcctaatcgtaccgctgaacggatcagcgcgccggttttatgacgatggatctgctccagctggtccagatccacagatttaccttccgccgctaaatcaagcgcctgtccgccacacatgccggccacgccgctggctttcgccagttcagagagcatcatcagacgatattcagcgctgacaccgggcattgcttcgtcggccagaattgaaaaggccagcgtctgcagggcgtcgcccgccagaatcgcggtatcttcgccatatttaatgtgacaggttggctgcccgcgacgcagtgcatcatcgtccattgcggggagatcgtcatgaatcagagagtacgcatgaatgcattcaaccgcggcggcgggggcatccagactcgccgggtcggcgtggagcatttcgccggtagcgtagaccagaaaaggacgcaggcgtttaccgcctaataatgccccatactgcatggcattcaccagaggagaactctgaaaaggaagtggctctataaaacgcgtcagcgcggcattaacctgctgctgatacgcgtcgagtaatcgggcgaaatccattagctgttttccggcgtgaaagcagtgaggtcggcatctttatcatcgttcagcagaatacggacccgctgttcagcctgctgcagcgtctgctggccagtccgcgccagctgcacgccgcgctcaaattcgttcagggcttcttccagcggcagttcaccactttccagacggctgacaatctgctccagctgctgcaatgacgtttcaaagctggctggctgttcggcttttttcggcatatttcgtgtcgactcacggttgggacattatctcgcaatcggtcatggtagctgagaccctatgattagcaaaataatcaatgcggcggctgatgaagaagcagtcacctgacaaaggtgatatactcccgcgcctcggatgcggttgcgccttgcagcccgcaattttgtgattttaccagctaagtgctgcctgttttagcacttatttgcccaacgaagctgtgtcgccgccatgaagtttatcatcaagttatttcctgaaatcaccatcaagagtccgtcggtgcgtttgcgctttatcaagattcttgccagcaatatccgcaacgtcctgaaaaccgttagcgacgaaatcgccgttgtgcgtcactgggatcacattgaagtgcgttcgaaaaatccggtgctgcgggacattattcccgatgagctgacgcgcattccggggattcatcacgttttagcggttgaagatcgtgagtacaccgatattcatcacatctttgaacagactttagtgcagtatcgcgacagccttgaagggaagagcttctgcgtgcgtgttaagcgtcgtggtaagcatagcttcagttcacaggatgtggagcgctatgttggcggcggtctgaatcagcatattgaaagcgcccgcgtgcagcttaaaaacccggacgtgacggtgaatcttgaagttgaagagaatcgtctgacgctggtgactgcgcgctacgaaggtctgggcgggttcccgatcggcacgcaggaagatgtgctgtcactgatttccggtggctttgactccggcgtctccagctatatgctgctgcgtcgcggcagtcgcgtacattactgcttctttaatcttggcggtgccgcccatgagattggcgtccgtcaggttgcgcactatctgtggaatcgttttggtcgttcacaccgcgtgcggtttcgtggcgatcaattttgagccggtagtgggtgagatcctcgaaaaagtggatgacggtcagatgggtgtggtgctgaagcgcatgatggtgcgtgccgcctcgtcgattgctgagcgctacggcgtgcaggcgctggttaccggtgaagcggtgggtcaggtgtcgagccagacgctgaccaacctgcgcctgattgataacgcctctgatacgctgattctgcgtcccctgatctctcatgacaaagagcacatcatcaggattgcccgtgagattggcaccgaagatttcgccagcaccatgccggaatattgcggtgtcatctcaaaaagcccgaccgtgaaagcggtgaaagagaagatcgaggctgaagagcagaatttcgacttcacgattctggatcgggtcattgaagaggcgaccaacgtcgatatccgtaccatcgctgagcagacagaagaggaggtggttgaagttgagaccgtcgccatgctgagcgagaacgacgtggtgctggatatccgctctattgatgagcaggaagagaagcctctggcactgaaagctacggaggtgaaatcgctgccattctacaaactcagtacgcagtttggcgatctcgatcagaaccggacctggttgctctactgcgatcgtggtgtgatgagccgtctgcaggcactctatctgcatgagcagggctttaaaaacgtgaaagtctaccgcccgtagtgacgcctcagagccagtcagcgcctgttcaggtctgactggctgcattgccttaaacagagcgttttaactcagcgtgtttacgcctgatagtcataaatgccgggagccagcaccagctgtgcggccacctcgcgcgccatctcttttcccaccagcagatcgatcagctttagcgcaaaatccattgccgtgcctggcccctggctggtcagcagattgacgcgcggatcccagaccacacgccgctccatccacttgtctgacggaatggtctcttttaagccgggaaagccagtcatgttaccgaccggaaagagatcgtgggggatgagtactgtgcctgccgctgcgcagatagcggcgacgatcctttcattgaggtgaaactggcgtaccgtttcgactaacagcggactgtcacggaaggtttcggcgcctttcaggccgccgggcaggacgatggcggcgaaatcattgtcggcgacttcaaccagcgtcacgtcagccagcagacgaacaccgcgtgagcagacgatctcccggttgccgtcgctttcgacgctggcggtgacgacgttcagcccggcccgtaccagcaggtcgatagtggtgacagcttcggtttcttcactgccatgtgccaggcaaaccagcactgatgcgttcgcggtcataatgggactccttgcgttttacaatgtcatacagacgggtgttctccgtcagcaccatgccgtgcgtccgggcgcggcgcagcagaaaaccgctgatatagtcgatttcggtaagacgctgggcgcgtatgtcctgcagcatcgaagaggtgttggccgcggtgctttcaatcacgtcgaagatgatgtcctgcaggctttcgctggcaacgttctgaccttcgcgctccatgacccagctgatctcttcgcacagttgcgcgatctgctccggataagcgcgcagggcaccgtttctggcactcatactccacgctaagcggattgatgatgcagttcactgccagcttgcgccagcaggccgcccggatgttgtcatgccaggcgacatcaggcagggcatgatgcaggatatcggcgagatcgctgtaagcggcgcttttacggttaccggggccgatgtgggtgatgccactggcaatgtgtttgatgacggtgccatcgcgcatcgccgcatgggttgttaccccacgcagtagcggctgagtcagccctttcagctcttccagcgtccccatgccgttgtgcagcagcagcaccgggcagttttctggcagcacgctttccaggtttttcaccgcgggcgagacctgcggggctttgagcgtaaccagcagcagctggctttctgccagaaacagcggatcgttggcgataaacgtgcggttcgaaatgttaccctgtggatcaatcacattggctgaacagtagggctgcggcacccgcaaccatccctgcacctcatgtccctggcgggcaagggctgtcatccagatctgacccagagcaccgcaacctaacacggtaattttcatgctgcctcccgctggcgggctatccatctattatttactgtcacactttcattatagcgttgtgtgcagcctgattttatttagcaccttaagacgcgtattatgcatgtcactttagcgtcaggagaagaagagatgccatctttcgatatcgtttcagaagtcgatctgcaggaaattcgcaatgcggtggaaaatgccaaccgtgaagtgtctacccgcttcgatttccgcaacgtgagcgccgagtttgagctcaacgaaaagaatgaaaccatcaaaatcaccagcgagtccgattttcaggttaagcagctggtggatattttgcgtgagaagttactgaagcgcgggattgaaggcggtgctttagaggtgccggaagagattgagcacagcggcaaaagctgggcggtcgatgccaaactgaaaaaaggcattgaaagcgacgtggcgaagaagctggtgaagctgatcaaagacagcaagctgaaagtgcagacccagattcagggtgaagcattgcgtgtaaccggcaaagcgcgtgatgatttgcagggtgcgatggcaatcgtgcgcggcagcaatctggggcagccattccagtttaaaaacttccgcgattaagcgggggccggctgaatttcagcatgaatgcagtgataaaaacccggctaaggccgggttttttgttgttgagcgagaggtcgtctggatgatagcgttctggctcaggcacccatcgccttggatttatgagtcgtctgtaagaaggcttgtgccgggtttggcgcggttgagcctattctggccccccttgctttgagtttataagctgtctgaaaccaggattgagttggatttgagtctgttaacagattcaaatcctgggggaacttagcagcaactcaaaagctcaggggcgcagggggcacggtcagaggaggaaagcgtcccgcgccagggacggcgcgggccgagcgtgccatggatggcggcttttgcgactttccgatctgaccgtgttccctgagccagctcgatcctgaagcgaaacgagctgacgttatcactaaactttttaagctaacaactacccagcagagcttccagctcagggcggctggtaaccttgctatcaattttgatgtaggcgcttttctcttctggcacgataaacacagagttaacgcccggctgcgctttcaggcgctgctccagattcggcacggccagtgcggcatcactcagcacgatgcgcaggctgctgacataaggcggttcctgcattgtcatgctgacaaacagccaggctgcggccaccatcgcgccaaccaggaatacggtctgcgcatcgaaatgaccaaatacccagccacccatgctgccgccaacggccacgcccaggaaactggctggtggagtagatccccatcgccgtgcctttgtagcccgcaggcgactctttactgatcagcgaaggcagaatcgcttccatcaggttgaaagcgaagaagaagagctgaacacccaccaccagcgtccagaaatgtccttccgcgccccacaatacgatctcggcaatgacaatcatcccgacgcagccgacaaagacacgcttcatgcggcgcttcacttcggcataaatgatgaaaggtactacgccggcaaaagcgatcagcatggtggagagatagactttccagtgttcgggagccgggaagcctgcctgttcaaactgccccggtaacgcgacaaaactcgacatcagcaggacgtgcaggcagaaaataccgatattgagcttcaccagacgtgggttagccagcactttgcggaagctgcctttaaccatgcctgattcacggttcagaacatgatgggaggccgatggcaccaccagcagagtgatcacgatacccagcgacgccagaatcgcaatcatccagaacagcgcatgcaggcccagtgcgtgagtaacaatcgggccgaccaccatggcgatcgcgaaggtaacgccaaaactgatgccgataaacgccatcgctttggtgcggttctgctcacgggttaaatcggataacagcgccatcacggcagcggcaatcgcgcctgagccctgaagtgcacggcccagaataatgccccagatggagtcggtgcaggcagcaataatactgcccaggacaaacagcaacagtccgccaacgatcagcggcttacgcccgatgcgatcggagagcagaccaaaaggaatctgaaatatcgcctgggcaaggccataaatgccgattgccaggccaattaaggtttcactcgcgccctgtaatgccatgccataagtggtcagtaccggcaggaccataaacattcccagcatgcgcagggaaaagaccgtaccgaggccccatgtggcgcgcagctccaccggagtcattttattatcgttcattccaacctctgttaatgtgctgcatttattctagggggcggggcagggcgggtaaaacaatagtttttaagcagtggtaacaaaaagaaagggcgcgaaaatcgcgcccttttcatgctgtatcggtgccggttaccagacgtaagtcagcaggtccttcgaggccggagccatcgaatccaccgacatcatcacgctcagtgcggtgatggtcacgatagagaagacaaacagtttacgcgcccagacacggtcatcagcggttttataacccgataacgccatgcccagccaccagacgctgaccgcagcagccaccaccagatatttgtagcccgcgtagcctcccagcgtcagcatcagcgtggcaatcataaacgccaggatatagagcgtaatatgatttttagccacggaaatgcctttcaccaccggcagaaaccgggatgttcgctgcctggtaatctttaaagcggaagatggcaatcgcgtacgaatgcggcatctgccacaggctaaagatcgccagcaggattaatgcgccagcatcaaactggttagagaccgcgcagtagccgataaccggcggcgcagcacccgacagactgccaatcagcgtaccgtaaacggaattacgcttcatgtagagactgtagatgcccacgtacaccacgaagcccatcaccgccagccacatggccagcggattagcaccgaagtagagcaacgcaaagccagcaatacccagcacagtggcataaaccaggcttactttcgcggagatgaggccttttaccagcacccgattcctggttctctccatcttgatgtcaatgtcgcggtcgatcacgttgttaaacacacaacccgatgcaaccaccagtgacacgcccaccagggtgatgagaaacagggcgtaatccgtgttgcctttggaagccaacagaaatccgccgatcacagaaattaaattcccgaaaataattcctggttttgtaacttgcaggtattgcttaaacattacgcgtgactctttagtgaggcatcatgttgtagttgaggttccacatgatccacagtgagcctactacgacaatcaggatgatgatggccgagaagacaatggctaccatgttccagccaccctcagatttgctgtctaagtgcaggaagtagaccaggtgaaccagcacctgaatcaccgcacataccagaacaacaccaaggatagtaccgtgagatgcactgccatccattaccatccagaacgggatcgccgtcaggatgatagagaggatgaagccgatcatgtaggacttcacgctaccgtgtgaagcgccatgttcgttaacagaatgactcattacatggctcccatcaggtaaacaacggtgaagacgcaaatccagaccacgtccaggaagtgccagaacaggctcagacacatgatacgagtgcggttagtcgcgttcaggccacgtttggaaatctggaacatcagaaccagcatccagatcagacctgaggtcacgtgcagaccgtgggtaccgaccagcgtaaagaagccagacaggaagccactgcgatccggaccaaagccttcagcaatcagatgatggaattcatagatttccattccgatgaagcccagaccgaacaggaaggtcagcgccagccagccgataacggcacctttttgctccttgttcatggagataacagccatgccgtaagtgatcgaactcaacagcagcagggcggtttctaccagaacaaacggcagctcaaagatatctttacctgccgggccaccggcagtgttgttgaccatgacagcataggtcgcaaacagggttgcgaagataatgcagtcactcatcaggtagatccagaagccaaagactttattggctcctgcatcgtgatgcccatgctccgcatgggcgtcgtggtgatgtttaatcagagtttcagttgacattatttcagacctgctttgctgatttcgtcaaagtgctggttctcaatcttctgaacttcggcaaccggaacgtagtaatccacgtcttcgtcgaagctcttcacgatccaggaaacgatcatgccgaggaatgaaacacccgccagccaccagatatgccagatcagcgcgaaacccattaccgttgcaaatgcgcagatgataattgcggcaccgctgtttttcggcatatgaatctcttcatacgattccggctgtttgtacgcttcgcctttctctttcatttcccagaaagcgtcacgctcatgcacatgcgggatgacagcaaagttatagaacggtggtggtgaagaggttgcccactccagcgtacgaccgccccatgggtcacccgtcacatcacggttctgatcgcggtcacgtaccgagacgtagaacatggtcagctgacacagaatacccagcgcaatcaggccagcaccgcccgcagctaccaccagtaaggtgtggaactgtggatcgatatcctggctcagacgacgcgtcatacccatgaagcccagtgcgtacagcggcataaaggcaacgaagaagccaatgatccagaaccagaatgcgcgcttgccccaggtttcgttcagggtgaagccaaatgctttcgggaaccagtaggtcacgcccgccatacaaccgaacaccacaccaccgatgataacgttatggaagtgtgcaatcaggaacaggctgttgtgcagaataaagtcagcacccggaacggccagcagtacgccggtcataccccctacagagaaggttaccaggaagccaacggtccacagcatggcagagtgcatctgaatgcggccctgatacatggtgaacagccagttaaagattttaacccctgtcggaatcgcgatgatcatcgtcatgataccgaagaaggcgttaacgttggcacctgcacccatggtgaagaagtggtgcaaccagacgataaacgacagcacggtaatggcgatggtcgcccacaccagtgaggtataaccaaacagacgttttttggagaaggtcgcggtaatttctgcgaacacaccaaacaccggcagtaccaggatatacacttccggatggccccagacccagatcaggttgacgtacatcatcatgttcccgcccatttcattggtgaagaaatggaagccgagataacgatcaagggtcaacagcgccagggtcacggtcagaaccgggaacgcagcgatgatcaggacgttggtgcacagcgcggtccaggtaaataccggcattttgaacaggctcatgcccggtgcacgcatcttcaggatggtcacgaagaagttaataccggttaaggtcgtaccaatacctgaaagctgaaggctccagatccagtaatcgaccccgaccccgggactgtactccgcgccggagagcggcggataagccagccagccggtctgtgcgaactcgcccacacccagagacaggttaaccaggatcacaccgaccgcagtaaaccagaagctcaggttgttcaggaacgggaacgcaacgtcacgtgcaccaatctgcaacggaaccgcgatgttcatcaggccaaccacgaacggcatcgccacgaagaagatcataatcacgccatgcgcggtaaagatctggtcgtagtggtgcggtggcagaatgcccgcttcaccggccgaagccataacctgctgggtacgcatcataatggcatcagcgaaaccacgaatcagcatgacgaaacgccatgatgatgtacatgatacccaggcgtttgtggtcgactgacgtcagccattcagaccacagatatttccacttaccaaaataggtgagcgcagcaaccagcgctgcaccacctatcaggatagcggcaaccgtaaccatgataatcggctcatggtacggcactgcatcaagtgttaattttccgaacatcgtattattcctcggctcccgcggaagcggcgtgactcatgtccataccttcatgttttggcatgtccattttcccgtggctcatcttgaacttgtcgatgacttgcatgaacagtttcggatcagctgaagagaaatattccaccgggtgattttcgcttggcacagccactttctcgaaatcatccatggtgttcagcgtgttaggggctgctttaactttagccacccactgctggaattccgcatcgtctttggttgcaatggctttaaacttcatgccagagaaaccacgaccactgaagttcgcagagataccgtcgaaaattcccggctcatttgcaatcagatgcagcttggtctgcataccagccatcgcataaatctggctgccgagcgttgggatgaagaaagagttcatgacggagttagacgtgattttgaagttcaccggagtatttgccgggaaggcaatctggttcacggtcgcaataccctgttccgggtaaatgaacaaccatttccagtccagtgcaaccacatcgatctcaaccggtttcacatcagattgcagcggtttgctgggctccagtgcgtgggttgatttccaggtcagcacgctgaggaagagaatgatcaggatcggaatggtccagaccacggcttccactttgttagagtgtgaccagttagggctgtacttcgcattcgtgttggacgcccgatatttccaggcaaacaccacggccatcaggactgcggggatgacgacgatcaacatcaggccaaaggcagtcagtatcagcgaaacgttgctccagtgcaatctgtcctttgggatttaacaatgcactatcgcagccactcattaataaagtgcctgcaattaatgacaaaatccccaaacttttattgtatttactgagtctcatttaacgacctcaatgacaaagggctctattgtcgtttaagtgtgcgcgcattttacgggaaggtttatgcagtgtaaaccagcttaaggatgtgtcagatacgtgttgacaccttttgctaagggtgtcacagatgttgcgccaggtgacaaataattaacgcagacaagcagttggcatcaatataacaaaaaccaatggaagtaaccgtaaaaaaatcagggaaaggaataacccttacttttaactcccaaatatttaacaagtctgcatcatttgcgcgatgaaatttaactaaagtaattgctcaccggtttttagtatttccgctacgcctcctcaggtcatattgttatttttaaaaaataacacgcgatgataaatggcggcgacttatcggggtgtcataaaataagccgcagcccgtaaacctatcgatttcacttaagcatctgatgcaggcaacgcaggggttctcttcagcgcccgatagtccagcaacacccccgaaagcacggccagcaaggagagtgtcatacccagctcaaacaggcgggtaagcagcggtgtcagcgccgtcacgcccaacgcattcagtgccagagccaccagccagagcgccagtacgccgcatccggctgcaaacagacgattagtccagcgatagccatgaggatagtagctacgtgtcagaaaattgccactttgctcgacctgattcaatgtttgtcggcaaaaagccagcagcaccaggcccggcagacccgccatcaccgtgaatgcataaaaggtcggccagccccagagttccaccagccagcccgccgccgggcccacatagacccgacccaccgctgagagcgccgacaacagggcgaactgggtagcggagaacgacttattgcacagcgtcattaacagcgccacaaaggccgcggtgcccatgccgccacagagattttcaacaaagaccgcgctggccatgctccacaactgtttgtcggtcaccgccagcagccagtaaccaaagttcgagacagcctgcagcagaccgaaaatcattagcgcccggaacaggctcagacgctgcatcagtacgccgccatagagcgccccgataatggtcgccagcagacccagcgtcttgttgaccagaccgacgtcaccggcgttgaagcccacgccgcgaatcaaaaaagtggtagtcagcgaggcggcaaacgcatcgcccagcttgtaaagaataatcagggtaatcagcagccaggcgttgttgcgctgaaagaaatcttttagcggatcgaccaccgcctgacgcagtgaatggggtgtggagatacgggtatctggctcgctcgccaccagcgtggcgataatgcccggcaccatcatcagcgccatcagccagtaggttgcctgccagccgaggtagcggtcagccagccacaacgccagcccgccggaaatcagcattgccagtcgataccccagcacggtaatcgccgcgccgctgccacgctcttcaggcggcaggatgtccgttttccatgcgtcaaaaacgatgtcctgtgaggcggagcagaaggcaatcagcacggccagcgcggccatcagggtaagatcgcgtcccggttgcagaaatcccatcgcgattatcccgccaaccagcgccagctgactgaccagtaaccagccgcgacgtcggcccagaaacggcggcgtatagcggtccatcatcggtgaccagagaaacttaaagacataggcctggccgaccagcgaaaagaagccgatggttttcaggtcgacattttccaccgtcatccacgcctgcaacgtgcccgatgtcagggccagcggcagtccggaagcaaaaccaagaagcagcaatacggcggcgtttttctggctgaagaggcgaagatagtggttcatgcggatcctgcagataacaagaagccctgcgcaaggcagggcagaggagagactgaattaacgggcgtttctgcttgatgaagtcgttgacgctggtgtcctgagccatatccgcgatcacatcgctcatagtggcgttcaccgcgttggtaatcttctggttattggcgttgaacgcgccttctacgctgtaagtctggcggtagtttttaacctgtttgttgccgtttttcgctgttgcgataatagagatgtccgctttggtggtgatgctgtagcgcacattgccctgagtgacgtcggcatagaggttgttcaccacaatctgcagatcgaccgcgccattaggaccaatcatatagccgcgtgctgtcatctgcttctccagcacttcctgcagcaggaagcgcaggtcacgcgatgacgttaaggtcactaactgaccatcacggtttacttttgccagcgcctgatctttacgctggtcggcaccgttgatgctgacagtcacgcccatcaggcctgggtcctgctgcggtaactgaattttaggctggatagtcagggtgttattgctggttgcacagccggctaaaatgaacgcagccaacagtgggaataacagttttttcaacatactttttctcgttggtgtcagggggttggtttgcaaaaactgcggtcatcatagcattgcccggcagtgaaaaaagccctgttgccggggaaattgtgtctgaaaccgttttaagccccttctctgacaggtcggtttgctgttcgtttcagctgcgttattatgcgtgccggaagcggtctgacataaaatgcaatatttagcgtgcgcttgcgggtaagcgcactaaaagcgactaagattgaatgagatggggcactgcgctcgccattgaggagtaatagccatgatccgcgaacaaatagaagaaaagctgcgtgtggcgtttcagccagctcatctggaagtgcacgacgaaagttaccggcacaatgttcctgccggatcggaaagtcacttcaaagtggtcatcgtgagcgactgctttgcaggccagcgctttctggcgcgtcatcgcctgatttatggcgaactggccgctgagttagcgggcagcgtacacgccttagccctgcatacttacaccctgaaagagtgggaagggttgcaggataccgtactggcttcgcctaactgtcgtggtgccggaacactcgcctgatctcccttctctgaaacggcctgcgggccgttttttctgttatttagcgaaaaacgcgatccctggctcaaaaaagcagcaaacctgctgaaaagtggtgagttagcatcctcgactcattccagcgatgccgctataatgctgcgtctatttttccggaatgtcttcgggacgcttctggtaacagggatcaggttctcttcacggaagccgtcccggttgttggatacggcgcatttcactatgtgtggtgtctgaagttgaccgagcacgtgattttttgaggtaacaagatgcaagtttctgtagaaaccactcagggcctgggccgtcgcattacgattactgtcgctgctgacagcatcgaaagcgctgtaaaaaaagaactggttgacgttgccaggaaagttcgcatcgatggtttccgtaaaggcaaagtgccgatgaacatcgtggcacagcgttacggcgcttctgtccgtcaggacgtgctgggcgagctgatgacgcgcaactttgttgacgccatcatcaaagaaaaaattaatccggctggcgcaccgaactacgtgccaggcgaatacaaagaaggtcaggatttcacctacgcggttgaattcgaagtctatccggaagttgagctgaaaggcctggaaaacatcgaagtcgaaaaacctgtcgttgaagtaactgatgctgacgttgataccatgctggacaccctgcgcaagcagcaggccaactggatcgaaagcgacgctgcagcaggtccggaagatcgtgccactatcgatttcaacggttctgtggatggtgaagagttcgaaggcggcaaagcctctgatttcgttctggccatgggccagggccgcatgatcccaggctttgaagaaggcgttgtgggtcacaaagcgggcgaaactttcactatcgacgtgaaattcccggacgactaccacgcagaaaacctgaaagggaaagatgcgaagttcgagatcgtgctgaagaaagttgaaacgcgcgaactgccagagctgactgaagagttcatcaaacgtttcggcgttgaagatggttcagttgccggtctgcgtactgaagtacgtaagaacatggatcgcgagctgaaaggcgctatccgtaatcgcatcaaaactcaggcaatcgacggtctggttgaagcgaacgaaatcgacgtgccagctgcgctggttgacagcgaaatcgacgttctgcgtcgtcaggctgcacagcgtttcggtggcaacgaacagcaggcgctggaactgccacgcgaactgttcgaagagcaggctaaacgccgtgttgttgtcggtcttctgctaggcgaagtgattcgtacccacgagctgaaagctgacgaagcgcgcgtaagcaccatgatcgaagagatggcttctgcgtatgaagatccgcaggaagtgatcgagttctacagcaagaataacgagctgatgaacaatatgcgcaacgttgcgctggaagagcaagcggttgaagcggtcctggcgaaagctaaagtgaccgagaaagagaccaacttccaggatctgatgaatcagaccgctcaggcctgatcacgcatttaaccgtctgtgctaagcccgtgactgcaaagtcgcgggcttttttgtgttttgcgtccggatagccactcttcgccgctatttgtttaataaacaggcgaattattcacgcatcgctttttccgggttagcgaacagggaaaagattgttatgcttgaaacatgcgtgcagcatccccagatacagggagtatgcagaaataagagtgaggctggctgattaaccgtcctgaaggtgtcggaaaaaggcgcggcgtggagtttcccgcgcgtcttacgtagaatcggtacagaatgttgccaatgaaatttatccaggagacggtaatgtcatacagtggcgatcgtgaatatacagcaccgcacaatgcgctggtgccaatggtggttgaacaaacttcgcgtggtgagcgtttcttacgacatctactcccgtctgcttaaagagcgcgtcatttttctgactggccaggtcgaagaccacatggctaatctgattgtggcgcagatgctgtttctggaagctgaaaacccggaaaaagatatctatctctacattaactcgccaggcggtgtcatcactgccggtatgtcgatctacgacaccatgaaatttatcaaaccggatgtcagcactatctgtatgggtcaggcctgttctatgggcgctttcctgctgacggcggggaccaaaggcaaacgtttctgtctgccaaactcacgtgtgatgatccaccagccgctgggcggttatcagggtcaggcgtcagacatcgagatccatgcgcgcgaaatccttaaagttaagcagcgtatgaatgagctgatggctgagcacaccggtaaaacgctggaagaaattgagcgtgacaccgagcgtgaccgtttcctctctgcaaatgaagcggtagagtatggattagtcgattcaattctgacgcatcgccaataagacccgacttaccgttgtccctggtctatagttaacaggacaacggtactattatgggttgaatgaatttcggccgtctccgcacggcctgagccgtacgcgggtatggcctgagaacaagaagaggttaactgatgacagataagcgcaaagacggttcaggaaagttgctgtactgctctttttgcggcaaaagccagcatgaagtgcgaaagctgattgccgggccgtcagtgtatatctgcgatgagtgtgttgacctgtgcaacgacatcattcgcgaagagattaaggaagttgccccgcatcgtgaacgtagtgcgttgccaaccccacatgaaattcgccatcacctcgatgattatgtcatcggtcaggaaagagcgaagaaagtgctggcggttgcggtttacaaccactacaagcgtctgcgcaacggcgataccagcaatggtatcgagctgggcaaaagcaacattctgctgattggcccgaccggtagtggtaaaacgctgctggcagaaacgctggcacgcctgctggatgtgccgtttaccatggctgatgccaccacgctgactgaagccggttacgtgggtgaagatgttgaaaacatcatccagaaactgctgcagaaatgcgactacgacgtacagaaagcacagcgcggcatcgtttacatcgatgaaatcgacaaaatctcacgtaagtctgataacccgtcgattacccgtgacgtgtcaggcgaaggcgtacagcaggcactgcttaaactgattgaaggcaccgtggctgccgttcccccgcagggtggacgtaagcatccgcagcaggaatttttgcaggttgatacctctaaaattctgtttatctgcggcggcgcatttgccggcctggacaaagtgatcgcccagcgtgttgaaaccggatccggtatcggcttcggcgcgaccgtgaaagggaaatcgcagaaagccagcgaaggcgaactgcttgcgcagtgtgaaccagaagatttgatcaaatttggtctgatccctgagttcatcggtcgtctgcctgttgttgcgaccctgagcgagctgagcgaagaagcgctgattcagattctgcgtgagccgaagaacgccctgaccaaacagtaccaggcgctgtttaacctggaaggcgttgagctggagtttccgtgacgaggcgttaaccgccattgctaagaaagcgatgtcacgtaaaaccggtgcacgtggtctgcgttcaattgtagaaggcgcgttactggaaacgatgtatgacctgccttccatggacgacgtggaaaaagtagtgattgatgaatcagttattgaaggtcagtctgagcccatgttgatctatggtaagcatgaagcccaggcatctggcgaataattaaacagatcgtccatcttgtcgtaataaaaaaggggaaaatgtttccccttttgcttttctcgcctctgtgacgttgaatgtcggacaatcatccccatatactcagatacctgtgggtttaactgcatacctgcctgatgcggttcccatcacctggcggacattaaacaaagagagagctctatgaatcctgagcgttctgaacgcattgaaatccccgtgttgccgctgcgcgacgtggtggtttatccgcacatggtaattccgttgtttgttggccgggaaaaatcaattcggtgccttgaagccgcaatggatcatgataaaaaaatcatgctggtcgcacagaaagaggcttcaacggatgaacctggcattaacgatctcttctcagtagggaccgttgcatcagtattacaaatgctgaaactgccggatggcaccgtcaaagtcctggtcgaaggtttacagcgcgcccacattacgacgctggccgataacggtgaccattttgtggcacaagctgaatatctggtttcgccagagattgaagagcgcgagcaggaagtgctggtgcgcacggcgatcaatcagtttgaaggctacatcaaactcaacaaaaagatcccacccgaggttttaacctcgctgaacaacattgacgatgcggcccgccttgccgacaccgtcgcagcacatatgccactgaagctggcagacaaacagtctgtgctggagatgtccgacgtcaacgaacgtctggaatatctgatggcgatgatggaatctgaaatcgatctgctgcaggttgagaagcgcattcgcaaccgtgttaagaagcagatggagaagagccagcgcgagtactatctgaatgagcagatgaaggcgattcagaaagagctgggcgagatggacgacgcgcccgacgagtacgaagcgttaaaacgcaaaatcgacgcggcaaaaatgccggaagaagcgcgcgagaaagcggaagctgagctgcagaagctgaagatgatgtccccgatgtccgctgaagcaaccgtggttcgcggctatatcgactggatggtgcaggttccgtggaacgcgcgcagcaaagtgaagaaagatctgcgtaaagcgcaggagacgctggataccgaccattacgggctggagcgcgtgaaggatcgtattcttgagtatcttgcggttcagagtcgcgtcagcaaaatcaaagggccgattctgtgcctggtcggaccgccaggggtaggtaaaacctctctcggtcagtcgatcgccaaagcgaccggacgcaaatatgtgcgtatggcgctgggtggcgtgcgtgatgaagctgaaatccgcggtcaccgtcgtacttacatcggctctatgccgggtaaattaatccagaaaatggcgaaagtcggggttaaaaacccactgttcctgctggatgaaatcgacaaaatgtcctctgacatgcgcggcgatccggcttcagcgctgctggaagtgcttgatcctgagcagaacattgcgttcaacgaccactatctggaagtcgactatgacctctctgatgtgatgttcgttgccacatctaactcaatgaacatcccggcaccgctgctggaccgtatggaagtgattcgtctgtcgggttacaccgaagatgaaaaactgaacatcgctaagcagcatctgctgaccaagcagattgagcgcaacgccctgaaagccaatgaaattacggttgaagacagcgcgattgtgggcattatccgttactacacccgtgaagccggtgtgcgtagccttgagcgtgagctgtcgaaattgtgccgtaaagcggtgaaatcactgctgatggacaagacgaaaaagcacatcaacatcaatggcgaaaacctcaaggatttcctgggcgttcagcgcttcgactacggtcgtgcggacagcgaaaaccgtgtgggtcaggtaacgggtctggcgtggacggaagtgggtggcgatttgctgactatcgaaaccgcctgcgtaccaggtaaaggcaagctgacttacaccggtttctctgggtgaagtgatgcaggagtcgattcaggctgcgctgaccgtggtgcgtgcgcgtgccgagaagctgggcatcaatggtgacttctacgaaaaacgtgatattcacgttcacgtacctgaaggcgctacgccgaaagatggtccaagtgccggtatcgccatgtgtactgcgctggtctcctgtctgaccggtaacccggtgcgggcggatgtggcgatgaccggtgagatcaccctgcgtggtcaggtgctgccaattggcgggctgaaagagaaactgctggcagcgcaccgtggtggcattaaaaccgtgctgatccctgatgacaacaagcgcgacctggaagagattccacagaacgtgattgccgatctggagattcatccggtgaaacgcattgaagaggtgctcaatctggcactggaaaatgcgccatacggtatgcaggttgtaacagcaaaatagtgattaacggcaaaaaccgttaaaaagcggagctggcaaggcaattggcgcttgccagcttttttttgtgccgttaatttaggtggctgccgacgcgacgttctcagagaaattccgttgtttcggctccacaggcttgatataacttgctgcgcgttcgcaccctgccggatgcagggtacgatgtgaaataataaaagaggggatgaagagagtgaataagtcacaattgatcgacaaaattgctgccgatgctgatatttctaaagctgcagcgggacgtgttttagatgcatttatgggctcagtttcagatgcgctgaaagacggtgatgaagtggctctggtaggtttcggcacattctctgtgcgtgaccgcgctgcacgtaccggccgcaacccgcaaaccggtaaagagatcaccatcccggccggtaaagtaccaggcttccgtgctggtaaagcattgaaagacgctgtcaattaataacaacgaatagattcattgacgcattttcttcagtggattagaggacgattaacccgtttctcatgtaacatacgggcacatcaatcagatgtgccttttttgttttaaccggtgagaatcgggccgtaagatggacctggaccggattgagactgccagctaagccagcagttgcgtgagtcgccagccaatggcgaattgcgaccgagctttacattcacactacagcggagtgttgccataccatgatggacaatttacgcgcggcgtcgaaccatgtcgtgctcaagattattttggggctgattatcctctcctttgtgctgacgggcgttggcaactatctgattggcggcaataacgactatgcggccaaagttaacggccaggagattagccggggacagctggagcaggcgttcaacagcgagcgcagtcgtcagcagcagatgctgggcgatcagttctcacagctggccagcaacgatggctacatgcagcagattcgccagcaggcgctgtcgcagttaatcgatcaggcgctgcttgatagctacatcaaagatctccacctcagcatcagcgacgatcaggtgaagcaggctatcttcaatcagcaggcttttcagaccaacggtaaattcgacaatgccaaatatctgagtctgatcagcaatatgggcttcagcgccgaccagtatgccgaagcgctgcgtaagcagctctctaatcaacagctgatcaatgccgtggctaacaccgacttcacgctgaaaggcgaagccagcaaactggtggacctagtttcacagcagcgtgagattcgtcaggcgacgctggacgtcaatgcactggcggcgaagcaggccgttactgacgacgaaatcagtcagtattatcagcagcataaaaccagctttatggcaccagagcagttccgtgtcagctaccttctgatggatgcggccagcatgcagcaggatgccagcgaggccgacattcaggcctggtacgaccagcataaagcggactattcgcagccacagcgtacgcgctacagcgtcattcagaccaaaactgaagccgatgccaatgcggtcctggcgcagctgaaagcgggtgccagcttcgctgacgtggcaaaagccaaatccattgacccgatctctgcgcgtaagggcggcgatatgggctggctggaaccctctacgacgccggatgagctgaaaaatgccggtctgactgagaaaggccagatgtcaggcgtcatcaaatcttcagtgggcttcctggtggttcgtcttgacgatattcagccagagcaggttaaaccactggatgaagtgcgcagcgccattgcagcgaaagtgaagcaggagaagggcgttgatgccttctacaaagtgcaacagaaagtcagcgaagcggcaagcaatgacaatgagtcactggcgggtgcagagcaggcttctggtctgaaagcgaaagagactggctggttcagtcaggatacgctgccagatgagcttaactttgatgcggtgaagcaggcgatctttaatggcggtctggtcgggcaaaatggcgcgccgggcaacaactccgatatcatcactgtcgatggcgaccgtgcctttgtgctgcgtatcagtgagcataaaccggaagcggtaaaaccgcttgagcaggttaaggcgcagatcactgacacgcttaagcatgataaagcgacgcagcaggcaaaagctcaggccgataagctgctggccgatctcaaagctggtaagcaggatgcgctgactgcagcgggtctgacgctgagcgccagcaagaccgttgatcgcaatgcgcaggatccggtggcacagactgcctttaacctgcctcagcctgcggaaaataaaccttcctggggtgtcagcgaagatatgcagggcaatgtggtactggtggcggttgataaagttaaaaccggcagcatgccgcaggcgcagattgacgaaatggtcaaaggcgtcacgcagaataatgcgcagctggcgtttgaagcgttactgcaaaacctgcgtaaagaggccaaaattaagtacggcgctgccgcacaaatgcagtaagcctcgcagaaactgcgcaacgactgtaacaatcaaaggccgcattcgcggccttttccatttctgaaatcccgcttttgagccttgcgtgcagtagtgccactctgtcgctgctgtttacacacaaggagaaacacagcatggctaaacctaaactcgttgccctctatctttcactcgcgctgggcggcgcactctgccacagcagcgtctctgcggcacctgaacctgtcagcgcagccgtcacgcagaactcacaccctgcatcgaagccggaagccgccgcgcagccacagcaggatcaggtcagcattaatgaagcaacagccgaacagctctctgccgttatgaatggggtggggctgaaaaaggcgcaggcaattgtgagctatcgcgaacagtacggaccgtttagcgcaattcagcaactcagtgaagtaccgggtatcggcaatgcgttgatagagcgaaatgcggcccggctgaaattgtgaagcagtacacatctgtgatgcttaacccacgatagacaggcgactctgctaaagtgaacaggtccaaccagttaattcacagcagcaggagagcatgaccatgcagaccaccataaaagtgcgcggctatcatctggatgtctatcagcacgtcaataatgcgcgctatcttgagtttctggaggaggcgcgctgggaatggctggaagaggtggaagcattccactggttgcaggaacagaaactggcttttgtggtggtaaacatcaacatcaactaccgtcgcccggccgtgctgggcgacgtactgactatcgaaagtgagatcacgcagttgaatggcaaaagcggcattattgcgcagcgtgttttgctggcaggccaggagaccgtggtggctgatgccgcactcacttttgtctgtattgatttgcggacccagaaggcggttgcgctggaaggggagttgcgcgagcgactgatgcgtctgatggcatgagccgataaaaaggcggcaacctggattctctgccgccacctcagacactcttagttaagaccgctttttgctttcattgccgccattacgccagcacgatcgttgagataaccctgcaggccattggcccgtaaatgacaggctgcacactcaccgcatccgtcacctttcacgccgttatagcaggtcagcgtctgctcgcgtaccagcgcaagctgctgccagtaatccgccagcgcccaggtttccgctttattgagccacatcagcggcgtctcaaaacgaacatcgcgcgccatgcccagcgacaccgcatggttcagcgctttgacaaactcatcgcggcaatcgggatagccggagaaatcggtctcacagacaccagtgatcaccgcttccgcttcgacctgataagcgtaaaccgaggccagcgtcagaaagagaatattgcgtcccggcacaaacgtactgggtaatccactggcctcgggattataagccggcaccggaatgttatcccgcgtcaggctgctgacggcgagttcgttcagcatggtgacatccagcactttatgcgcgcgcgcgcccagtttaatcgccaggtcgcgggccacatcgatctcttcccgatggcgttgtccatagtcgaaagtgacgcaatgaacatcatcatattgctctaaggcctgaatcaggcaggtagtggagtcttgtccaccgctgaaaactacaacagcgcgtttcatggcgttttcctgataattaattttgcgcttatggtaatgcctcagtccgccgctgaacagctgcatggcagatcaatgggcggcgggatccatgcgcggctgaaatcgaaccagcccagcgtattcagttcaatcccttcaacgcccggcggcgcgtagatttgatagcgataattgaacagtggcagcaggatgccgcccgtcatcagctgatgataaagctgatgcagcgagcgggcacgggtttcgtcgtcagcaatttgctggatagccagcagttgcgcctgaatctcttcgccctgcagtgtgggccacagcggccgccatagcgggtcagtctgcaaccagctggccagcgtaaagaccggcgcatcaccaatcagtctgtcgcccatcacgatatctgcctcatcaagcgggtcgatgccgtgccagttttttaccggatgaaaaacaaccttcagggtgcagccgtgctgttttaacagtgcaaccagcgcctgtgacatctgatgcagctcaaccggcaactgataatgcagcgtcagggttgccggtaagggaaccctgacagcatcaatcagcggcacactccagccaggtaacaactctttactgggagtgatgagtccctcatccagaggcaaccggctgacaatgccgctttgctggatcagctggaaaagcgtgcacgcctgatcaggggtaaatccggctcgcggccggcagaccagataacagaagccgaggctgatactgctgctgaccggttgcagcgtcctgagctctgtggcatcgcctatcgcaatctgcaccggatgacgacagctgctgccgagagcgggatcaaacagctgaggggtaatccagtactccaccgcctgcagcagaggacgctgcagatgccagcgcgcgtgactttcaatcctgaccagctcggcgctgaagtgcctgagtttccacggcccgctgcccgtgacgggatcgatgggatggggcagcaggcacaacaagtgggcgagccgatggggcagccagaaatcagggcgtcgcagtacgaaacgcaccgcaagcggatggggcgcatccacgctgaccacatcggccagcaacacactgacgcgcgtatcccgcaacagctggcggaattgcgccaccagttgtgcggcctgcagaggctcgtcgttgtgccacatcagctgaggccgtaaccagaataaccagccagatgacgcctcgtcatattgccagtgatgcgccagatcgccgaccggctcatcctgctcaaagcgagtcagaccggaatagatctggcgagccaggtgctgctcggcccgaccggtaatctggcgcggctctgtgctctccatcggacgatagtaggggatgcgcagaaccggcgtatcgtttctgccactgtccgcccattaatggccgcagcatattgatcagcctttccggcggcagatccagcagctgcaaggcctcagcggcgtctccggcgtcgagctgttgttgcagcaactgctgccgtaattgttcaggtgagcgcagaaacactatttgtccctgtttgccacggccaggctcgccgcgccagctgagccagcctgcatgctgccactgtgacagcaacgtgcgcagatgacgctcgctgcagatacagtggcgggccatctccgccacgcaggtttgctgtggggcgccctgactctgctgccacagacgctggaactgattaagacggttaagctggcgcatgttaaacccggaacagttttttaaaagtattcactattagttccgcaattaacaggcaatagtggagttcatctttcagcaggaggtaaatcatggtgcgtttagccgcgttcgatatggatggcacattattgctgccggatcatcagctgggtcagcagacgctggatagcctgcaggcgttgcatctgcgtggcgttaatctggcgctggcgacgggccgccatctgctggagatgcagatcttacgggaaaaaatgacattgcccgcgtggctgattaccggtaatggtacccgtgtacacgacaggcagggcaatctgatctttgcgcgtgatctgccctctgcggtcgccgaagaggtgatccaccgccgctgggatacgcacgccaccctgcatgttttcaacgatcaggggtggtttaccgatcacccacagcctgaactgctggtggcccatcagatcagcggatttggctatcagctgtgcgatcttaaaagattgcccgcgcatcaggtgacaaaaatctgctttatcgatcagcatcagcgcctctgtcagctaaaaacagagctggatgccgcactgggcgagcaggctaacatctgcttctctgctgtggattgtctggaggtgttacccgccagctgcaataaaggcagcgcgctggcactgttatgtgaccatctgtcgctgaccatggcggagtgtatggcgtttggtgatgcgatgaacgatcgcgagatgctggcgcaggccggacagggttttatcatgggcaatgcgatggcgcagctgaaagccgcgctaccgcatctgccggtattagggcattgcgagacacaggcggtgtctcactatttaaatcactggctggcaacacccgacctcgcgtattcccccgaatgctgaggattgccgtgaaccggacaggatgtccggttttttattccagctcgcgctgccatggcgtgatatcgccaatatgttttgccacccactcaggctgatagtagctatcgggataacgtttcgccgctgtcgcacagcagtgtcaccagcgctccctgctgattcgctgcccgtaggcgttttgccacctgcatcatgccccagaaattggtgccggtagaggcgccaggcttgcgtcccagaatcttttccagtttcagcatggcggccagcgttgcaccatccggcactttgatcatttcgtcgatcacgtcaggcataaacgacggctccactcgcggacggccaattccttcgatcatgctgccgcgcgcgctggtcagggtagcatcacgctgctgccagtaatcaaaaaacaccgaatgctgcggatcaaccaccagcagtttggtttccagtccctgataacggatatagcggcccagcgtggctgaggtgccgccggtgcccgcactcatgattatcgtatggggaatcggataaggttcatgctccatctgacggaaaatgctctctgcaatattgttattgccgcgccagtcggtggcacgttcagcataggtaaactgatccataaaatggccattgagctcccgtgccagccgttcagattcagcatagagctggcagggatcttcaacaaaatggcactgtccgccataaaaggtgatctgctcaattttacgcttcgctgtgctcgccggcatcaccgcaataaagggcagacccagcagccttgcgaagtacgcctcagaaacggcagtgctgcctgacgaggcttcgataatcggcgtatcctgtttaatccagccgttggagaggccgtagaggaacagggatcgtgccagccggtgtttaagactgccactgggatgggtactttcatctttcagatagaaccagataccgggaaagtccgccagatcgaaacggatcaaatgggtctcagccgatcgttgaaaatcagcgttaatttcgttgatagcgtggcgaatccagcaggtgtgcatctcaggtgtccggtaaaaaagtgatgcggctattttatggcacgtgcaggaaaaagagattgcacaattaccgctaaaatggcggtaatggagaaaatgattctcccggagccgcgaatgttagataaaactgaccttaaattgctctcactgctgcagcatgactgcacgctgtcgctgcaggcgctggcggatgccgtcaacctcaccaccacaccctgctggaagcgcctgaaaaagcttgaagatgatggcattattcgcgcacgggtggcgttgctggatggagataaaatcggactgtcactgacggcgtttatgtttgttaaaacgcagcagcacagtcgcgactggtatcaggcatttgtctcggtggtgagcagcatgccggaggtaatggccttttaccgtatggcaggcgagtatgattacctgctgcgcattcaggtggccgacatgaaaagctatgatgctttctacaagcgagtagtgaatggggtgcccggcctgattgatgtgacatccagcttcgccatggaagagattaaatacaccacggctttacctgtcgccccctgagggcctgagattgagagcagcgttgtgcgattattcagtcaattaagttggtattttctgcgggagtggcggcgctatctgggcgcggtcctcctgctgattgttattgctattctgcagctgctgccaccgcatgtggtcggggtgattgtcgatggcgtgacgcgtgacaacatgagcaccagccgcatcatgatgtggattgggatcatgctggcaacggcggtggtggtctatctgctgcgctatgtctggcgcgtgctgctgtttggtgcctcctaccagctggcggttgagctgcgcgaagatttctatcgccagctgagtcgtcagcaaccggcattttatctgcgtcaccgcaccggcgacctgattgcgcgcgccaccaacgacgtggatcgggtggtgtttgcggccggagaaggggttctgacgctggtcgactcgctggtcatgggctgcgtggtgctgctggtaatgagcacgcagatcagctggcagctgacgctgcttgcgctggtgccgatgcccattatggccatcgtgatccatcgctacggtaatcaactgcaccatcgctttaagctggcacaggccgccttctccagtctcaacgatcagacgcaggagagcctgaccagcatccggatgattaaatcctttggccttgaacagcatcagtcgcagcaattttccgatatcgcccgcgataccggtgaaaaaaacctgcgcgtggcgcgggtcgatgcccgtttcgatcccactatctatatcgctatcggcttctcaaacctgctggcgattggtggcggcagctggctggtctggcatggagagatgacgctggggcagctcaccagctttgtgatgtatctcggcctgatgatctggccgatgctggcgctggcgtggatgtttaatattgttgaacgcggcagcgccgcctggagccgcatcggcgcgctgctggcggaagcgccagcggtggaagatggcgataagtcactgccatctgaaccaggcacgctgcaggtcgcgattcgtgcctttaactatccggccagcgtgggtccggtcttaagcgatgtcagcttccagctgaaacccggcgagatgctggggctgtgcgggccaaccggcagtggcaaaagtacgctgcttagcctgattcagcgccactttgatattcagcagggcgacatccgttatcaccagatcccgctgccgcagttgcggctggacagctggcgcagccgtctggccgtggtcagccagacaccgttcctgttctcagacagcgtggcgaacaatattgcgctgggaaaaccgggcgcaacccagcaggagattgagcatgccgccacgctggcctgcgttcatgacgatatcctgcgtttgccgcagggctatgaaacggaagtcggggagcgcggtgtgatgctgtcgggtggacagaagcagcgtctttcgattgcccgggcgctgctgctgaatgcggaaatcctgattctggacgacgcgctttctgcggtggatggccgtaccgaacacgaaatcctgcataacctgcgcatctgggggcagggacgcacgctgattatcagcgcgcaccgcttatcggcactgacggaagccagtgaaatcctggtcctgcagcagggcagggtggtgcagcggggcgaccacgacgcgctgaccggcagggctggctggtatcgggacatgtaccgttaccagcaactggaagcggcgctggatgatgatgaaaatgagaaaggagtgccgcatggctaagtctgcacgcttgtggcctaccctgaagcgtctgctgagctacggtaagccgtggcgcaaatccctgtcgctggcggtagggatgctgtggatcgctgccgcggcggaagtgaccggaccggtgctggtcagctattttatcgacaacctggtggcgaaacatcagatgccctggggagtggtcgccggactggtggtcagttttatcctgcttcagctgctggccgccgggctgcactactggcaggcgctgttgtttaaccgagccgctatcggcgtggtacagcggttacgcagtgacgtgatgaatgccgcactctgtcagccgctgagtgcctttgatacccagccggtcgggcagattatttcacgcgtgactaacgacaccgaagtcatccgcgatctctacgtcacggtggtttcaaccgtgctgcgcagtgccgcactggtcggcgccatgatggtggcgatgttcagccttgactggcgtatggcgctggtggcgatgatgatcttcccgctggtactggtggtgatgttcatctatcagcgttacagcacgcccattgcccgtcgggtttcgcagctatctggcagacatcaataatggctttaacgaagtgatcagcggtatgagcgtgatccagcagtttcgtcagcaggcgcgatttggtgagcgaatgggcgaagcgagccgttctcactatctggcgcgaatggaaacgctgcgtctggatggttttctgctgcgtccgctgttgagcctgttttcagcgatggtgttgtgtgggctgctgatcctgtttagtttctcgatgcctggcgtgtttgaagtgggggtactctatgcctttattacctatctggggcgtctgaatgagccgctgattgagctgaccactcagcaatcgatgctgcagcaggcggtagtttcaggtgagcgtattttcgaactgatggatgctgcacagcagcagtatggtgccgatcaacaaccgctggcttcaggtcgtatcaccctgaacaatctgagctttgcctaccgtgaaaaccgcgatgtgctcagtgatatcaatcttgaggttgccccacgcgagtttgtggcgctggtgggacataccggcagcggtaaaagcacgctggcgaacctgttaatgggttactacccggtgacgcgcggcgagatccgcattgatgatcgacccattagcgacctgagccatgccgtgctgcggcgcggtatcgcgatggtgcagcaggatccggtggtgctggccgatacgctgctggcgaatgtgcggctgggacgcgacatcagcgaagaggccgtctggacggtgctggaacaggtgcagctggctccgctggcgcatgcgttgccggagggaattcatacccggctgggtgagcagggcaataatctgtcggtcgggcagaagcagctgctggcactggcccgggtgctggttgatctgccgcagatactgatcctcgacgaagcgacggccaatattgattccggcaccgagcaggctattcagcagacgcttgagacgctgcgccagcacagcacgctggtggtgattgctcaccgcctctcaacgattattgaagcagacaagattcttgtgctgcatcgtggtcgtgtggttgagcagggtacgcatcagcaactgctggcgatgcagggacgttactggcagatgtatcagctgcagcaggcaggtgaagatctggtatcgggcgtcgctgtaacaactgaaggctgagttgcaccttttttgcgcacctttatcagattaatctgtataaatgcactcctttgacgcctgaagcaccaaaggagtgcagccctccgctgcaattacccctgtacggcctctctgtttcccatcctctttaaagcatcccttgtcgcgtctcgcctgaacaacgtattaccgtcattttcacactctggcacaggctttgcttatatccctgcgtgtccgtaaacgttacctatttactcgctggaggggatccaatgaagctggttaccgtcgtaattaagccattcaagctggaggatgtacgtgaagctttatcctctatcggcattcagggactgaccgtctccgaagtgaaaggttttggccgtcagaagggccatgcagagctttatcgtggcgcagagtacagcgtgaacttcctgcctaaggtcaaaattgatatcgctattgccgacgatcagttagacgaagtggtggatgtcatcagtaaagcggcttacaccggcaaaattggcgacggtaaaattttcgtggctgaactgcagcgcgtcatccgtattcgtaccggcgagaccgacgaagccgctctgtaataaagactcagtactgtgatgggatggaataaaaatgaataaaattttcgctaagttgggcctcaccagcctggcactgttaccctcactcgcgatggctgcgcctgccgttgcggacaaggctgataacgcatttatgatgatttgcaccgcgctggtgctgtttatgtcaattccaggtatcgcgctgttttacggtggtttgattcgcggtaaaaacgtgctgtcgatgctgacccaggttgcggtcaccttctcactggtctgcgtattgtggatggtttacggctattcactggcgttcagtgaaggcaacgcattctttggcagctttaactgggtgatgctgaaaaacattcagctgaccgccgtcatgggaagcttctatcaatatattcacgtcgcgttccaggcctcgtttgcctgtatcacggtgggcctgattgtcggtgctatcgcagaacgcatccgtttctctgccgtactgatttttgtcggcgtctggctgaccctggcttacctgcctatcgcgcacatggtgtgggctggcggtttcctggcacaggatggcgcgctggactttgctggcggcaccgtggtgcatattaacgccgctgtcgccggtctggtgggcgcttatctggtgggcaaacgtgccggctttggtaaagaggccttcaaaccacacaacctgccaatggtattcaccggcaccgccattctgtatgtcggctggttcggtttcaacgccggttctgcttctgcagcaaacgaaatcgcggcgctggccttcctgaacaccgttgtcgcaacagcgggcgccgtgttgtcatggacctttggcgagtgggcggtacgtggtaagccttcgctgctgggtgcctgttcaggctttattgccggattagtagcgattacgcctgcctgtggttacgtcggcgtcggcggtgcattaattatcggcctggtaggcggactggcgggactgtggggcgtgaccaccctgaaaaaatggctgcgcgtggatgatccctgcgatgtgttcggcgtgcatggcgtgtgcggcattgtcggctgtatcctgactggcgtgtttgcctcctcttcactgggcggcgtaggctacgcagagggtgtcactatgggccatcaggtctgggtacagctctttagcgtgggcctgactatcgtctggtcgggcgttgtcgccttcatcggcttcaagctggctgatttgattgtcggtctgcgcgttccggaagagcatgagcgtgaaggtctggatgtaaacagccacggcgagaatgcttacaaccagtaatggatgggcagtgaaaagatcaaccgggggcgagtaatcgccccctttttttattcgctgcgctgacgcatcactccttcctgaaccgttgaggccaccagcacaccctgctgattgtagaactcgccccggacaaaaccccgtgcgcctgacgccgaagtactgaccacgctatagagcagccattcactgaagtcgaacgggcggtggaaccacattgagtggtcgatagtggcgacctgcatgtccggctctaaaaagcctttgccgtgcggctggagcgcgaccggcaggaaattgagatcggaagcatagccgagcagatactgatggatacgcaaatcgtcgggcagtgggccggtggcacggatccagacctggcgttcaggcttatccacatggccccgaagaggattgtgaatctgtaccgggcggatctccagcggacgctcagcaatgaatttttcacgtagcttttctggcagcagatgcgccattttctgcgccatcgcctgttcagttaacagattctctggccccgccacctgtggcatcggattctgatgttcaaagccgctttccggtgactggaacgaggcggtcatataaaaaatcggctgcccattctgaatggcactgaccctacgtgcgctgaaacttttgccatcacgcagcgtttcaacatcgtaaataatcgctttctgactatcgccgggccgcaaaaaatagctgtgaaaagagtgaataatgcgatcttccgccacagtttgctttgcggcatacagcgcctgacccaccacctgaccgccaaacacctgacgaaggccaatatcttcgctctggccgcgatataaaccctcttccagtttttccagatttaataaattcagcagattttgcagtgcctgactcatggcgcgttcctcaatatagtgacctgctcagtttgaaagatcggaccagttgacgtcaatcagactttctacattgtcggtgccaggcaaaatttcatttttgtgccaacattaaggacatacggcgagtgaagcgctgtaagcaggattcgctgccgacaatcattttgatcaaatggagacgacatcaatgaaactcaggcatgtgttcagtggagtagttatggcggttgctgttgtaggatgcgccgacaagagtaaacccgtgccaacgccaactctgggttctgcggttgcaggacagacggcggcgattgcgcagcccaacgtaagtggttcagtctttatccgccagcgcattgcgctgccgccggatgcggtattaaccgtgacgctctctgatgcgtccgtcgccgatgcaccctcaaaagtgctgtcgcagcgcgtggtgcgtaccgaaggcaaacaggcaccgttccagttcgtgctgccgtttaacccagccgacatcaagcctgatgcacgcattctgttaagcgcagccatctcaatcgacggtaagctggcctttatcactgaaggcgtgaagccagtgattaaccagggtggcaccaaagcagagctgctgctggtaccggtaccgtctatggcgatgccaacccagccgggcgcagcgaccaccgttccttcgacctcaccgactcaggtgacgccgtctgctgcggttcctgctccaactcgtctgtaaactcatttcggggcgacattgtcgccctttttaccctgtctaaactcgccagcgataagtttcgagatcgagctgtccatcatcactcacctctatgccttccgcctccagtgcatcccgctgccgcaacagacggtcaccctgaagagaaattgtgccgtgtcggtttacgacgcgatgccagggaagggtagtgccctcgggtaagcgactcagcacgccaccaacctgacgcgccgcgcgcggagaaccggccagtagcgccacatcgccataggtggtgacgcggccagccggaatagcggcaacaatttgccagatgcgttgctggaaagtgtctggctgattcatgtacttatttcatcaggaaaaagggttttaactttagcacggggaaaaggcggagaaagcgtaaaagcggtggttgttcaagaaaacaacggttgtcccgactacgcttgcaattgccacctccttcccagataatgcccccgctctcgtaaagagggcttgtcaatgggggccctgttggttctcccgcaatgctagcttgtgaactcggtcagatccggaaggaagcagccgtagcaggtgacgcgtgtgccgggatgtagctggcagggcccccaccactttctcccttcgatattctccccctaagctgcagacaggcaaaacccgcctgggccgatcctttgccggcaggcaggattatccggtactttattggggtaaaactgagctgtaagcgatcagattaacggacaaatttccatactgaacccgggactttatcgtagagcttgttcatcgtcagtttccgccaggcgatggtcagctgctgagtaaaataccgctaattcatcttccggtaattcatacttatttttttcaatcaccctttccagggtatcaagagagcggcagcgccgcagtcgcatcaaataatcggttttagtcagggttttgttcataaataaaccgttctcatgtctttactataatgaatggctcggttgctggagaaaagcgcactcttcagtgaacagattaaataagcgttttgctgaacgttgccaccgctgaagatccggactattgacaccataattgctgaatagcataaaagtatcatcaagatattcatcgatttgcgaaatcagcgcttcatcttcaacgtgcttaattttgtaattcatggtgaaagaggcgatatgctcaatcaaatcgttaagctgtagattgctttcagaagtgggatcattaacccagccatgatgactgtcggttaatgttgccatgctgtcgtcaaacagactctcacaaaggtatttaagctgggcaatatcatgccgtttcggtgagtattcgtccatctttttcccctccatagctagcacagttgccgcagggcggcgagagaagatcacgcggccaggaagcgattattcgggcagttattaaacgggataccttaaagatagtgtaaaaccattagttctgctcacctccattactaaatattacaattcatcgccaggggagggttgctcattgtcgatcacatcaaactcaagtgcaccgggcttaatgtgaaagtttacctgttctgactgcgtcacggtttcatttagatccaggcagggactaaataaattccagtcaaaatcgtaaagtaatttaaaactattcagatcctggtattcgaccgaaatgatttttaaactgcctggaactaaccgggcattttgtgagtaccagcgtaaatcccctaccagcaaatcggttattttgagaatattccgctgaacaatctctgctatttttgcgcagtccgattcacccgcggcaatatcacattcaatgcgtgacagcatatctgttccacttataaccgttaataaacctatcattggttttctgcaacgggtttgcaagtcagttgagcacaaaactctcagtttctgagatttgccagacgccgccgcaggccttatcgccagcgcgggtctgccagtgcgtgcagctgatatttatcttttgatacacaatcccacattcaacagagagcaacatcaggtatctttactgttatgttataacatcatggtgaggtaatgcgtcagagtggactacttatgtcactgggcgggcggctgggagtagcactgctatttatcacgctgcttgctgtggcaataaaatgggggatcagcacatgatcctgtttaacgcacttcgcgcgggctaccagggacaggttgtgaccccggctattaccggccagctcgcagccggctcgatgaccgcgctggtcggcgcgaacggtagcggcaaatcaaccctgttaaaaaccattgctggcttactgccaccgatagccgggcgctgcgagctgcaggttgcacgccgggatatcggctggttgccgcagcgcaccgaacttgagacccgctttcccctgacggtatttgaactggtctctattggctgctggccacgctgcggctggttcggcggcattaaccggatactgcgtcgggagatctggcaggcgctggaagcggttcagatgagtgattatgcggatgcgcagcccgcgacgttatccggcggacaactgcagcgggtattgtttgcgcggctgatgctgcagcgcagccagctctggcttctggatgagccttttaacggcattgacagccagacggtgacgctactgatgtcgatccttgagcagcaacagcaggccggaacaaccctgctggtggtgctgcacgatcgtccgctggtggcgcgctacttcagtaacgtgatgtcgatggatgaacgtgaggttaactgcacctgcctgcctgcttcctctctgcggagtcgtgcgccgtgaccctgattcaaccctttattgagtttggttttatgcgacgcgcgctggtggcctgtctggcgctggccgtcagcgccacgccgctcggggtattcctctccctgcgacgtatgagcctgattggcgatgccttatcacacgcggtactgcctggtgccgccattggctatctgatctccggattgtcactggtcgcgatgggtgttggcggcctgatcgctggtttagccgtggcgctgctctctggcgcggtcagtcgctacacgccgctgaaagaggatgccagttttgccggcttctatctgggttcactggcgctgggcgtcacgctggtttcattacgcggctcaagcgtggatctgctgcacgttctgtttggctcgctgctggcggtagacaacgcagcgctgttgctggtgggcggcatcgctgcctttacgctgattctgctggcggtgatctatcgtccgctggtcatcgatgcgtttgacggcgacttcctgcgtgcgcagggaaaatggagcgcgccgctggtgcatggtctgtttttaatgctggtggtgctgaatctggtggcgggttttcaggtgctgggcaccctgatgtcggtgggtttaatgatgttgcccgccgccagcgcccgcttctggagtcgccatctcgccgcaatgctggttatcgccattttcatggcaatgatttcggcgctggccggtctgatgctctcctggcacttctcattgccggcgggtcccgctgtagtgctgagcgccgccatgctgttttttttctccattcttacagggccgtgcggcggaattttacgccgccattaatcttaaggggtatctatgaaaaaattaccggttagcgtggcactcgctgcgctgtttgccacgcctctggcgatggccaaaacggtggatgtcgtggccagctttaccgtgctggctgacatcgttaaacaggtcggcggcgatcatgtaaaggttaaaagcctggtagggccgaatggcgatcctcatacttttgaaccgacaccgcaggacagtcaggcgctggcgaaggccgatgtggtgtttgtcagcggactgggactggaagggtggatggatcggctggtcagcgcctcagggtatcgcggtcaacccgttgtcgcctcaaccggtgtcaccactcgcagcatggaggaggagggtaaaaccgttaccgatcctcacgcctggaacagcatgcagaacggcgttatctacgcgaccaacgtgatgaatgcgctggtcaaagccgaccctgaagatgctccggccattcgtcagcgtggacagaattacattcagcaactgcaggcgctggatcgctgggcaaaaaccgcctttgacgctgtgccagccgataagcgtaaagtgctgaccagtcatgatgcgtttggttactttggacagcgatatggcgtgactttcctggcgccggtagggtttctctactgaggcggaagcgagtgccagcaacgtgggtaatttaatcacccagctgaagcagcagcacatcaaccgctatttcattgagaaccagaccgacccgcgtctggtaaaacagattgccagcgccaccagggcagagccgggtggtgagctctatccggaagcgttatccacggcctctggcccggcagccacttatcaggcggcttttaaacacaacgtgaatgcgatgctgaagagcatgcactaagcataaaaaaggccgggcaagcccggccagtcatcacgacacaaactagcgttttttctttcttccctgtactgctttaaaccgcgggttcgatttacagatcacgtaaatacggcctttgcggcggaccactttacaatcccgatggcgattttttgctgaacgcagcgagcttaatacctgcatgatcctctcctctatttctttccaagaaagcgcccgaaacgctggttaaagcgcgcggtgctgccctctttggcaaaatctttctgtttgccggtgtagaacacatgtgaggcagatgacacatccagggtgacgtagggcagcgtttcgccttcgaactccacagtgcgatcggttttgatggttgatccgattttgaaccagacatcagccgatgtgtcatggaagaccacgtgacgatagtgaggatgaatattcgctttcataatgcacacctatgtaatgttataatataacagtattatgcgatgcacaggccaggattgcaactgtccgtgagacaggaaaagcaaggggacaggaaaggagaagggcataatcgcaggcataaaaaaaggccgcttgcgcggcctcagatgatttacagcttagtgagtctggttatgctcaaccggatgactgttcgctgattcttcttttttcttgccaaagcggcggcgtaccaccacaaagaacacaggaacgaagaagatcgccagtatggtcgcggtgaccataccaccgataacaccggtacctacggcgttttgcgaaccggaaccggccccggtactgatcgccagcggcagtaccccgagaataaacgccagtgacgtcatcaggataggacgcagacgcatacggcacgcttccagcgcagcttcaatcagccctttaccctctttatccatcaaatctttagcaaattcgacgataaggatggcgtttcttggtggagaggccgatggttgtcagtaaccccactacgaagtagacgtcattactcaggccacgcagggtggtaaagatcagtgcaccaatgaccccgagcgggacaaccagcataaccgagaatggaatcgaccagctctcatacagtgcggcgagacacaggaagaccacaatcagcgagatggcatagagcgcaggggcctggttgcctgacaagcgttcctgataggacataccggtccagtcatagccgataccggcaggcagtttcgccgccagctcttccatcaggtccattgccgcacccgaacttttgcctggcgcagcctgtcccaggatttccatcgcaggcagaccgttgtaacgctcaaggcgtggtgaaccatattgccatttcgctgacgagaaggcagagaagggcaccatggttccgctgctgttgcgcacgtaccatttaccaatgtcgtccggcagcatgcgggcgtccgctttacccatgacgtaaactttcttcacgcgaccgcggtcaatgaagtcattgacgtaagagccgccccaggaagccgccagcgtggtgttgatatcactcagtgatacgcccagcgcctgtgctttctcctgatcgatcgtgagcttgtactgcggcgtatcttccatcccgttgggacggacgccaaccagcgtatcaggatgttgcgcaatcatgccgaacagctgattacgcgcttccgtcagcttatcgtggccaaggttattctgatcgatcagctcaaagtcgaagccggtcgcgttacccagttcaataatggctggcaggttgaaaggaatgaccattgcatctttgatcgcgcccagcgcctgcatggcacggccagcaatcgccggtactttcatgtcgctgccggtacgctcatcccacggcttgagactgacgaaggcgataccggtgttctgtccacgaccggcaaagccgaagccgttaacggtaaacaccgatttaaccgtgtctttctcctgggtcaggaagtaatccgtcacctgatccagcactttctgcgtacgctcctgggttgcaccagcaggcagctgcgcctgagccagcagcagaccctgatcctcttccggtaagaatgaagagggcagtcgcacaaacagaaacgccataccgaccacgatcaccagatagatcaccatatagcgacccgtactgcgaaccatgtgacccacaccatccacatagtggttggtgcttttgtcgaacatgcggttgaaccagccgaagaaaccggtggttttaccgtgctcgccttttttaatcggtttcagcatggtggcacagagtgccggcgtcagaataaaggcgaccagcaccgacagggccattgccgaaacgatagtgatggagaaactgacggtagataacaccggtcgaaccaccaaagaacgccatcggaataaatacggcagccagcaccagcgcgataccgaccagtgcgccctggatctgctccatagaacgcttagtcgcttcttttggcggtaatccctcttccgccattacgcgctcaacgttctcgaccaccacgatggcgtcatccaccagcaagccgatggccagcaccatcccgaacatcgtcagggtgtttatcgaatagccaaaagcgctgataacggcaaaggtacccagcaataccacggggaccgcaatggtaggaatgagtgtggcgcggaagttctgcagaaacagatacatgaccaggaacaccagcacgatcgcttcgatcagcgttttcaccacttcgaaaatcgagatcttaacgaaaggcgtggtgtcatacggatagaccactttcaaaccggccgggaacgtcggctgcaatttggccagttcttctttcaccgcattggcggtatccagcgcattcgcaccggtggccagcttgataccgataccggacgcaggcttgccgttataacgggcaacgatttcgtagttttccgcgccaagttcaatccttgccacatcacgcagacgaacctgagaaccatcttcattcactttcagcaggattttgccgaattcatcggtagaggtgagacgggtttgcgcaatgatcgaggcgttaagctgctgtcccggaaccggaggcgtaccgcccaactgaccggcagcgacctgggtgttctgcgtattcagggcgctgataacatcaaccggcgtcaggttgtagttgttcagcttgtgcggatccatccagatacgcatcgcgtactgcgcaccaaatacctgggtatcacccacgcctttggtacggctgatcgggtctttgatggacgatgaaataaagtcagaaatatcattctgcgtcatattgtcatcgtcgctgatgaagcccgctaccatcaggaagctactggaagatttcttaacctgaatcccctgttgctgtacttcctgcggtaacagcggcgtcgccagctgcagtttgttctgcacctgaacctgcgcgatatcggcatctgttcctgactcaaaggagatcgtcagggtcagcgtaccggatgagtcgctgcttgaggacatatacatcagtccatcaatgccgttcatattttgttcgataacctgggtcaccgagtcctgcagcgttttagcatctgcaccagggtaggtggcctgaatctcaatcgccggcggtgcaacattgggatattgctcaatcggaagtttgagaatcgatagcgcaccgaccagcataatgatgatggcgagcacccatgcaaagatgggccgatcgataaagaacttagccatgaatcaacggctcctgttatgacgatgacttgtcagactgcggctttgaatcgggtgccgctttcgcatcgtctgagacttcttgtggggtaacctgtgcgcccggcttggctcgctgcagacccgtgctgatcacacgttcacccgctttaacaccgtcggtgactaaccacttgtcgccaatcgcctgagaggtggtgacctgacgagcttccactttgttatctgcacctaccaccatgaccgttgcctgacccgttggggtacgggctaccgcctgttgcggaaccagcaacgcattaggattggtaccttcatccagacgagcgcgaacaaacatacccggtaacagcgcatggttcgggttcgggacaatggcgcgcagggtgatagaacccgtggtttcatcaacggtaacgtcagagaaactccagcgtacctgtctgtggatagctgttgccgttctgcatcagcagggtcacgttggctttgccatcgttctgcttcagctgacccgactccagttctgaacgtaagcgcatgaaatcttcgctcgactgggtaacgtcgacatacatcgggtcaagttgctgcacagtggccagggcggtggtttgtgcgttttgtaccagcgcaccttccgttactgacgatttgccgatgcggccactgataggcgaggtgactttggtataagccaggttaatgcgggccgtttctacattggcttttgctacctgaaccgcagcatcgttttgcgcggccgtggcaacggcggtgtcgtaatcctgctgactgatatatttggtgccgagtaaaggcttataacgtttgacggtcagctgagcgatgcgagcattggcctgcgcctgagttaagtcacctttggcgctgtcataggcggcctgataggtagcaggatcgatctgataaagagactgacccgctttgacatcgctgccttcaacaaagttacgcttcagaatgataccggaaacctgcggacggacttcggcgacacgatatgccgaggtgcggccaggtaattcagtcgagattttcaggggttcagttttcagtgttacaacccccactgctggcggttgctgggcggcttgttcggatttattgttgtcacatcctgttaacaaaaagctgcctgatagcatcaggacggccgccagaggcgataatcctctgattttattcataaataaacctctagtgtccgatatcaattggtcaatggatcacaaactgaaaaacccattgctgtgtcaagtcgcaggtcatgctatggtacatacattcgcaaatgtatgtaaacttacctgtttgtaaaaaaagccccttatggcacgaaaaaccaaagcgcaagcacttgaaacgcgacatcaaattcttgatgccgccattgttctgttttcgcagcagggcgtttcagccacttctctggcggatattgcaaccgctgccagcgtcacgcgaggggccatctactggcacttcaaaaataaagccgatgtattacatgaaatatggcttcgttgtgatgctggtctggacgatgtggaacttgagtatcagacaaaataccctggcgatccactctctgtgttgcgagcgatgctggtctatatctttgacgcgacagcaaaggatccgcagcgccgcgccttgatggagatcattttccacaaatgtgaatttgtgggcgaaatgtcggcgctgaagaatatgcagcagagcttactgctggagtgctacgacaaaattgaagaagtcctgcgccagtgtatcgaagccggacaacttcctggcagtctcagcacgcgtcaggccgctcttatcctgcgcggttacgtcaacggtatgatggaaagctggctgtttgcgccggacagttttgatttagccggagacgcgccgacgctggtcaatgcctttatcgatatgctgcgcctcagtccgacgctgactgcccaccactaagccgatgggcgatcacgcttgttttcgaaatcgcgctgcaccatggccagcgctgagagcacggtttctatcggcagttgatgctcttccagtagctgaatcagatcaactgccagtttgacgtcgtcaggggcattttccagtgacatctcttctcctaaatacgtagtcgggccgcgaccagcagcatcactaatgcaccgagaatcgccatgcccagtgcgccaatatgcagcgttgccagggtacccaggtcaaaataggtggcgatatagccgccaatcagagccccgatcatcgacagcgtcagggtagcaaccaggccgcccggtggtcccggcatcagcaggcgcttcagcaaccccagcagtaaaccgcttaacagccacacaagtaaagccatggttcttctccgcgccgaatcacacccagtataggagcgcttttgtcacgctgcgctttattcgctgccgcgcaacgaagaggcccattcgacagagcgaatcgcctgccgacagcgtgccagtcgctgctctaacgtttccagatcctgtttcagctgatgctgtaccgccagcgtttcggccagcgccagccgctgctcacgctgatcgatcattgccagcaaacgccgttcaaattcacggtactcctgatattttgcggcgcgtgggttcctgacgggctgttcgcgtcgggtacgcagctgttgcgtactcgcctcacgttgcagggcggctatctgatcgaccaggcgttcagccagccacgcactgcgggccagatcgtggctgctgtcgcagagccgggcaaaattctgttccacttccagcaggtaatcagccagccgcgtgcctttggtgcgaaacagctgagtatcaaaacgtggcagacggcaaaccccatctgaatggcaggcgagttcctgccgcagggcgataaggagctgttgcaggcgctgttgtatggcgatcgcactcatcgcgtcacgctcaattgtgctaacgtacgctgatgaggaaagagttgggcggcattcatgcaacgcattctgttattaaccctcggctggctggcgattgtgctggggacgctgggcattgtattacctttattacctaccacgccattcatgctgctggcggcctggtgttttgcccgttcatcgccgcgttttcatcactggctgctgtggaaatcgccatttggtcgctatctgcgccactggcagcagcatcgcgcgatgccgccaggggctaaagtacgcgctatctgcctgatagtcgccacctttagtctctcactcttcctggtgcatcagctctgggtacgcatcatgctgctgatcatgctggcggcgctgctgctgtttatgtggcgtattccggtggtggcagaagcagcggacgcaccgccgccgccgcgataaagttgcatttagccggtcatttgcttagatttgggcgtcttcgtgcgtggcttccctttgtgaattgacttccgctgagcctgttatcaggtattagcgcttttgaagctgcgcgaaacagaattttttaccaggcgtatcattatgaccgacactgcgcagcagcttgaattcattaaaaacagcattaaaagcattcccgattatcctaagccaggcatcctgttccgcgatgtcaccagcctgctggaagatcccaaagcctatgccgcgtcgattgcgctgctggttgagcgttaccgtaataaaggcatcactaaggtggtggggacggaagcgcgcggtttcctgtttggtgcaccggtggcgttaggcctcggcgtcggttttgttccggtgcgtaagcccggcaaactgccccgtgaagtctacagcgaatcctatgagctggagtacggcaccgataagctggaattgcacaaagatgccatccagccaggcgatctggtgctggtggttgacgacctgctggcgaccggcgggacgattgaagcgaccgttaaactgattcgtcgtgcaggcggtgaagttaaagacgcggctttcattattaatctgttcgatctgaccggagaaacgcgtcttaatgccatgggcgttgagagctacagcctggttaaattccccggccactaagccactctttcggccttgccatccggcgaggccgtcacgccttcggcgtcaagataacgagtgccagccaaaagcgtagctgatagactactgcaatcttatacaggggttgcagagcgtctgcgctcatctttccatccaacttcgtcgaactccacatgagctatcaggtacttgcgcgaaaatggcgtccccaggcttttgctgatgttgtcggtcaggaacatgttctgacggcgctggcgaatggattgtctctgggacgcatccatcatgcttatctcttctccggcacccgcggagtagggaaaaccactattgcgcgtctgctggccaaaggccttaactgcgaaaccggtatcactgccaccccctgtggtcagtgtgataactgccgtgaaattgagcagggccgctttgtcgatctgattgagattgacgccgcatcgcgtaccaaagttgaagatacccgcgatctgctcgacaacgtgcagtacgccccggcgcgtggccgcttcaaagtctatctgatcgatgaagtgcatatgctgtcgcgtcacagcttcaatgcgctgttaaagacgctggaagagcccccttcacacgttaaattcctgctggcgaccaccgatccgcagaaactgccggtgaccattctctcgcgctgcctgcagttccacctcaaagcgctggatgtggatcaaatccgtcagcagcttgagcatgttctgaagcaggaacagattgagagtgaaacccgggcgctgcagctgctggcgcgggctgccgatggcagtatgcgtgatgcgctgagccttaccgaccaggccattgccatggggcagggcgcggtgaccagcagtacggtcagcgtcatgctcggcacgctggacgatgaacagccgctggggctgctggaagcgctggtcgacggtgacggtcagcaggtgatgaatctgttgagccaggccgcgtcacggggtgtggaatgggaagcgctgctggtagaaatgctgcgcctgctgcaccagattgcgatggtgcaactgctgccgacctcgcttaatgacgatgatgagagtaacgcccttcgcttgcgtgaactggcgcgggtggtgccgcccgccgatctgcaactctattatcagactctgttgatgggccgcaaggatctgccgattgcgcccgatcgtcgcatgggtgtggagatgacgctgctgcgtgcactggcgtttcatcctaaagctgccgtagctgaacccattgcgcgtcccgcattaactcagcagacggcgcctgtcgcccctgcgcagacatcaccggcagcatccgggccatcgccgttagcacggcaaccggcagcacagccagcctcaccgtcacctgccgctgcgccgccgtcgcacaccgcgtcgcccgtcgcgcagcagactcaacagcagatgccggagcagacgcagcagcaggttgctgctcagccgcagatggccgcgcccgatgctgcaccgcagcattcgccgtcgccagatgtcacacctgacaccgcactctccagttccaccagtcagctcctgcaggcgcgcactcagttgttgcgtcagggagcgaacaagccaaaaaagcgtgagccggcagcgccaggtgcgcggccggccaactccgcgctggagcggctggcctcggtcaccgagcgcagtcagcagcgtatccgcgatcgcgagcctgccgccccggtaaaagaggaagcgtaccgctggaaagcggttaatcagccggtggaagtggcggagccggtggcgacgccaaaggccttgcgttctgcgctggagcatgagaaaacccctgagctggcggcgcgtctggccgaagaagcgcagcagcgcgatccctgggccgcagagattgcgatcctgccgctgccgaaactggtgcagcagctggcgttaaatgcctggaaagagaccaccgaaactggggtctgcctgcatttgcgtagcagccagcgtcaccttaattcaccgtcggcgcagcaggtattaagcgatgcgctgagtcagcatgccgggcagagagttgaactctcggtagttgaagacgataattcatcggtgttgacgccacttgaatggcgtcaggccatttacgaagagaaactggcgcaggcgcgtcagtcgatcacctgtgatacccacattcagacgctgcagcgcttttttgatgccgatctggatgaggagagtatccgacctgtttgaacacgctgctgctatcttaacgatagcgttgtagcctcagctgagagagaaaactatgtttggtggtaaaggcggattgggcaacctgatgaaacaggcccagcagatgcaggacaaaatggccaaggttcaggaagagattgccgcgattgaagtgaccggtgagtctggtgctggcctggtaaaagtcaccattaacggcgcgcacaactgccgtcgcgtggaagtcgatcccagcctgctggaagatgacaaagatatgctggaagatctgattgcagccgcgtttcaacgatgcggcacgtcgcattgatgaaacccagaaagagaagatggcttctgtctcttcaggcatgcagctgccaccaggctttaagatgccgttctgatgcaaaccagtccactgcttgaatctttgatggagtcgctgcgctgtctgcctggcgttgggccgaagtcggcacagcgcatggcgttccagctgctgcagcgcgatcgcagcggtggcatgcggctggcgcaggcgctgacccgggcgatgtcggagatcggacactgcgccgattgccggacattcaccgagcaggaaatttgcaccatctgcgccaatccacggcgtcagcagaatggtcaaatctgcgtggtggaaagcccggcggatattcacgccattgagcaaaccggccagtttggcggtcgctactttgtgctgatgggacatctctcgccgctcgacggcatcggtccggctgatattggcctggaccgtctggagcagcgactggagagtgaaaccctgcaggaagtgatcctcgccaccaacccaacggtggaaggcgaggcgaccgcgaactacatcgcggaactctgtggtcagtatggcgtcgacgccagccgtatcgcgcacggcgtgccggtgggcggtgagctggagatggttgatggcaccacgctgtcccattcactggcgggccgccagaagtttaaattttaatcacttgccggtgttgtgacagacaccggcttgaaaatctccctgtcacccccacatcaacctcaacgtttgttcaacctgttttgttgaggtagcaatgaccatgaaaggacaagagacccgtggctttcagtcggaagtaaaacaacttctgcacctgatgatccattctctctattcaaacaaagaaattttcctgcgtgagctgatctccaacgcctcggatgcggcagacaaactgcgcttccgtgccctgtcagattccagcctgtatgaaggtgatggcgagctgcacgttcgtctctctgttgataaggacaaccgtaccattacgctcagcgacaacggtatcggtatgcgtcgcgatgaggtcattgagaacctcgggactatcgccaagtcaggcaccaaatccttccttgaatcgctgggctccgatcaggcgaaagatagccagctgattggtcagttcggtgtcggtttctattctgcattcatcgtggcggataaagtcacggtgcgtacccgtgccgcgggcgcgtcagccgaagaaggcgtgttctgggaatccgcaggcgagggcgaatataccctggctgaaattgagaaagccgatcgtggtaccgagatcaccctgcatctgcgcgaaggcgaggatgagttcctggatgcatggcgcgtgcgcaacatcatcagcaaatattccgatcacatcgcgctgccggttgagatcgaaagcaaagatgaagaaggcgaagggacacactgggagaagattaacaaagcccaggcgctgtggacccgcaacaaatctgagatcagcgacgaagagtacaacgagttctacaagcatatcgcccacgattacagcgatccggtcgcctggagccacaatcgggtggaaggtaagcaggaatataccagcctgctctacattccggcgcgtgcgccattcgatatgtggaaccgcgatcagaaacatggcctgaaactctatgtgcagcgcgtctttatcatggatgacgctgagcagtttatgccgaactatctgcgctttgtgcgtggcctgattgactcgaacgatctgccgctgaacgtctcccgtgagatcctgcaggatagccgcgtgacccagagcctgcgcgccgcgctgacgaagcgcaccctgcagatgctggaaaaactggcaaaagatgacaacgagaaatatcagaccttctggaatgagtttggtctggtgctgaaagagggcccggcggaagatcacgctaaccaggagacgatcgctaagctgctgcgtttcgccactacccagagcgaaggttcagcacagaccatttcgctggaagattacgtcagccgcatggtggaaggtcaggagaagatttactacatcaccgctgacagctatgccgccgcgaagagcagcccgcatctggaactgttccgcaaaaaaggcattgaggtgctgctgctctccgatcgcatcgacgaatggatgatgagctatctcactgagttcgatggtaaaaccttccagtcagtcagcaaagcggatgaatcgctgagcaagctggcggatgaagagaccgaagagcagaaagaggcggaaaaagcgctggagccttttgttgagcgggtgaaaactctgctgggcgaaacgtgtgaaagaggtgcgtctgacgcatcgcctgactgatactccggcgattgtcaccaccgacgccaacgagatgaccacgcagatggcgaagctgtttgccgcggccggacaggaagtgccggaagtgaagtacctgttcgaaatcaacccggatcatccgctggttaaacgtgttgcggatacgcaggatgaagcacgcttcggtgagtggattgagctgctgctggatcaggccttgctggccgagcgcggcacgctggacgatcctaaccagtttatccgccgcatgaaccagttgctgaccgcataatggcaacaggccggtggttttcaccggcctcagacggctgataaagccacagcatcaagccggtgaccctcaccggctttttttatggttttgcggcatcctgcagccagtcgcgaaacaggctgatctccatatcgtgccgacggctctgttttgtcatcatccatgtggcccgctcgacgcgtacaaagccaagcggcgcaagcagcgtgccatcctccagctctttgcgtaccagcaaacgcggtgccatcaggacgccaagaccacttcgtgcggcctgaatccccagtgtcagactctcaaaatgcttaccgccgttaaaacggccgctgaccccagctttgtccgcccactctgaccaggcgtgcagccgggtatccgcatgcagcaggggcatcgcggccagatcctcgccgccccgcagctgcgaggcaaagtgaggtgcgcagagcggcccaatctcatcctcgctgaccagcgtggcgtctatgtcagattcagggggctcgccgtgactgaggatcagtacatccacatgttcgctgcgcagttgcgagatctgcgtcagcggctggaagtgaacctcaatctccggatagcgttgataaaaactggcgatacggggaatcagccattgcgacaaaaaactgggggcgcaggatacccgaatctgctgaagcagcccggtacgaatgctttcgcagctgctgcgcaactcactgaacgcctgctgacagctcagcagcagacgttcaccgtgtgaggtcagtttcacgcggccatggctgcggacaaaaagtggtttgcccatccagctctccagctggcgaatctgatggctgatggcgctgtgcgtaacatgcagatgttcagccgccacgctaaaactgctgtgtaaggctgcctggtgaaaatagtgcagcgctctcagtggcggcagtccgttcatcctcttcccctgtgcaaaaatctaacagggattgtcaatttatatcattttaaagtccagccgcattgacctactctgtagggcaaattctggcgggttgactcagccttatatctgtgatttttcagggtattccgcctcgcttaaccagcgttcacgccgcacactccccgaagcgagacaaccatggcacaccgctctttatcctctgaaacttcagcagaggcgcgccatcggttacgcctggcgctctcacgcttttaccggctcgagcagttcgatctcttcttcgcgccctcgctgcatgtggcgcaggtccttctttctcagctctttctgcggcaggagcaggcgcgcaatcagcatcgttacgcctcgcactttccggtaaccgaactcaacatcctgccagcagttccgctgatcgctggcagcatcatgctggtaccgcatgtcgaattgcccaatggccgcgtgcgtccgctgcgggattgccagaaccagggcgtgacggaggcgagcgagagttttgccagcgtgctgcatcagaaactgatcgacgaagcccatctgtttgtcacccgactggatcgccacgccgagatctgcagcgatctggtgctggtggcgttgcggacacatgacttcagtacgctggtgcgcagcgaactgcggcttttcgaacaggggctgaccctgaccgccacgcatgaggcactgcgccgcttcgacgatccgcactggcggccttacaatgccgccaccgtcgatgcgctctccctgtcagacccgctgccgctgaactcctgccatcagcccggtttgccgtttgccagctttaatgtcccggcctccgtgatcacatcgctgtcagatgcggaagatgtggtgaaatggccgcagcaggcgcggctgctgctgaatgctaacgtgcgcggcagcggcaaaaaaagcgtgaatatgacccatcatctgagccgacgactgcaattcctgctcggctcaggcggtaaatctgaaaaagcgtccggcaggccaggcgggtaggggtcagggccaaaaagcgactcaggtcgccctgcgcgatccgcgcccttccttgtgatgagcgggtcataatggtatgttctttcgcttctaagatagatcaatgcgattcgcaaggggatttacgcaatgcgtattattctgctcggagctccgggcgcaggtaaggggactcaggcccaattcatcatggagaagtatggcattccgcaaatctccaccggcgacatgttgcgtgcagcagtaaaagcaggcagcgagctgggcaaccaggcgaaagccatcatggatgctggcaaactggtgaccgatgagctggtgattgcgctggtcaaagagcgtatcacccaggaagactgcaaaaacggtttcctgctggacggtttcccgcgcaccattcctcaggcagatgcaatgaaagaggccgggatcaccgttgatcacgtgctggagtttcgccgtaccggatgaactgatcgttgagcgtatcgtgggccgtcgcgttcacacgccatcaggccgcgtttatcacgtcacttttaatccaccgaaagtggaaggcaaagatgatgtgaccggcgaagagctgaccatgcgtaaagacgatcaggaagagaccgtgcgtaagcgcctggtggaatatcatcagatgaccgcgccgctgattgcttactacagcaaagaagcggaagcgggcaacactgcctatcacaaaatcgacggcacccgtaaggtgaccgaagtcagtgccgagctggctaagatcctgggctaagttcacaggggccggtattactggccccttttgcagtaatcgcttttacctcccactaattccgctacaatttccccgttttcacgcatccccgttgttatcaaggaactcaaatgaggcaagataaggccggcgtgttattggttaatttaggtacgccagacgcgcccaccacacctgcagttaaacgctatctgaaacagtttttaagcgatccgcgcgtggtcgatgcgccgcgctggctctggtggccggttctcaatgccgttattctgccgtttcgctcgccgcgcgtctctaagctctactcatcggtctggatggaaggcggttcaccgctgctggtttacagcatgcgtcagcgcgatgcgctggcggcacgggtcgatatgcccgtcgaggtgggcatgagctacggtaatcccagcctgaaaagcgcggttgataagctaatggcgcagggcgtgacccgcctgattgtgctgccgctctatccgcaattctcctgctccaccgtggcggcagtgtgggatggcctgaccgcggtattcaaagattaccgctcgctgcctgatgtgcagtttatccgcgactacgccgaacatccggcctatatcgccgcgctgaaagcgacggtggagcgatcctttgagcggcacggtcagcccgatctgctggtgttatccttccacggcattccgcaacgttttgctaacgaaggcgatgactacccgcagcgctgtgcggataccacggcggccctggtcaaagcgctgggcctgcgtgacgatcagtatatgatgacctttcagtcgcgttttggtcgtgagccgtggctgatgccctacaccgacaaaaccatggaaagcctgcccgctaaagggatcaaacatgttcaggtgatgagcccgggcttctcgtcagactgcctggagacgctggaagagatcagtggtgaaaactgcgaaatctttatgcatgccgggggtgagaagtttgagtatatccctgcgctgaacgccgatgaggcgcatatcgacatgatggtgcaactggtcgacgcacgccgttaaagcgcaggcggagagtgtgatatcattctccgcctgtttttccagacggcacctcccgatgaaatttcccggcaaacgcaaatccaaacactactttcctgtcagcgcacgcgatcccctgttacagcccgcccagcacgatgttgatgcaggcagctgggtggtgggtatcgaccagacgctggtggatatcgaagccaaagtcgatgacgcttttctcgcacgttatggcctgagtgccgggcactcgctggttatcgataatgccgtcgcggaagcgttgtacaacgagctgatgcaggaagcgctgatcacccatcagtttgctggtggcaccatcggtaacacgctgcataatttctcggtgctggccgatgaccgctccgtgctgctgggcgtcatgtgcaataacatccagattggcggctacgcctatcgctatctctgtaacacctcaagccgggtcgatcttaactatctgcagggcgtggatggcgccattggacgctgctttacgctgattggcgaacatggcgagcgaacctttgctatcagccccggccagatgaaccagctgcatccggataacgtaccggaagaggtgatcgccggagcctctgcgctggtactgacctcctatctggtgcgctgtgccgaaggtgaaccgatgccacaggcaacattgcgggcgattgagtatgccaaacgccacaacgtgccggtggtgctgacgctgggcaccaaacatgtgattggcgacaatcctcagtttctggcgcgatttcctgcgcgagcatgtcagcatcgtggcgatgaatgaagaggaagcgctggcgctgaccggcgaaagcgatccgctgctcgccgccaatatggcgctggactgggtcgatctggtgctgtgtactgctggcccgattgggctctatatggcgggttacaccgaagaagagttcaaacgcaaaaccaaccatccactgctgcctggcgcgattgctgaattcaaccagtatgagttcagccgggtgatgcgccagcaggattgccagcagccgctgcgcattttctcgcacatcgcgccttatatgggcggaccggaaaagatcatgaacaccaacggcgccggagatggtgcgctggcggcgttactgcatgacatcaccgccaacaactatcacagcctgaatgtgccaaactccagcaaacatgcgcgtccttacctgacctactcatcgctggcgcaggtatgtaaatatgccaaccgcgtcagctaccaggtgctgaatcagcattcgccgcgtctgacccgcggtctgccggagcgggaagacagtctggaagagtcttactgggatcggtaaagctggcagctgccgcgcataaaaaagcccttctgaagagaagggccttagaagactggcaacgtctggctcggttagcgatgagatcgagcctgttaagggaacacggtcagatcggaaaattgctaagccatccgtagccgggcgaactcttcgcgttgttcaaaaacgctcccggcgtttttagtacgcacctcatccctgaggtgcgcccatagctgggccaacgctttgcgttgttcaaaaacgctcccggcgtttttagtacgcacctcatccctgaggtgcgcccgtagccgggccaacgcattgcgttgttcaaaaacgctcccggcgtttttgtcccggtcggcgggacgctttcctcttctgcccgtgttccctgcgtgttgagtttattcgttgcggtaaaattcaccctgattttgatagagcagtagcctgccagtctttgcttaacacgaatcagcgcacgacatcgcagggctgtaaatcttcgccctgggtcatctcatcctgcaggatttgaagcatactgctggcgatctcacgttcgcccatcaccacgcgtgtagcaccccgttccatgatgtactcgacttcatcgtcatagtgggcgcgggcgataatctcaatattctgatgtttttcacgcgcggcggtgaccacttcacccgcttcatagccattcggaatagtcagtaacagccagcgggcgcagtcgagtcgggccagttccatggtgtcagcgcgggctgcattacccagcaccgccttaataccgcgctcgcgcagcgcttcaacacgggcgcgggagttttcaactaccaccagcggaacattggcttcaagcagcttctgaccaatcagactgcccacccggccgtaacccacaatcaccgcgtgattgcagaaatccaccgggatctgcttctcttcttcaatcgcctcttccagcgtctgctcttccatcgtctccgttttcgccaggaaacgctccagcagggtaaacaggatcggattaagcataatcgacaggatggcggcggccagcaccaggttgcggccctcgtcagtcagcaggcccagcgagatacccagaccggccagaataaaggcgaattcaccaatctgcgccagactgaccgaaatggtcaacgccgtacgacgtgaatggccgagcagcgacaccagcagccaggcggcgaccgatttacccaccacaataatcaccagcgcgcccagcactgccagcggctgcgtcaccagaatcgacgggtcaaacagcatgccgaccgagacaaagaacagcacggcaaaggcatcacgcagcggcagcgtatcgcgcgcggcgcggtggctcagtttccgactcgttcagcaccataccggcaaagaaagcgcccagcgcaaacgaaacatcaaagaattcaacagcaccaaaggcgatgcccagcgccagcgctaataccgccagagtaaacagctcacgcgagccggtggcggcgctgcgggcgaggatccaggggacggcacgccgtcccaccaccatcatcagcaccataaaggcggcgactttgccgatggtccacagcaggtcccaggccagcagtccggcgctggcgttgccctgttccatcatgccggcaatcgcaggcagcagcaccagtgtcagcaccatcaccagatcttcaacaatcagccagccaatcgcaatctgcccgcgctggctatcgatcagttgccgctcttcaagcgcgcgcagtaacaccacggtactggcggtagagaggcagagaccaaacaccaggccggtcatccacgaccatcccattgtccacgacaagcccattcccagtaacgtcgcgaccgcgatctgtgcgatggcaccgggaatggctatcgactttaccgacatgagatctttcattgagaagtgcaggccgacaccaaacatcagcagaatcacgccgagttctgccagttcaggagccagattggtatcggcaacaaagccgggggtaaagggtccagccagcacgcctgccatcaggtagccaaccaggggcgaaatacgcaggcggttcgccagcatcccaaggagaaatgccagaaccagtgctccgacaatggtagtgatcaacggtgtggtgtgatgcatgcctgtctccttgtatacaaatgtatccgcttgtaacaaatgagtttaaaacaaaatctattctttcgctgagcaatttgcgggaataccctaaaaaagcaggaaaaaaagtcaaatgcacaatcgaaagggtgtttttgttcattatccataatattggctgatttgacggtttaaagcggtccgggtaaataaaaattagcatccttaaatgccgtgggtatgacacaaataagggttaaatgcgcgcacagacagggtaaagcccgtcagcggcacttttgcaggggtaaacaactggttaacatcaggcctggctacccgttctggcttatccggaacaaaccagtctgacgctggcgcggccttgcggctattgtcatgctcagcaaaagcggtccggagataaaaagagcggcatacagagacaggcgaatgtgcgttggccttgagttcgccgggggaatgtgcgacacagtggggcaaaccggcagaaaatcgggccagacggcaaattaaggagaatcacagtgttgttatctaaatggacaggggcgggcgtggcactactggtggccctgatgccgctgttttcacaggccgcccaggccgatcgcacctatcgtttcagcctgctgcacaccaacgatgagcatggtcatttctggtttactgagcagggtgaatatggtctggcggcgcagaaaaccttaatggatacgatgcgctacgatgtgcagtccagaggcggcggcgcattgattctctctgccggtgatgtgaacacgggcgtgccggagtccgatgagctggatgctgaacccgattttcgcgcgatgaacctgattggctatgatgccatggcgctgggcaaccatgagttcgacaagcccatcgcggtcctgcgcaagcaggagaagtgggcgcgattcccgctgctcgccgccaacgtttatcagaaaagtaccggtcagcgcctgtttaagccctgggcgttattcaatcgtctcgggctgaaaattgcggtggtcgggctgatcaccccggacacggcgaaactggccaatccggcgggcctgacagataccgagttccgcgatccgattgcggaggcggagaaggcggtggccgaactgcgcgccacagagaagccggacgtgattgtcgcgctgacccaccttggtcactatgacgacggtaagcatggcagcaatggcattgatgacgttaccctggcgcgcagcctgcctgccggcaccatcgatctgattgtgggtggtcattcgcatgatgcggtctgcatggaaaaagagaacgtcagcgttaaaaattatcagccgggccagccctgcaaacccgatcagcagaacgggatctggattatgcaggcggataaatggggcaaatatgtcggacgtggtgacttcaccttccgtaacgggcaggtgacgctggaggcttatcagctggtgccggtcaaccttaaacatcagataaagaacgcggatggcagcgaaacctggctcacctggcaggaagagatcccgaaaaacaccgccatgatgaaactgctgatgccattccagaaacgggctgaggcgaagttaaccgtgaatgtcggcagcgccgacggcaacttcagcggtgaaaaagagcaggttcgctttgagcagacgaatctcggccagctgattctgcgcgcccagatggcgcacaccaaagccgattttgcggtgatgagcggtggcggtattcgcacctcgctgaaatcgggcaagctgagctggcgtgacctgctgcaggtccagccgtttggcaatcaggtggtctcggtcagcctgaccggggcggagatcaaaaaatatctggatgtggtcgctaatattcagcctgactcaggcggctacgcccagtttgccggcatcagcctgaccgcagacggtaaacatgtcagcgacgtcagcattaacggtaaaccgctgcaggatgcgcagcattatcgcatggcaaccaacagcttcaatgcggctggcggcgacggttatccgcgtctggataatcatgcgggttatctcaacagcggggtagtcgatgcgcaggtgttgcgtgactggatcaagacgcactcgccggtcaaagccagcgactatcagccgaaagggcagattgtgcatctgaccgatgagcagatccgggcgcgggatgaagctgcggaaaaagcgcggaagcgtaactatcccaaaatgatcctggcgtggatctggccgtgggggaatgaaacagccgccacgcattgaactgaccgggaggcgcttgcgcctcccgtttttcttacgcccggcaggggtgacgtttgatccagcgctcgcgcagtttgtcccacacccagttgtaggccatggtgtagggcaggaagaagaggaaaaaggccacttcgaccaggaaagcctgacccagagagatatccagcatccaggcggcaatgggcagaccaatcaggatgaatccgccttcaaatcccagcgcatgtaatacacgcacgcccgggccacgtttctggcctggcgcatagaggcgatcaaatccgctgttgtaaatcatgttccatagcatcgcgaccgtagagagcataatcgccagcgatcccatctgaaacagcggtttattcattgcccatgccgccagcggcgaaacggtgagaatcgccagtgtttcaaagcagacagcatgaagaatacgttctttaagtgagcgggtacgcattgtgagttctccttcaataatgcggcgcattttcacacgtcagaatgctaagataaaatgaacacctatcgaaaaaagcgatggttcagatgcgttactccccggaatcccttgaggcttttatgcagactgtggcgagcggttctttctctgccgctgcgcgcgcgctgggtaaaagtcagtccaccatcagcgcggcagtagccagtcttgaagacgatctcggctttgcgctgtttgaacgggcaggtcggcagccggtcctcaccgagcagggacgccgcgttattcctcaggttcagcagatcctggcggccagcgagcggctggatgcgctggcgatacgtctgtcgcagggcgttgaaccccggctcagttttgccatgtcagacttctggcaaaccgatcatcacgagcatctgctcaggcaatttgatgcccgttatccggagattgaactggaggtcatgattgccgaggatggtgatgtgctggatctgctgcaggccgggcgggtacatctgggcgtggtgcgggcacagcccaatctgccggtggatattgccgtggcgcgactgcaggttgaagcacagatggcggtctttttacatcgcgatcatccgctggctcagcttaagaccctgagcgaaagcgagctggaaggggttcgtcacctgcgattaaatacctgggttgaggcatctgaacccgcgccaatggggcgcatctggtcggcaccgacctatctgttactgctggagatggcggagcagggatttggctggacgattctgccgcgctggctggtgaaacagtttggtcatggcgtttctgaaagagttgtcgatgccgggctggccgcagcatatcgccattgaggtggtctggtcacgccgtacgccacccggtccggcgggtcgctggatgatcgatcagctctgcgcccagccacgggtttagtcgtggcgggcgatatccgcaaacggagcgtccagcagtcgtgaaagatcctggggagccagttcgatatccagtccacgcttgccgcctgagataaacatggcgtcaaacgcgctggcagagtggtcgatcaccgtaggcagccgttttttctggcccagcggactgatgccgcccaccagatagcccgtgacccgctgcgccagctgtgggtcggccatatccgctttcttcgcgcccagcgcttttgccactttcttcagatccagttgcgtcgaaaccggcgtaatcgccactgccagctgtttcgcctcgccattcagcgccaccagcagcgtcttatagacctggcgcgcatccagattgagtttacgtaccgcttcgtcaccaaaatgggtttcgctgctgtcatgctcatagggatgcagggtgaagctgactttttgtttttccagcaattttacggcgggcgtcatacaggttccttactaagaataatcttattacgcagaatcgtggaaaaaggtggcgaaactttgttctttgagtgaaaattagccgcgcgccagcaatctgattgctgagcgataaccaaaatcataaacaaattcctctttgacgggccgataatattatcggctctctttttttcagggcttcttcagcatctcaggcaggttatcttcgccgtagagatgcagagcaccgaccgctaccacatagtttcctgctgataatccctgaagccggtcacaccactgcgcatttcgctgaccgatcaacgtatcattcagcgcctggctgaaggtggcgggcagggtgatttccggctggcgtggcggcgtatcgagccaccagctcaccatcatctgcagcaggcgcgcattggtgtgccagtgcagcagcgtatcctgcaacaacgccatgccgtcatccggcagcgcagtcagcagggcgatctgcgcctctgcgccttccagttcaatcaccggtttgttcagacctttcgcggcctgcaacagctgataatcgatgccgtagtcaggacgcaatcccagcctttgtgcctgctgcgcctgtaacatcagcgccacctgccaggcgggcagattatcaaacaggctcagattgaggctcatctcctgacagagtgcggtgagcgtttgcatcgcgtggctatccagccgggtggaaagcgcgggacgatcgccgtggtgatcaaagggtgaaccaccctgagtaatatccgcttccacaatcagtgcatccgcctgctgcaactgacgcagcagacgggcgggcaacggctgcatgtcgcgcgtccccatgtggatgctgccgaccagatgcagctgacgatcgccaagccggacatccatcgcaggccagcggtaactggcgggaaaaagttggctgataaagccgcgcagtgagcgccagatgttgcctgtcattcccggtcctttgcgattcaaaaccccatgctagcgacttcagcgcgcgaaaaacagcgctgaaacggcgattactcgcgcggtggccggtaacgcagcaggcggttagcattgctgaccacggtaatggaggagagcgccatcgctgcacccgccacaatcgggctgagcagggtaccggtcagcggatagagcacacccgctgccaccggaatgccgatgctgttatagataaatgccccaaacagattctgccggatattgcgcagcgtcgcggaagagagcgctaacgcgtccgccacgctgttcaggtcggcacgcatcaacgtgatgcccgcggtttccaccgccacatcgctgccgccacccatggcaatgcccacatcggcctgcgccagtgcgggcgcgtcattgatgccatcgcctaccatcgcgacgcgacgaccctgctgctgtaagtgttcaattgcagccgctttgccttccggcatcacgcccgcaatcacttcatcaataccgacctcggcagcaatggcgcgcgcggtattttcatgatcgccggtcagcataatcaggcgataaccctgctgatgcagtcgcttcagggctgcgctgctttctggccgaagctgatcgcgcagcgcgataagcccggttagctggccctgctcagccagtaacaccggcgttgcaccctgttgcgtcagccgcgcaatctctgcttccgccgcctggtaatcgacgccgttatcctgcattagcgcggcattacccagcagcagcgttctgccatccagactaccgctgacccctttgccgcgtattgtacgaaattgcgctaacagaggcggctgggtcagtttcgcttcggcgacaatcgcttttgccagcggatgacccgaggcgaaaactccagcgcagccgcggtcgctaacactgattcacgggtggcatcgccccagacctgcacgtcactgacctgcggcttgccggcagtaagtgtgccggttttatcaaacaccagggtgtcgatttggctggcgcgctgcaaggcatcggcgtcgcgcaccagcacccccagctcggcggcgcggccaacaccggcaataatcgacatcggcgtcgccaggcccagcgcacaaggacaggcgataatcagcacggttgtcgcgatcaccagcatgtaggcaatttgtggctgcggcccgaacagataccacactgcgccgctgagcagtgcgatcaacaccaccaccgggacaaaaacggcggagatgcgatccgccagacggcccacatccggtttactgctctgcgcctgacgcaccagccggataatgcgcgacagggtggtgtgattacccgtcgcccgggcgataaattctaccgagccatcctgcaccagggtgccggcaaagatggctgcgcccggggtcttgctttgcggcaccgcttcgccggtcagcatcgcttcatcaaaccaggcttcacccgtggcgatttcgccatcgaccggtacccgatcaccggtgaccaggcgcagcgtcatgccgggctgcacttcgctgaccgaaatcagcctgtcgccctgttgatcaacctgccgcgcctgggctggcgtcagatccagcaatctttccagcgctttagaagatcgctgacgcgcccgctgctccagagcatgccccagattgatcaggcccaggatcatgacgctggcttcgaaatagagatggcgcgcctgtggcgggaaaaagtcgggccacagcaccacgctaaaggagtaaatccaggcggcgcctgtgccgagtgccaccagcgtatccatggtggcgctgccattgcgtaaactgcggcaggcactgcgataaaaatggctgccggtgacgatcatgatcagcagagtcacgatgcccagcgtcagccagacgccgtggttgtgatcggtgagcatcatgttgtcgcccaccatgccccagatcatcagcggcagtccaaacgccagggcgacagcagcctgccagctgaaacgccgcatcgcgctgcgggcgctgagctgctgcttctctcgtcgctcctgctcgtcatccaccacctgtgcgccgtaacccgcggcatcgacggccgctaccagctgctgcggatcagcgtcgcccagcaccagcgcactgcgttcgccgagattgacgcgcgcctggctgacgcctgcgacctgctgcagcgctttttccacccgactcacgcagctggcgcaggtcatgccctcaatcagcagcatatgggtggggagggttgtttctgccggacgggaagcagtctccgttgtcagcgcctccggcggcggctctgatgctgtcaacggttcagactttggggaagcgtcagcggaagcgtcagcggaagcgtcagcggttttcagcgtcgcgtgataacccgcctgctccacggtggcgatcagcgcggccgcatctgcgtgaccggaaacctgcgcttcctgttgggtcacgtcggcctggtcaacatcatcgcgttgttccagtgcctctttgacacgtttgacacagtggccgcaggataagccgtccagtgccagagaaatagtgtgtgacataatcaactccttctgtaatcccatttgaccgattggtcattttcgattcatgcttaagcataaaccttccatcaaggggaaggtcaaggggacgaaaatgaacatcagcgacgtggcaaaaaagaccggactgaccagcaaggcgatacgtttttacgaagagaagggagtggtgacgccgccgttgcgcagtgaaaatggctaccgcagctacaacggacaccatcttgaggagctgaacctgttacgtcaggcgcgacaggttggcttcacgctggatgagtgtcgtgagctggtggcgctgtttaacaatccgtcgcgccacagtgccgatgtaaaagcccgtaccctgcagaaagcggaggaaattgcggcgcatattgaagagctgcacgtcatgcgcgctcgcctgctggcgctggcagaggcctgtcccggcgatgacggcgccgaatgtccgattatcaacaatctggccgggtgctgcggtcagcgtggctgaatacgcagcgtaatcccctcaatgccggttacgaccactgctgtgcccgcaggcagatcctgctccgcctcaacccgccagctgctgtccccgatccgcacatggccggtgcggttatgcagcgcggtatccagcgtcagctgcaacccgatcatctgactgccgcgctggttcagggcattgggtttctgacgcgcttcacgatggcgcatccagcgataccataaaaagacgcagatcagcgtcagcacggcaaacagagagccctgcgccgtccagctcaccggcacaaaccactcaatgaggccgacgatgaccgccgccagcccgctccagagcaggtaaccgctggtgcccagcatctcagccgccagcagtaacccacccagcgtcagccagaaccagtgcggatgcgcgataatatcgaccagcatcagcgtttcgactcagtgcgtgattccttcagcagttcaccgatgcctgcaatcgaacccagcagactgctcgcctccagcggcatcatcaccactttgctgttattagcttcaccgattttttgcagcgcatcggtatatttctgcgccacaaagtagttaatggcctgaatatcacctgatgcgatcgcttccgagaccatcttagtggcgttagcttccgcttcagcctgacgttcgcgcgcttctgcctgcaggaacgccgaggtccgttcaccttctgctttaaggatttgcgactgcttatccccttcagcgcgcaggatcgccgcctgtcgcaccccttcggctgtcagaatatcggcgcgtttagttcgctccgctttcatctgcgcattcatcgcgccaatcagctcctgcggcggacgcacatcgcggatctcgatgcgggtgattttgacgccccacggattggtcgcttcatccacgatatgcagcaggcgggtgttgatgctgtcgcgctgtgacagcatttcgtccagctccatgctgccaagcacggtacgcatattggtcatggtgaggttaagaatcgcctgctcaagattgctgacttcatacgcggcacgcgcgggatcaacgacctgaataaagcagaccgcatcaatggtgacgttggcattgtctttagagatgatctcctgcgagggaatatccagtacctgttccatcatgttgatcttacgaccgacacgatccatgaacggcaccaccaggcttaatcctggctgcagggtgcgggtataacggccaaagcgctcaaccgtccattgaaaaccttgtggcacgatcttgacggtggcccagaccgccaccagcgccagaataatcagggcaggaattacagttatcatacaacctccgcgttgtcagattaacgggccgagtcgcttcggcccggggtgctgccgcttagtagagcagggaatagagctgacggcgataacgcgcggcaagtgcatcgccggtacccagcgccgccagaatctcctgcagcattttacgcgcctggccatcagcggcattaagatcggatttcaggaagctgaacagcagttccagcgcttcttcattacgacccacctgatgcagctgtaacgagagtttagcagccagcccggcgttagtcgggtcagcctccagctgggattgcagctgctgaatctccggcgtatccgctgcctgtttcagcagatcgatctgcgccatcaggctctgatagcgggtatcctgatcctgcaatggcaccactttcagcaccgcttccgcttcatcgctgcggttcagggtaatcagtacgtcagccagcaggaaaccgatctcgctggactgattgctcagctgccacgcatcttttaacaacggcagcgcctccagcggtttaccttcctgcatcagcgccatcgcctgctgcgctttcagctcttcttcgcgcggcaggactttttccagcagggcgcggatcgcttcttccggctgcggtccctggaagccatcaaccggctgaccatcctggaacagatagacggtcgggattgaacgcagaccaaactgcgacgccaccctttgctctttgtcgcaatccagttttgcgagaataaactgacccgcgtactcctgcgccaggcgctccagcacgggcgtcagctcctgacagtgctggctgcgctcagaccagaagtagaacagcaccggcagctgcatcgactgctcaagggtctgctgcaggttagattcgttgatgtcgatgatagaagcttgtggtgacatggataagtctctttgcaaaaagtgttctaagaatatggggccaactggcccggcttcaagcgctattgcgcatgcctgattaatggctgcgcaaaatgcgatccagcatccagccgggcagtaaccgtttcagcaggctcattatgtgtgcgaccagtgtcaccggatagcgtaaacgcggatgtttactctcgagtgcatgacgaagtttaggcagaatggcttctggtggcagagtaaaacgtgccgcgatgccggggttacgcaccgggttatgctgttcgccctgcgtcacattgtcggtaaaacgggtctgaatcggacccggttcaatcaggctgacccggatgccgcggctgcgcacttcaagccgcaatgcatcgctccaggcttccagcgcatatttactggcggcataggcaccccggcctggtgtggagatcagccccagcaccgagctggtattaataatgcggccatcgccgctggcctgcaatgccggtaacagacgcagtgtcagctgatggacgccgaaaaagttgctggaaaactgctgttccagctgctggcgggagagggtgtgcagcgggccatagagaccaaatccggcgttgttaaacagcgccgtcagacggttatcgcagagcgcgatcacggtgtcggcggcctgatccacactttgcggatcgtcgagatccagctgcagcccggtaaagcccagtgtttccatgcgggcgacatcctctgctttacggcaggcggcgatcacccggtaaccccgcgccagtaaatcgtgagcggcaaccaggccaataccgctcgaacaacctgtaatcagaatggttttttgcacaaattcacgccttgaataagatttaataatcaataagttaagttatgttcgttaatgattttatgttgtggattgacagtttgtcgcccgcaccgggtgacagaaacgggcggtaaacggggctatacagccccgcaaaaaatgcccgatttcagattttacgtctgagcagtgagaccagtgtgcttaattgacgggtggcagtcccatttgtgtgatttcagcagaatggtttttgttcagattaatttggcactggtcgatatatgactggtagtcgtatgcgtcctcgttaagttctgtagctacagacaggcaaatttgagtccggtaatccttccattttttttgcgcatccagaaagcgccgagagtaaacgtctccggacgtttctttgctggactcttttccattaaaagggccgacattgttggctttgattctcttaactgtatccgctattagcgcatccagcgctttattgctgttgtctcttttggcagacagacagttatatgcagttggtatgtcttcattctgtttgaagcaggcgtcacgttctggccctgatgataattcagcctgcgccatagcaggtgcaataagagcgaccattagaattaagacttttttcactgtagataccttattctgtttctgtggttttcgtaggtcatgtatgtaggactacttttaatatgggctattaatgcgggcttaccttcaattgcggcctgaaacagtgctctggcattgtgaacaccctgatagaaaatatcagttacgacatctcgaattttggggtctaactgttcccatgctggggcagaattatcttttcgcattgatattgtttagagagtaagcctggacacttagagatggcaaagcggtcgaaaatctccgtcgccaccttgccgttatttagtgcttttgcatttctttacgcttttggcgcatccctgcgcgctacggctgcttaactaagggggccaggtcttttgccattaactgggcgataaaaggctgggcatcaggattaggatgaatgccatcctgctgcatccactcgggtttcagataaacctgctccatgaaaaagggcaccagaggaatgttatgctgctgcgctaatccgggatagatgccgctgaacgcttcggtgtagcggcggccatagttggcaggcagacgaatctgcatcagcagcggcttcgcattggcggctttaacatcgtcgataactttactcagattctgcgcgatagcgtcgggcgggaaaccgcgcaaaccatcgttaccgcccaattcgattaacacccattgcggctgatgctgttttaatagtgcgggcaggcgcgccaacccctgtgcagccgtatcaccgctgatactggcgttgatcactttaggtttttgctgccactgcttatcaagcaggctgggccaggccgcggtggcagacatgcgatagcccgcactcaggctgtcgcccagcaccatcagcgtatctgcagcagcaagacgcgacaccagcagaagaatcaataacaggaagggataatgccagcggaaaacattgttgaagttcatcatcttactaagtccgtcggtcagggagagcatcagttaaccatccttaccggagttgagttggttgtcaaaccagctgagaccattgcgctgattggcgagtccggctccggcaagtcaaccttgctcggaattctggccgggctggacgatggcagcagcggcgaagtccatctgctggggcagccactgcaccagatgaacgaagagcagcgtgcggccctgcgtgcccggcaggtcggctttgtattccagtcatttatgctggtgccaaccctgaatgcccaggagaatgtgcagctgccttccctgctgcgcggcgacagcgaccgtcagagccgtgaacaggcgaaagagcttctgacgctgctcggactgggtgaacgtctgcatcatctgcccgcccagctttcaggcggcgagcagcagcgcgtggcgctggcccgcgccttcagtggccgtcctggtctgctgtttgccgatgaaccgaccggcaatctcgatcgtaaaaccggtgaccgcatcgccgatctgctgttttcccttaaccgcgatttcgccaccacgctgattctggtgacgcatgacgagcaactggcggcgcgctgcgatcgtcgcctgcggctgcgcgacggtaaattgtgggaggagcaatgatctggcgctggttctggcgcgagtggcgttcgccctcgctgctgattgtctggctggccctgacgctggcggtcgcctgcgtgctggcgctggggtcgatcagcgatcgcatggaaaaagggctgaatcagcagagccgtgattttatggccggcgaccgtacgctgcgcagcagtgatgcagcgccagaagcctggctggcaaaagcggctgaaaccggtctgacggtgagccgtcagctgacctttatgaccatgacctttgccgatcagtcaccgcagcttgcctcagtaaaagcggtggatgatcgctacccgatgtttggcacgctgcagacgcagccaccggggctgaggccgcaggcgggaactgcgctggcggcaccgcgcctgatggcgctgctgaacctgaaagtgggcgacacgctggaagtgggtgacacccagctgcgcatcagcggggaggtgatccaggagccggatggcggctttaacccgtttgagatggcgccgcgtctgctgatcaatctggcggatgccgccaaaaccggtgcgattcagccaggcagccgcatcacctggcgctataagttttccggtaatcccgatcagctggacagctatgaccgctggattgaaccgcaactgaaggcggaccagcgctggatcagcgtggagaactcggaagatgcactgggccgttcgatgcagcgggcacagcagtttcctgctgctctcggccttgctgacgctgatgctggcgattgcggccgtggcggtcgccatgagccactattgccgcagccgctacgatctggtggcggtgctgaaaaccctgggtgcgacgcacggcgcgttgcagcggttgatcatcggtcagtggctggctgtgctgctgctggcggcgattgccggtggtctggtggggcagggcgtggaagcgatcctgatggcgatgctgaaacccgtgctgcctgccagcttaccggcggccagcgtctggccatggatctgggcggtgggctcgctgtttgtgatttcgctgctggtgggtctgcgtccctatcgtctgctgctggcgacgcagccgctgcgggtgttgcggcgcgatgcggtggcgaacctctggccgctgaagatctatattccggtgatgattgctgttgtggtgacgctgttagcgctgctggttggcggcagtaaaatgctctgggcgctgctggcgggtgtggtggtgctggcgggattgctggcactactcggctggggaaccctgctgctgctgcgtcggctggtagtgcgcaatctggcgttacgactggcgatcaaccggctgctgcgccagcccggcatgacgctgagccagcttgcggccttttcgctgtcgttcatgttgctggcgctgctgctggtaatgcgtggcgatctgctggatcgctggcagcagcagttaccggcggatagcccgaacttcttcctgctgaacatgacggcagatcaggtgccgcaggtgcgtgatttcctgcagtcgcatcagatcacgcccgggaccttttacccgattgcgcgggtgcggctcagtgaactcaacggcaaaccggccgatccgaagctggataatgccctgaaccgtgagctcaacctgacggaactggccgatcgcccggatcataatccgctggtggcaggcaactggccacctaaagcgggtgaagtgtcgatggaagtggaactggcggatcggctggggctgaagctcggcgataccctgacgttcgacggcgatacgcagaccttcagcgcgcgcattaccagtttgcgtaaagtggactgggaaagcctgaagccgaacttcttctttatcttcccgccgggcgcgctcgacagccagccgcagacctggctcaccagcttccgcatggaggcgaatcctgttctgctggcgcagcttaaccgtgcttttccggcgctgagtctgctggatatcggcagcataatgcggcagatcggccaggtgctggcgcaggtcagccaggcgctggagatcatggtggtgctggtgactgcctgcggcgtgttgctgctgctggcgcagattcaggtcggtatgcgccagcggcgtcaggagctggtggtctatcgcacgctgggtgccggtaaacgcctgctgcgcacgacgctgtggtgtgagtttgcattgctcggcgtggtctccggcgtggcggcggcgatgggggcagaagcggcactgtggggattacagactaagattttcgacttcccgtggcagcctgactggaccctgtggctggcgctgccgttgtgtggcgcactgctgttatcgctgtgcggtggctggctggggatccgattactgaaagggaaggcgctgttcaggaagtttgatgcggcgtgagttagcacccgtagcgctcgacggtaaggtgctggctcagggagcatacgccctccgcaaaaacgccatccatggcagactcagcgcgggcgattacgctccccatccctgaggtgcgcccgtagccgggccaacgctttgctttgttcaaaaacgctcccggcgtttttagccgggcggcccgatgctttgctccaggcgtatgctcccatcacattaaccttctgagctgcctggtaaagccattaccagactcaggtgcggaggattacagtttttcaaccgcccaggcgatgccgctggcgtacgcttccggtagctgcgtcaccagcgcattaagggcagccctgagccgttctgtatcgctgtcggtcagattcagatggcccactttacgacccgggcgcacctctttgtcataccagtgcagatgcaccagcggctgctgcagccagctgagattcacgtcagtgccaatcagattgaccatcgccgacggcgcaaataccaccggctgtggtaatgccagaccaagaatggcgcgcagatgcagctcaaactggctgattgacgcaccgtttctgcgtccagtgcccgctgttatggacgcgcggcgccagctcattgatcagcaatccgtctggcgtaatgaaacactccatcgccattacgccgacgtaattcagttcctgcatgatcgcactcagcatcgcttcagcctgctgctgctgtgcctgatccgcctgcggcagcgcgacgctggtgcgcaaaatgccatcctgatgcaggttatgcgtcagcggatagaacaccacctggccatcgtgaccgcgcgcccccaccagtgacacttcaccggaaaagttgatgccctgctcaacgatgcattcgccgtagcacgcctccggcagggtgtgagtctcatcggcacgcagacgccactgaccccggccgtcgtaaccgccggtgcggcttttcacaatcgctaactcgcccagcgagtcgaacaccgctggccattcgcttttatctgccagcaactgccacggcgcggtggccagtcccagctgatccagcagctgtttctgcgtcagacgatccgccagacgcggaaagatatcgcggttaacaaaggccggatggctggccagctcacgcgtcagcgccgtctccggccagcgttcgatttcggcggtgatcacgctgtcggcgatagggagcgcggcaggatcggcgtctaagcccaccggatacaccgcgatgcccaggggttcacccgcctgacgcagcatacgacctaactggccgttgcccagtacgcaaaccggcttcatgcatccacccgcggatcgggatggttcagcacctcatcggtctggctctgacgccaggtggtcaggcgtaacgccagcgcactgtcatgcagcgccagaatctgcgccgccagcagcgcggcattggctgcgcccgccttgccaatcgccagcgtaccgaccggaataccgcgcggcatctgcacaatcgaatagaggctatcgacgccgctcagtgccgcgctctgcaccggcacacccagcaccggcaccagcgtttttgccgccagcatacccggcagatgtgccgcgccacctgcgccagcaataatcacctgaagacccttgtcggctgccgtttcggcgaagctgaacagtttatccggggtgcggtgcgcagagaccacttcaacatcaaaagggacgtccaggctggagaggatttcagcggcgaactgcatggtggcccagtcacttctggaacccataacaatggcgatgcgggccggggcgttggatgacatggggtcaactcctgtgaatgaacaaacagacctggccgggcggacaggttttgaagggcaccgagaatagcatgagaagcacgcaaggaaaacggttgcgtcgggcttaaggtcgtggatttaaccgcagattaaaagtcgaaatggatgagctgaatgccactggcgtcgagctggatcatggaaccccggctgtgccaggcacccagcactgcgcgttgcgccgtttcaccctggaggctcagcgtatgaatcgccgggcgatgagtgtgaccgtggattaacagcggcacctgctggcgcagcatagtggcgacgaccgcttcctgattcacatccatgatggtctgggatttatgctgattggcctgtttactgtcggcgcgcatccgggcggcaatgcgtttacgtatccataacggcaacgcgagaaacagccgctggatccagggattatgcactttggcccgaaaacgcaggtaacccgcatcgtcggtacagagcgtatcgccgtgcatgatcagcaaccgatggccgtagagcgtcagcacctgctcttccggcagcagcgtcatgccgcaggcctgcgcgaaacgccggccaatcaggaagtcgcgattgccatggataaagtaaaccggaaccggcagggcgcgcagggcgcgggcaacctgctgatgcagtggattaggatcgtcgtcgccaatccaggcttcaaacagatcgccgagaatatagagcgcgtcgcagtggggcgcttcgcgctgtaaaaaatgcagaaaaccggcggtaatcgccggtttcttcctgacacagatggagatctgcgataaacagcgtgcgcgacattactcgctgacggtcactttctggataacgacgtcgtcttttggcacatcctggtgcatgccgctgcggccggtagagaccgctttgatcttctcgaccacatccataccttcaaccacttcagcgaacacgcagtagccccagccctgaacgctttcgtcacggaagttcaggaagtcgttgtcagctacgttgatgaaaaactgtgcggtcgcagagtgcggcgcagaggtacgtgccattgccagcgtacctttggtgtttttcaggccattgctggcttcgttctgaatttcggctttggtttctttctgcttcatgcccggctcgaagccgccgccctgaatcataaagccgttgattacgcggtgaaaaatggtgttgtcgtaaaaaccttcacggcagtaatccaggaagttctttacggttgccggcgctttatcatcgaaagttttgattacgatatcgccatggttcgtctggaaagttaccatttttgtcgtcctgtaaaggttgtcatcagttgctgaggtcgctctgtcgattggcgtccccctttttgtcgaccgttcttatatcataatttccaatgacgcgtcagcagcgcggcgcagttggcttgctttgcgtcgcgcgagcgataaaaatacggcacaatgtctggatacttaaaagtgccaaccacacgcgaaaacggaaccgttcaatgcttaagatttataacaccctgagtcgacagaaagaggaattcaaacccattcatgccggtaaaatcgggatgtatgtttgcggcatcacggtgtatgacctctgtcacattggtcatgggcggacgttcgtggcgtttgacgtggtggcgcgctacctgcgttacctcggttatcagcttaattatgtacgtaacattaccgacattgatgacaaaatcatcaggcgcgccaacgaaaacggcgagagcatcgaaaccctgactaaccgcatgattggcgagatgcacaatgacttcgccgcgctggggattctgccgcccgatgaggagccgcgcgctacccgtcacatcgctgagattatcgagctggtggaaacactgatcgctcgcggtcacgcttatgtggcggacaatggcgacgtgatgttcgatgtgctcagcgacaccgattacggcgcgctgtcgcgtcaggatctggagcagttgcaggcgggcgcgcgtgttgaagtcgccgacgtgaagcgcaacccgatggacttcgtgctgtggaaaatgtccaaagcggatgagccagcctggtcatcgccgtggggcaacggtcgtcccggctggcacatcgagtgctcggcaatgaactgcaaacagctgggcacccatttcgatatccacggcggcggctcagacctgatgttcccgcaccatgaaaatgaaatcgcccagtcgagctgcgcccatgacggtccttacgtcaactactggatgcactccggcatggtgatggttgatcgagagaagatgtccaaatcgctcggtaacttctttaccgtgcgtgacgtgctgcaacattatgatgcggagacggtgcgttacttcctgatgtccggtcactatcgcagccagcttaactacggcgaagataacctgaatcaggcgcgtgcggcgctggagcgtctctatacggcactgcgtcacaccgacagcagcgtgcctgcccacggcggcgaagcgtttgaagcgcggttccgcagcgcaatggatgatgatttcaacaccccggaagcctattcggtgctgttcgacatggcgcgtgaagtgaaccgcctgaaaagtgaagatggcgcttcagcgcacgggctggcgtcgaagctgcgcgagatggccaacgtgctgggcattctgcagcaggatcctgagcagttcctgcaaagcggcgcgcaggtcaatgacgaagaggttgccgagattgagcactgggtgaaagcccgtgccgatgcgcgcgccgccaaagcctgggcggaagcggacatcgcgcgcgacaagcttaacgcgctgggtgtcatcgtcgaggatgggccgcagggctccagctggcgtcgaaaataaaccggagagggcgagcaatcgcccttttttattatggcgattgaacagattcagatccgcggcttccgctcaatacgtaacctgacgctgtcgctgcagcagctgaatgtggtgagcggtcccaacggctgcggtaaatccaacctctacaaagcggtgcggttgctgcatgaggcggccagcggtcgtctggcactggcgctggctgaagaaggcggcattcagaaagcgatgtgggcgggcggcttacgtcggggcgatcgccgacacgatccaaagcggctggagctggccgtggtgatggatgatatggattaccagctgaagattggctttcccgagccgctggtgaccagcctgtttaatctcgatccgctggtgaagcaggagcgactctggctgagcggtcagcagcgccgtccttccgcctgtattatgcagcgcgaaaatcagactgcctttctgcacaacgttgagggcgagcgcgtcgcctatccggcggtgctgcatcccgaagagtcgctgtttggtcagcttggcgaaccgcatcgctatccggagctttcgcagttgcgcgaaacgtctgcagcagtggcgcttttaccatgagtttgcggtctggcctggctcaccgatacgggcaccgcagattggcgtgcgtgcgccggtgctgagccatgatggcagcaatctggcggcggcctgggcgaccattgttgagcgcggtcattccgaactcctgtctgaggtgatggaacaggcgtttcccgacagtcagtttgatgtcgatgtgcagaatggccgtttccagatgctgatgtcgcgccagggcattctgcgtccgctggagagcgcagagttttctgatggcacgctgcggtttctctgtctggttgtcgcactgctcagcccgcgtccgcctgcctttatggcactgaatgagccggaaaacagcctgcatgaagatctgttgcctgcgctggcgcgcttaatcgccgaagccagcgagttcagtcagctctggatcaccagccattcaccccggctcgcgacgttgatagcgcagcatacggcggtgaatcatattgcactggaacagcgggaaggggagacatgcgtaaagggggatgagcgggtgtaacagcgtccccgcagggacgcccggaaatcactcgaccacagtaatgcggaaacccgcgaattccacggtctgaccagctacgattttgcagcgcttgcgggtttctactgcaccgttgaccttcacttcaccctcggcaatcacgactttcgcctgtgcgccgctctgaacccagccttccagtttcagcaggtcacacagatcgacgtgcgggaatttacccagtgaaaaacttgtcatttatactacctctttatcatgaaactcttcgcacgcctgcagcgtgttttgaatcagtgtagctactgtcatcggaccaacaccgcccggcaccggggtaatgtaggaggcgcgctcggatgcactatcaaaatcaacatcgcccaccactttgccgctctccagccggttaatgcccacgtcgatgacgatggcgcccggtttgatccagtcacccggaataaacccgggcttacccactgcaacgaccagcagatcggcatgctcaacgtgatggcgcagatctttggtaaagcgatgggtgacggtcgtggtgcagcccgccagcagcagttccatgctcatcggacgaccaacaatgttggatgcgccaaccaccacggcattcaggccgtaggtgtcaatgttgtagcgctccagcagcgtcacgataccgcgtggcgtgcagggacgcagggttggcgcacgctgacacaggcgaccgacattataagggtggaatccatcgacatctttatcaggcgtgatgcgctccagcactttgacattatcaatgccggctggcagtggcagctgcaccaggatgccatcgatttcgtcgtcctgattgagcgcatcaatcagctccagcagctcagcttcgcgggtcgtggcaggcagatcgtaagagcgggagtggaaacccacttcttcacaggcacggcgtttgctggccacgtagatctgtgatgccgggttttcacccaccagaaccactgccagacccggcgcgcgttttccggcggccagacgctgcttcactttttccgcaacctcaacgcgcacctgctgcgcaatcgttttaccgtcaataatttttgctgccatcagagaggaaatccactgtgttgtgttgaatcggggaagggggctattttgtcagaagcgcggcgcgctgtcagttacagtttcagccgcgtatgtgctttccggctttttcgtcgcgacgagtgccagcctgcatgcgtatgatatctgcaggacaatccggggacgatgtaatgatttggataatgcttgctactctggcggtggtgtttgtcgctggatttcagctgctcaccgctcgctcacgccacgccgctcagcgactcagcaaacggctgcagctgccaccggtacaggtggaatcaatgatctctatgatggggaaagaggcggcgaaagagtttaccgactatctcagcaaggataatgaaacgcacctgcataatggcgcagcggtactgctgatctggcaggtgttcattgttgacggcagcgaggagaaacagccagcgatggcatgcgattctcagtcgtgccggttttccacccctgattaaccgccagcagctgctgctcgcgctgggctttctgcgccagctggagccggacatccaggcgctgcatgcacttcgtgagcaatacaatgcgcgtttcacatcacaagggattgagctggaaggagaatttaccgacaacagtaaactcgtgtcgctcagcgaatggcgcaggcgtcactgacgccaattggtcattaccgcagcacttcgctgcggagaaacggcaaaaacgttgacgtacccgcttcccgacgtataatccgtgccatctccatgcgcccttagctcagttggatagagcaccggccttctaagccgtaggtcacaggttcgaatcctgtagggcgtaccattttttcaagtcaacacacttctactgaactctctttctttgcttaataatccatgatattgatagtttttttggcgcgagctgtttcaaagtccactcagttatacctttaatcaagtggtacctgtgaatttttaaggggtttaatttcgtttaatggaaatttaagagctctttatgtcacaaaagacaggacaaatttacactgcaaaacctaaagaaaatgaatatgtgtttactaacggtgataacttagatctatcagcaactcctaagtatgctatataattgtctttaaagtaagataagggggaaattacaataagcgcacacatcgatatttttccatcatatgcacactgaaggttgatgcagaatttaaagtggttagtttaggggaaagaatagcagaagaaaaagaatcttaaaaactggagcaaagatttaatgtcgaaaaatacagatatagatattattctaaaaggaatgagtataaacggtctggttgggtgaaatcatatgcttaatatttataggaatatatagtaaccatacctatctcaaaattgtgaacataaattttaaaatttaaaaagtggaaattttcctaacgtgagtaactgccggttcaacgacagttgagcaagtgcgttgtacaaaatatgtctaattaaatccccatgttaccacattcttttaccccctccgctacagctgttcaaaccagagtaagtatccatttagtttttatataataaacgatttattgcattatgatgcccacgtgcgcatagcatcatgctttactcagttttgatgatgattaggcttctttgcactacgtaacgctattaatatttttaatgggttaggggcgggcatttttataaaaatcaagatttaatttaattaaaaccgtcaaggttggagtgaaaatttttagtcttatgatttataatggtaatttgacttgccctgatttctaaattacaatttgtatgctctttagcgtggtatggatttcaccactcaacggttaaatctagttcggcgttacgcagaactctaacttattgattatatttacagttgcggaacaaaatttctgaaccgcagccgtagttgcggatcagaaattttgttccgcggctactagtaaagagcagagcaccaaaggtaggggtatgccttgtcgtacccctacctccttcctgctccttcatacctctaatgagccagttttccacttgcttacaatcaaggtagtaacttgcgatgatcattgatttaaaaggtgaactttcagagaaagtggatgatctacagcagctactcaaatcacgcccttctactcactataaagtttataaaatacctaagaggagtattggatttaggttgattgcccaaccaactaaaaaattgaaacatatacagaaattaattgttgacttgcttttgaacaaagtaaaagtacataaaaatgcaacagcctacattaagggtaaaaacatatcctttaacgcctctatccataagaattctgagtatctattaaaacttgatttagagaacttttttaatagtattaagccgggtatgtttttcaaggaacttgaaagacaaaatattcgccttagcaatgaagatactgcgattttggaacaattttgcttctggaatagatctaaaagaaaaaatggcgctttagtgcttagtgtgggtgcaccaagtttctccatttatatctaatgtattaatgtatacgtttgatcaggaattatatgagttttgtgcatctaaaaaaatagcttactcaagatatgcagatgacatgacgttttcaacaaaagaaaaaaatgtactcctatcaatacataaacatgtggactttttgctaattaaatatttttctaaaaacttaagaattaatgacttgaaggttgtatattcatccaaagcacataatcgacatgttacaggtgttacattaaccaacgataatgaaatctcaatagggagagacaagaaaagattaatatcggctatggtttataactttaaaaataattcgcttggtttagatgatactcacacattgcaggggttaattggctatgcatttagtattgaaccagattttataaaaagacttcaagctaagtatgggtcaactatacttgaagatattaacaaaaaccttttgaggacttaatttatgaataaaattagtagcaccataaaaaagctcatcaaaaaatcagaaaatggagactttgcttcttcttatcaactttataaagtgtatagcgaagggcatggcatttatgaaattgatagcgaattagctgaaaaatatcgtaagcattgtgtaagaaatatgtctcatggtcagcttagagttattaaaatacaactagaaaattacaaaggttttgaaaatatcactcttgatttttctccagaagaaaaaatagctgtttttgttggtaataatgggtcgggtaagtctacattattagaagcgctgcaaaaggcgatgactcatgtatcatcgcggtttgcaacacgctcaaacaatggcgatctcatagaaagatttgaaataagaaaaggaagtggttattcgagaataacagtgacttatagctataatgatgtcagttttttaatggttataggacaagataatttaacagatgatcctaaagggaaaagcaactattcaggaattaatgagttaggtcagttgtttaaaaatgctaattctgtggatcccgcatttaactatccattgttagctgcatatactgttgaaagagcgaatgatgtgaccactaaggatattgaaaactcagacgaaataaaagaatctcaatcgtgggataaatttaaaggatataataaaagtcttacggggaaagctgattttaaattattttttaggtggttgaaagagttggttgaaattgaaaactctgacaatgttgagcttaaaatgctcaaaaaagaaattgaaaataaagagaaagaattagaaaacccacttttgaaagctttagtttcagaacatcctgattccaaaacaacaaagcaattattagagcaacacaatcttgtaataaatcatttaaaagaaaagttaaatagctattttgatattaatagtaaaacgctgcaaacagtggaaaatgccatatattccttcttgccaggatttagtgaattgaaattacagagatccccactagatcttttgataaagaaaggggatgaatctttcagtgtgttacaactctcgcagggggaaaaatctattttatctttagttgctgatatagctagaagattgacaatactcaatccatcactcgaaaatccccttttaggcacgggtgttgtttcttatcgatgaaatagatttgcatttacatccatcatggcagcaaaaaatagtacaaagattaaaatctactttcgaaaatatacagttcattattactacccacagcccgcaagtttgtcatactattgatggtgagaatattttccttcttaaagatggtaaaagattcaaagctccaagaggtactcgtggagcagtgtcatcttgggttttgaaaaacttatttgaagttccggaaagaccagaacatgatgagtttactaagaaacttgaagagtataaaaataacgtctattcagataaatatgatacagctaaatcaaaaaaattatacttagaattgtctaagcattttggtagtgattatgatgttctagtacaactgcaattgtatattgaaaacagagaatgggagaaagagattgagaagcataattaagtcaaatgaaaaaatagttttctctcaatatagaatttcccagccaaacagcacatgggatgaatttaaaaattttgaaagaggaaacgtctataagttaattaagaatcaaatttttgatgatcaatttcagttgtgtgcttattgtgaaacatcagttccaaaaacacctgaaaatgaaagaagaattgaacattttagatcaaaatctggctgtgatcctaaaattgataactggcatttggattggatgaatcttctgggggtttgtgttggaggctcgaattgcaaagcagaatatgaacttccgctaaatctaagctgtgattcgcataaatcttattatgaggaaactcataaaagagaaactaaagattgggtcggcaggattttgttgccactttcattgcctcctgaacacgagctttttatgttcgataaaaaaaacggaaatcttcttcctaataaaacttattgtgatggttttgagtttgaaaatcatactaacgttaatattgaagaattagtaaaaaaaacaattattgtacttaatcttaattgtgaaagactttgtaaagcacgattagttatgttgcatgaatttaatcgttctttagctaattataggagtacaaataacattacggtttttagaaatctggtcatccggtggtcaaaaggaacgccaagtttttttcaaacaacaagattgatgttattaaaagacagctttatagcaaaaaaaataatggaaggaaaagattgaagactgctgatacaactctgctataatcaaaatttagaaaataatccactaaatcgcaagggggagagaatgaatgaaggttcaattggacttgaaatgataattcgttttaaccaagaaaccatagcctgtaagcttagacgcctgcctttcaactggtgattaaggtagggtaattcaaatgagtgaagagctcatatgctattgcttttagcatatatccagcaaggtttaattaaattaattattggcataattggatagggaaccgagtttttttctgtctcaatctataaaagtgacctctagggaatattaagatttaactctaaaaatattaacaaaagcaggttgttgatatcattgttaattaaaatagagcgtaagaatatatttgtattttaattttctttagataaaaataatgtctatataagctttgtaatatgtggtgtgaagaatttcgattggctggataagtgtttttattgaatttaatccagaatgtctgaccaaataaacagggtttatataaataatagattattagcgctcatgcctcatcatcattcgttaaaccacccaacttgagtctgccgctccccaatcagaagcggcatccttttacctcaacgccactaacccgcaaccacacccgacaaagccagaaacctgcttctgtttcctggcgggcagcttattcagctgcgctaacgcgttaaccagctgctcatcgaccggctctggtggtttcacggtcagcacaatacggcccgctgtgacttttacttctacttcggtgccggtggtaaatccggcggcagccagccactggcctttcatgataatcgatggaatacgcgcgtaactgggataccggctggcgtaactcaccgttaatttgcgctgggaaacggaaggggcttctgaatttaaaccaactgcattacactctgactcagtcatgatctctattctcgctaaatagtggttgtgattagcgatacaggggtgctccaacacctctgtatcgcgctaaatacctgtacatataatcaactattgcaggaaaagtccagctgaaaatcgatgtaaatcagtgactttaatcatctgataaacagcgaattttacgatgacgatctcaaaaaaatgcaattaactgaaagcattcattgttcggaatataagaaaagtcacaggtgatatctcgtcataaatatctgccattagccgtattcagtaagcccgctatcagtaacaggtgcttaacccgcagtgtgcttaagcagaaagtcgattaacgtttttactcttttcgttttacccgcgcttttaggataatagagataaaccggcggataagttttccagtaacgctccatcaccggaataaaagcctctttatccggctgtaaattatgaaccggttcaaacagtcgcccgatacccagcccgttgcgaatgccatcagccatcacctcaatatcattactcatcaactgacccggcatctcaacggtcagctgttcgccatgatgatccagaatcagcggcagaatacgattattggtgataaaccggtaaccgataagccggtgctgatgcaggtcagacggagactctggaataccgaaacgctgccagataggcagaagaggcatacaaaccttcgcgaaacggcttcatcagcgggcgcgccaccacgccaccttccagaatgtcgccaaaccggatccccagatcaaaacgttcatcaatgatgtttacggtgccatcgtataccgaaatttccagctgaataccgggatattgctggcagaaagcggccatcgcaggtttcagcaccagcagataagcaaagcgcgaaagggtgattctgaccagtcccgacggttcctgattctggtcacggatgctttccagcgatttttccagcgaggctaccgctgctgaggtttgttccagcagctgctgtccggcatcggtcagctcaatacggcgcgtggttcgcacaaatagcggatgaccgatgtgcgcttcaagcagcttcagcgccttactgacagaggggggagtaatctccagtttgcgagcagccgatgaaatatttccttcgcgggcaatgctctggaagatgcgtatctgattatagatggcgttgttcacgggataatcctgacacaatcgggctgcttattattagccgcaggctaaatatctttgagtcaatagtggcctaatcttcactaaatcgcgagcatatactccttatcagttccccctggccgtgaatctcaggagattgctatgcgaattttgtgtctggataaacccgcccccgatgccacgctggaaaagtatcaccctcatatggctgccgaagctttccatgcctggagtctgtataaatccggtgcgctacgcgatatttactaccgacaggatcgacccggcgttgcgatcttccttgaatgcgactcggtggaacaggcccaaagcctgctggctgactttccgctggcaaaagccggtctgctgagttttgactgcatcccgttaggtgcattcaccaactgggaaagcctgtttcgctgcagagtataagcctcagcaagagggcgccacccaatgatcagtcgcaaaccgctaccgtgtgttgtcaccagtcatccgacaggtgtcaggcaggcggcgcagtaaaaacgccgcgtgaagcgctaacggcaggaaaggcggaagccgtatcggtgggttttgattaaacggtgccggacggcaaaaagtacccagcgcgtgatggcatcgccaacgcctggctatctgttaaaaaaataaatgattaaaaactgaaaatgaaaaatatattaattatttccggtcatcctgacctgagccattcggtcggtaacgctaccattcttaatgaagtcgcttctgcgctgcctgatgctgaaatccgtcgtctggatgcactttatccggacaacaacatcaatgtcagtgccgaacaggatgcgctgctgaaggcagatattatcgtctggcaatttcccttctcatggtattcgctgccagggctcatgaagttatggctggatgacgtatttgttcatgggtttgcgcacggatcgacggccagactcggcggtaaaaaactgatcctctccttcaccactggcgcaccgcaggcgttatacgcggcagatggcgtctttggtcatcagctggaggattatctgattcagtttgaaaccaccgcccggctctgcaatctggagatgcagaaaccggtttatacctgcgggataagctatgccagtcgtaatgaaactattatcacgcagcaaattgctgcagcaaagcaacacgcgtcgcgactcattgctcagctcaatgcggaactcacgacggcttaatagccagatgaaacagaaatcgcgccggttaatgcaccgaatgaatcgcaaatcacctcatccgataattaaggcagaccgtgaacaatattaccgctctgactctgactctgctgatggccggcccggcatcggcagccgctttaacagaccccacaaaccgtgtcattaatctgcatgaaatggaaattaaggccgggaaaaacggacagtacgatgaagttgccagagataatattacccgttcgctggcagagcaaccaggtacgctggcgatgtattcactgaaacataaagaaaatgctcatcaggcttatatgattgaaatttatgcgagtgaagaggcataccagcaacatctcagttctgagccataccggtcttttattacacgcgcacctgatcttatcggccagaaaaagagcactgtgctggagccgcagtttctgggtgataaacccttcgtacagaataaagaaaccatcaataacctggtgattgttgacgtgaaaccggccgatcagcaggcattccgcgatattgtgctgcctgaaatggcagagtcactgaaggtggaaccgggcgtactggcgatgtatgccgcgaccgatgcaaaaaacagatatcgctggttcttctatgaaatctacgccagtgacgccgcctatcagcaacaccgcgaaacgccccattttcgcgactatatccggctgacagctgagatgaccgaccgcaaagaggcgatccccgtgttgccagctctgctgaaaaaccgtggcgctcttaactcttttgttaactgacctttaccagggagctgatcagaggatgaaaaaagtgattgccgccgccgcgatctccatgatgctggccgacctggccgctgctgaacccaaaagaggtgaaactatgttgaacgtcaatccatccagcctttcggttgccgacattgagtccgtctctcccgcactggctcgtttcggacgtgaagcgataactgatgatctctggaaacgcgatgcactttcgatccgtgaccgcagtatcgtcacgcttgccattctcatcgcccgcaaccagcctgctgagttacaacattacgccggtgtggcgctcgacagtggcgtgacgcctgctgaagtctccgaaataatcactcacctggcgttctattccggctggcccaatgcgatgtccgcaattgcggtgaccaaaaatgtgtttcaggcgcgaggcattggtgccgatcaactggccgaagcctctccggcactgctgccactgaatcaggcagctgaacagcagcgtttctgcaacggtggagaaaaatgtggggccgatctcgcccgggctggtcagattcaccgccgatccgctgtttctcaatctgtggcagcggccagcgctacagcctcgtgacagaagtctggtgacggtcagcgcactgattgcttcgggacaaagtgcgcaaattagctaccatctcaaccgggcgatggacaacggattgacggctgaagaagcgggcgagattatcactcaggccgcgttctatgctggctggccaaatgccttttcagcggttccggtggtgggggaagtactgcgggatcgcgcagcaaaacaggaataacccgcagcgggtgaggctctcaggtttgacttcacccgccgtttcttatgccagccggataccgacagagatccggaaaagtgctgtgccattctggtggtttttcccctcccgccgcaatgccatgatgaccgctccaaaccttccacttacaaccacccgccattgggcataaaaacagagagcaccgcgtcatggaaagtaaaaatctgacagatattgctgaagacgtttcatacggtgtgaaatataaagcagtaataaatgaaggatgggcagggcaggacgcaggagttatttaacagaataaatgaaataagccgtggcgggcgccacggctaatgttttatgcagactgccactcactttcaacatccgctttggctttagaaaggatgactttattatcatcaacttctttcacccagctgaatggaataatgtggtgtttgccgcccgcttcaggatcgcttttcgccagcttaattttgtcgtcgccttcgaagtggtcgacaatcccgacatgttcgccattcacatcaacaacctgcgcgtgatctaaaatttctgatttatctaccatggtggcttaatccttatatttaatgagttcagttgccctcagacaaaacaagcctggttgttaaatgctgttttcgccaggggattaacaaaatgaaatagttcagtgaactggacctggtcgcagttatttatttccggcaggagaataaagggcatataagcgaaaccgcaaacagagtcggagtatctgcagccacgggtctgctgacctcactgcctgccacatcgacaccatcagatttgccgcaatcgtctgccgcctgttcaccaatcaacgctatgataatcaggtcaatcgccacgccgcagatcggccagcacgcgggcggtttaacttacccaaaggagtgcctatgacagcagtcagttccattaccactgaaggtggcgtctggattaatcagccgccggtacacagcctggatggcgaaacgctgaggttcgaaaccgcgctgaacagcgatttctggcagcgtacctggtatggcttcgaacggcacagcggccacgcttttggcttctgggtggaaaacgactttaccgttcaggtgcaggtgagggcggatttcagtcagctctacgatcaggccgggctgtttattcaggataacgaaacgcactgggttaaggcgggcattgagtttaacgatgaccagcccgcaattggcagcgtggtgacgcgcgagttttccgactggtctaccggtgtgtttcccggcgatgcgcgccagttttctggctgcgcgccacgctggaaaacgcggccttaagaattcagtactctaccgacggcgtgagctggccgctgttacggctctgcccgtggcccggtcaggcgcggcggtttgtcggagtaatgggctgctcgcctgaacgtgaagggctggcgatgagttttacggacttcgctattactccaccgctcggcaaagcactgcacgatctctcctgagccaggcggcgcattgcatatcgtcgcagaatcggcttaattgtcaggtcagaatttgcggtgacgcgtcgcccgtgcaagacgacgcctttacagggaaagctatgcgttgcgccacctcgtttatcccgctgctggtcatcagttgctgcgccggatggacacagcaggccactgccgataccgtctggctgaataatggcgatcggctgaccggcacgattcgttatctcagcgacggcaagctggcgatagagacacactacgccggtaccgtcacgctggactggagtgcggtcagtacgcttgccagcgagaatccggtgaatgtcgaaaacaaaaagaccggcgaacattatcaggtgcggctctcctcatccgatcccggctatgtctgggtggaacgcaacgagcaggagcagcaggtctctctgcggcgcattgatgagtttatgaaagccaaagtccgcagcgatcagctcgcctggaccggcaacatcgatgcgggcgtgaaagtcaaaaaagcctcgaccaaaactgacgactacagcttcgcgctcaacacgaaactgaaccagggaaaatggcgtcacgatatcggtgcgacctacaatcgcgagcaggaaaacgagaacatcaataccgataactacagcctgcgctacgccttcgactatctggtcagggagcagttcttctggcagacccgcgccacctacaagcgcgactgggtggagaatctgtcacgtcaggcgctgatcggcaccggtccgggttatcagttatgggacaccgaactcagcgcgttctcactctcggtgctgggcggtgcctttgagtatggctacagcgatgaccgggaagagcggcactttggcggctcgctgcgctggaactatcagcgctatctgctgggcaagtcggtcacgctttacagcaatggcgatgtcggccattcgctggatgatgacggcgtatttatgctggatgccgaagtcggcctgcgctacagcctgacttcgtggtcaacgctgcacgttggctatcaccgtaatctggtcagcggcataccggataccctgaacgaaggcattttctctaccggattggggctgaagtggtaagccgctgatcgaacagcgtcgcagcaaatccttacggtttttatccggttacaggcgcgggattagctaagctgcatgtactgtcacaacgggaaagcagaagatgatcgtaagcagcagggtgtatcgtccgggatgtgcgggcgaagaggtcgaagtcgatgatatcagtgaagtgatcaaagagccggaagcatttatctggctcgggctgtggcagccagacgctgagtttatggcgaagattaaagaggagttcggccttcatgaactggcggttgaggatgcactcaatgcccatcagcgacctaaaatcgaacattatggcgaatcgctgtttatcgtggtgaaaacggtgtgcgctaaggatgacagctgcgaaactgggcgaaacgcatctttttgtcggaaaaaacttcctaatcagcatccgtcacggcgcctctgaaagctacaccccggtgcggcagcgggcggctgaaaacccggcgctgctgaagtttggtcccgcttatccgctctactgcctgctcgattttattgttgatcgctatgccgagctctctacctcgctgaatgaacgggtcggacagatggagaacgatctcttcaccagtgaatttgatcgcaagtcggtgcagtcggtctacaccgtgcggcgtcatctgctgaaactacgcaatgcggcgctgcccgtggaggagatctgcaatcagctgatccacctgcatgaagatctgatcccgcgtccgctgcgcgcctacatccgcgacgtgcaggatcacgcccgccatgtcgtcaccgacgcggaagatatgcgcgaaatgctgaccagcgccatgcaggtcaatctggcgctggtgacggtgcagcagaatgaagtggtgaaaaagctggcgggctggggggcgatcctggtgatcccgaccgtggtcttcagtatgtatggcatgaacttcgagcatatgccggagctgaagtcgctgtatggctatcctttggcggtggggctgacgctgctggcctgcggcgggctgtgggccaaactgcgtcgctccggctggctgtaaacggcaggatgcggtgccagattgtcccgctgaaaaggtcacgacccgccagatagtgaaccgatactgtctggctatgcttaacgcagcgtgcagtttttgttcctgagccaacagtgtgtgaggtcacggtgaaaaaagaggatagcagcggtcaggcagtaccgattcaggaaaacctccgctgggtacgccgtgaatggctgattcagcgtatcggtgaatacgtcctgattgcgctggtgattctgggtgcgtgcggactcttttccaaaggcgtgctgagtaacggcagcgcccgctcgccggacgggaccatccaggtggagtatgaacggtttggccgggttgagagcaatatggatatgcgcattcgctacaacgcaccggtaaccgatcgctttaccgttacgattggcggtggcgccctggataacctgcaaatccagacgctgcagcctcaaccgctggaggcggtgacgattggcagcgatctgcggctgaacttttcggcccgcaacaccggaccggatcacgcgatctggcttggcctgcagccgcgcaatgcgggccgcattcacgtcactattcatggtgacggctatgctctggcccgttttacccaatggatttatccctgacagaggcgctttatggaaacggtattacgtgccgcagcgatctacctggtgctgatggtcgtgttcaaaattgccggcagacgcactctgttgcagatgacctctttcgatctgattctgctattgatcatcagtgaagcaactcagcaggcgctgctgggcgacgatttttctgttaccggcgctgcgctgactattatcacgctggtagcgattgatattgtgctgggcaaactgaaaagtcgctttccggtggtggagcaggtgatcgatggcggcccggtgatcctggtcgagaatggtaatctgctgactgaccgcatgaagatgaccggcatcagtcctgatgatgtgctggaagcggcgcgctccgggcagggtctggagcgatttgatcagattaaatatgcggtgctggaggttaacggccatatctcgattattccccgagccgataaagagtcctgaggggcgttcgccctgacaggagagcgcccgtgccggagccgcgcaggttacacacgcctgagatatcctcatccccttgctgcagcaggccctggatgcattacagatcctcattgcgtcacgctgcgcttgttatgccgcttcccttgtaatcctgtcgatttcgttcagactgagtattccactcatgctttatcatcagagctggcctgactatcaatcagcgttatgcttttacagtcaggattaaatgaatgaatttacgcgatttaccttctacccggttaccggctggcaaattggtcccctgaatacccatcaggcactggtagtgaaattcggttatatcgatcccaatgccccgcgtgaaaagggcccgcaggagaccctgtttctgggtctgaccctcgaaatggcgaaaaagctggtcgccaatctttccgaacacatcgactacgctgaaaaaaagagcacccagcactagtttctcaccgcgatcggttaccacgcccaccgtcgggctattttgctgcgctgtcgcccggtgcataaacccgcagtgcactggctatcaggcgaaaatgtgcgggtgtctgaccgataatctcaccatctgcattgatgtaatggggacggcgcgtctcaatcgtcagctccgtggcgctgaatgcccgcacgttacgccagcgaccgtgagtgccgcgccgcagaaagggcagcagcgcaatgagctgccagctatgctgcagctccagactgtagacatccagtaacccatcgtccggagcggcacgctgttccactgtcatgccgcccccataaaagcgtccattgcccaccgacacctgaaccgttttgatcggcgtccgatggccctgatgcaccagcgtagcgctgaagggacggctctgccgcagcacccgcaaagccgccagggcataaccgcccactccccagcgttttttcgattccgccgtgaggttgcgcgccagttccaccgaaaagccgatgctggagacgttcagaaacaggtgctgattcacttcacccaggtccactgcgcgcagctgcccgtcagcgataatctttatcgctgactccaggctggcaggaatgcccagcgtgcgggcaaaatcgttggcggtccccagcggtaaaatgcccagcggcaggccggtctgcatcagtcccggcgcggccgcattaagcgtgccgtcgccaccgccgacgatcaccgcatcaacgcgatgggcatacgccgcgattaattcgctgtagctgcgggtatcatctccggccggttgcagcagggtgaacccggcctgagccagcagcgactgtgcgcggctggcctcggcgcgtcctttgcgcgagcgctgattaatcagcagcagggcagttttctgctgttgagacatacttttgcgttatcccgatgtcaaaatggctgtaacgagacggcaagtacagcactggcctgaccggtgaacaaccctgcttgcgctactttacgtaacctgttgagtgccataagcggcgataaagatcgtctacactgctaagggtcagatccacactgaggagttgcgatgacagaacacgaattcagaaaattgttagccgaacagggttttgacgagcctctgttgattgagcgtgcagccgccgcccagcttgataatcacgtacatccctttgaagcactggcactgattctgagtggtgacatcaccatcagtaccgaacaaggcgataccacctatcatcccggtgagacatttcatctgcagccaaatgaactccatcgtgaggcgttcgggtcgcagggcgtacgctatctggcgggacgtaaatatgagtgactggcaatcagcatgaaggtttctgacgatctttttacccggctgtcacgctcgccgttccgtcagcgctttcgtctgggacgcgcggaatatgattatgcgagcagcaaaggcgagccggtattgcgccagcacgccgctgagtttgtggcacagcggctggcgcctgcgcagcctgaaaatgatggcaagcagacgccgatgcgcggccacccggtgtttatcgctcagcacgccaccgcaacctgctgtcgtggctgtctgagtaagtggcacaacatcggacagcaccagccgctgagcgcggagcagcagacctatatagtgacggtgttactgcagtggatcactcatcagatgcagcagcctgcaccgcctgctcgtgtcagccgaagccagccgaaaccggacgacgatccgcaactcgcactttggtaatggacgaaaaagctacagccggcggctttttctggtgaaaactggccctttttcattcctggtttattcttaaatctttcctgggaacactatgccaggattaaaacctacacggcaacgattcatacagagggaattatgaagaaatcaattattgcactgtctgctattttgctggcctcgccggtatttgctgctaccaccacagacaacaccgttgcggaagcgcataaaggcgccgataccgcgaaggaaaaactgcatcagacccagaacgaaggcaaagagctgaagctgaagtctgagcatgccgctgaaggcaaaagcgataccaccggcagtaaaattaccgaaggtacgcagaaaggctggcacaaaaccaaagaaggcactgagaaaggctgggataaaaccaagcagggtgctgaagatctgaaaaacaaagcgactaactaattcgcggctgttctcaggttaaaaaaaagaacccaccgaaaggtgggtttttttatggctgacgcggattacgctttcttttccgctgtttctttctccgatgcggctaacgccgcgactttcctttccgtctctgcagccgcatcggcggaggccgccgccgcttcagccgcagcctctgccgcggtatcggactgtttcttaccttcttcgataaactcttcgtcgatggcttcgatgttttcgcggttatcgcgtccggagagcaggttccagcaggcgataaacagagcggcaatcaccggaccgataacaaaaccgttgatgccgtaaatctccatgccgcccagcgttgcgatcagaatcagatagtcaggcattttggtgtctttgccgaccagcagcggacgcaggatgttatcaaccagtccgacaatcaccacgaagaagcccaccaggaacagccctttccacagtgcaccggtggcgaagaagaagatcgccgcaggcacccagataatggcggaaccgactgccggaataagggagaggaaggccatcagcgcgccccacagcaggctgccgtctataccggtaaaccagaatgccagcccaccgagaataccctgaacaataccgaccaccaccgtgcctttcaccgtcgcgcgcgccacggccgcaaacttcaccatcaggtgatgcttcacgtaggttgagagcggcagcgcttccaggatcagatgcaccagataggagccatctttcagcaggaagaacagcagataaagcatcacgccaaagccgacggtgaagctgaacgtccctttaccgatgataaaggcgctgcctgccacatactgaccgcccttaagggcaaacgaggagagcttctgctgaatctgttcggcgttatccaggttgttttcagccagataatgttttgcccagcgcggcagatgctgcaacagatcggcgaagaccgccgggaactgcgccgaattggtctgcagtttgtgatagaccgcgttggtttcgaccaccagcgatgaggcgataatagccagcggcgtgaacacaatcagacagatacagagcagggtaatcaacgcggccaggccattgcgttcgcccattcggacccgcagatacgttttcagcggatggaaaatcaccgccagaatcgccgcccataaaatcggcgagaaatagggcgaaagcacctcgaaaaaaccgagtgtggcaatagccagaatcaaaatgaaaaacccgatgttcaatcctttaaaacgcatggaaaaacctcatctcgaacaactctgataaacccgacgcgcgaattttctgtgtctggctttgcttatgcggctgcctcgtcactgattatcggtcaggctttgctttttaaacgctgctgatgacagcatcatgctggctaactctttgaaaggtctggcagaagtgatgaacgggcaatgtgcgttcgctgcgtgacttcctataggtaacacgctgcaactgacagcagcgcgctgaatcctacattagcgtagcggtttcgaccattattggtaggtcagagactcatgatcccgggggatgctgccgataacagtattaactggataaaaaacaggcaatgaaaaatgagtaaacagagcgtcttaatcgtgctgctgacgctggtattaaccggctgcgccaccaagcagtatccgcaggcatccgcggtcaccccggaagagacggcgatgctgaattgcagcgcgctggatcaggagctggtgaaagcgcacagcgtgcagagtgatattgagcagaccggccagttcgatgcactgaccgtgctgggctttgtcggggatttcgggctgggcaatggcattgcgaaatacaatgccagccagaaggcggagcggcgactgacgcagttgcagtcgctgaaagccgcgaagtgcagccagcggctttcgtagcgactgcgccgggtcagccgagcgtccgtttcgctgacatgctgcagccggacattttcggcggcgcgtttaccggcaaggaaggcgtgatccgagttgtaatattcccactcgctgtagcggcctgacagatgaatgtcctgggtcagcagccactggcggatcagcgccacgttagcgctgcgcgcatggtcatagaccacgtaggcgtagggcatatcgacctctgaggcgcagagcagcggatcgtccgcggtgatcatgccaactctgatgcaatcctgacggcagcgctcaatcagcgcatcccccgccagcggcagcggattggccgcgttataggtgatttcgcaggttaagccgaaaccgcccggcgggttgcagtgcggactcgcattgccctgcacaaagatgcggtgaaacagcgtatcgccaggatagtaaatccagtgcttttcggtcaggtcggcgcggccaatccccagattaacgcagcgcaccgagacaaactgcaactgctgcaccgcccgttgcacactatccggcacttcatcgcccatcagtttaatcagctccggcagcggcatggtgctgatcaattgttcataacggtagtggcggccatccgccagcagcgcgacgtgcgcctgcgggtagaggcgggtcagggtggcgtccgtttccagcgtacatttcaggtgcggcaaaaagccggacatcagcgcctggaagccaccgcgcagcggatagccgaaacgggcgttggggccaaccggtttcgccagcggttgcagcgcgccatcaatgatctgcgccagatcgggcagcggtacgcgtccgcccagccatgaagtttccatgtcggtcagcggcaccttccacagtttctggttgtagggcagggcaaagtgacgcgcgatgcctttgccccaggtgcgcataatgaagtgctggaaatcctcttcgccttccaccacgcctgtgctgctgccctcatcggggatcgcgccatctgcgcagcagtcccgccgtgcccgcgcccgatccagtggcacagcggcggcggccgtttcgccataacgcgcctcgatagcgcccagcacgcactcttttaccacctcgaccggcaagccgtgtagcgcggactggaagggatagcgggtataaacgccgtcgctgtagacccaggcttcacgcgcctgccagtgcaggttgtcgcccagcaacatctcatacagctgcaagacgtacgggtcctgcgagaacataatgtgaccggcatagtcgaaggtaaaaccctgatcgtcaatcgagcggcaccagccgccaggcgtggcatttttctccagtaacactgcgccttcgccatagtgataaccggcgctcagcccggttggcccggctccgataatcaggcagggcacagcttcactctccagcatcaatggggttaacggcgtgatattcgcctgcgcgctgccctggctggccgaccttagtgcgggctgacgctgcgtcagcgcctgctggatcagtccatgaatctgttcagcggtgcgatcccatgaggtggcatcgacctttgcctgcatccgtcccgccagcgccagccgtttctgcggcaccaatcgccattgcctgttcacaggcggcaataaattcagcggggctctctgccaccgccacttcctctgcgtaatgccgcgctacgtcaataatcgcggtactgacaatcggcagctgcgccgccatatactccagcaccttggtcggtgagatgaagcgggtcgaggcattgatggcaaacggcatcagacagacatcccagcccgccagaaactgtggcagcgcctgatagggctgctgtccgagccagtgaatattgtcgcgctgcggcaggctggccggatcaatttttaccaccggcccgaccataatgatctgccactcggggtggctgtccgctagcgccgcaatcagcggcaggtctatgcgctcatccagcacgccgtaatagccaagacgctgtgccggaatcgcatcctgcatcggatgacgattgctgcgatcgcgcgcctgctcaaagtggatagcatcaacgctgctgggaaagcagtaaacctgaggatgtttgtcacgcttcgcttcatagaggctggtgccgccggtaaagaccagatcggcacgggtcatcagcgcggattcgcgctgctgcagctggcgcggggcattctgaaaagcggaaagctcatccatgcagtcgtaaatcaccagtgagggatcaaaaggtgtcagcaacggcagcgccatcggcgtatagaaccagatcagcggctgttcatcttcctccagcagcggcgtcagcagcagcagcagcggggcgatctggctgtcgtggaaaccaggcgcgtcgctgtcggtatgcggctggatcaccgtgatgttagcggcaggcgagctctgatgcaggccctgtggccccgcctgccagaccggctcttcgacaaacagcacgcgatagtgctgtgccagtcttgtcagtagctgctgcggacgctgaaaaacaaatccccagcgtaaatggctgaaaacaatgagaacaggtggtttcatagggtgctcctgacaggggtgttttaaggagtggatgtgctgcaaaaagcgctgcgcctgacgtaatgcgtcggcataaggctgctgtagctggcgggcatagggatcggcccccagcagatcgagatcccacaaaccgctgcgggtccagaaagtcgtctcctcccataagggacgatcgaggatcggatagaggcagatgccgtgcagctcaacgcctgccagttgcgcctgcgcaacctgcgcggcgatctcaaggatccagcttccgcgtccgctgccgacgtggctggtttccgccagcagcagtggccgctgataacgctgccagacctgctgcagcatccgatgcagcggcaggcgtcggctgtcgcccagatgccagtaaagccgccggtttgatccctgctcccactgattgtcgtggtagtaattcacgccaatcagatcgagatagcgtggggcgccgcccagttccgggttgcgcctgccgctcagcatgtcccatgcctgatactgggtgtcacacatctcacgtgccagcacgtcgctggccggatcggcgggatcgggcacgatatggatcagtggatcacagtgcagcagacgggctcgcggatcggccagccagatggcatcacaggctgccagcgtagcgcgcaccagctgctgcttggcggcatccgcccgatccgcttcagggatcgcctcacaggtgaacagccctaccgagataccccagctgacaaaggagatctcattcatcggagagtagaccggcgcctgctgataccagggggccaggaagcgggccagtgcgccacagaaggcggcgaaacggctgacaaagtcgtggtcaaacaggctgacgccagcgggccagccgtagtggcagattgtccagctcagctgaatgccctgctgctctgcggcctgcatccgggccgcgaccgtcgagaagtcatagcggccatcgtgctcacataaccgccagccgacgctttcgcgcactgtgcgaatggaaaagggggccagcgcggcataatcttctgctgcacgcgcctgatgctggttaagatcgttcatcgacagcgcaaggccggcaggattgatatgatcggcaccttcgtagccggcctgccagaaactggaaaagggcgtcatggcatctcccgaaaaaaagcaacacgcttcccgctgacgagccgtcgtgaaacgggtcagggcgtcagggtatgcattgcagactgatcgatctgaccactctgaacggacgggcgatccatgccataagccacagacactgagttgcaggcatcagggcctgtcgcggtgtggacgagtgagatagcaggtataggccagtgacgctatcggcagaaaaaggctggcttctctggatgttgaaaggatttgcggaagccttactggaaagtataggcagtaaggtttggttcgcaatttattgaagtaaaagaaaaaagcgcagcggtaaaaattatccagccagaaacaggaagttttagcatgcggttttgcgaacggcccgataagcgtagcgtgaatagtgtcagcgccattttcagctttgttaaccttttcctcaacatgcagagaggtcagactcgcccactttcgcgttacagcttcgcttgccttttggcgggctggcgacaagatttacttatcactggcctgaatcagcgggtcatcaacgggtgatgcgacgatgcgcgccccctaaaacaggatgttttacagactatgttctcattcgactggcaccgtttcttacttaacgatcaaccggccacctttttgtttgaggtggtggtacgggtcatgatcgcttatctggtggtgttcacctttctgaaagtctcaggacgacgcggcgtgcgccagctgtcgctgttcgaactggtggtgatcctgacgctgggttccgcgtccggtgatgtgacattttacgatgatgtgccggtgctgccggtcattatggtgtttgtagtcctgctggcgctctaccgcttcacgacctggctgacggcgcacagcccgcgcttttcacggcttattcagggcgacgtgattaccctgattaaagaaggattgtatgtgctggagagtctggatcgtctgaatatttctgaagatgagttttatatggagttacggcagagtggtgtagagcatctggggcagatccggctggcgctggtggaggttgatggtcagctcagcctctatttctacgatgacgatgagatgcgcgccgggttaagcgtactgcccccagagcaccggcaggattacagcactgtgccggtcagcgcgctctatgcctgcacccattgcggccagacgcagatcattgaggctgagcagcaggctgtctgcccgcgctgtcagcgacagcgctggtccgcggcactgaccgtgcgtcggctgcattaatcgccagcatccgctccgcgttcaggacttgtcgcgtttgcatcagccgggttaacgtcggcgaagcaggcgctgagcgggcgcttttgctgtcccccggcagcgaaattatccgcacttagccaggcactcagggcgcgctgaacatccggccattcacggtcaataattgatagccagtcggtatcgcgattacgctgtttacgcgtcatcacctgacgaaaacggccctcaaagcggaaccccagccgttctgctgcgcgtcgtgatgcgatattggttgaatcacagcgccacgccactcgccgatagccgagcgagaaagcctgttgcagcagcagataaatcgcctcgctgccgatgacactgcgctgcatcagcggcgaccaggtgacgtgaccgatttcaacagtgccgtgtcccggctcaatgctggcgaagcagaccacgccgcagggctgctgatttggcgagcagaccgtgaaggacaccagggccgcatccgccactttatccgcaatccagtgctgcatctgcggcagagaggcgggccgctctgcgctcagccaggtccagtcgcgatcatccggtgccagcataaatgcctgcaatagcggttctgcatgatcgatgcttagcggcaggagaaggcagtgctgacccgtgagtggcatacagggtggtctggtgaccggttgccagtcgggcagagcctcaccgaccggctgatcaaactgattgaggttcaatagcattctcctgaaagaaaacggacggttagccgggaaacttatgatgccgggctgacggactatcctgaaccgcggttaaacccgtcgcagcttgttcccgcttaccacataactttgcctgttactgacagaaaatgaaaacccttcgggcagcatagcggcaccgttaccaaagaggtgtgcgtatgaaagtgaggctggccagtgcattactgtttttgctgttatcgtttggcgcgttttcacaacaggtgatcagcgaaagtcatccccattcacgcagtgcgcgatggctggagcagggcagtcaggttgatacggcggattcgccggatgaacatctgctggagaggcgggagtggcgaagcagcctgcaacgcaagccgtttctgagatgagatccccggcggaaaacagccggggagccaggggttaagcgtttcagacccgttgtgaaattatattgtggcctgtgtcgctgccatgccaggcaccagaatcaccttgcggcactcctcttcgcgtttggcgaaaatatcgtagccacgcgcagcatcttccagcggcagatggtgggtcacaatctcttccggcgtcagatggccctgttcgatcagcttcagcaggtcgggcagataagcgtgtacgtgggtctgtcccatcttaaaggtcagccctttgtcaaaggcgtcaccaaacaggaagccgtgaatgaatccggcgtagacgcccggcacgctgacgataccgccacgccgcactgcggcaatacactgacgcaacgctttaccgctgctgccttccagtttgagattggtgagcacggtttcggtcatgctgccttttgcctcgaatcctactgcatcaatcactgcatccacaccgcgattgccggtgctgtgttcgataatccagccggccgggtcatcgatctcatcaaagttaatcgggataacaccgtagcgctcgcgggcaaagtttaagcggtagttgttgtggtcgatcatgtagatctgttcggcaccctgctgtcgggcgcaggcggcactgagcaggccaaccggtccggcaccgaaaatcgccaggctggagccgggtttcacctcggcgtttttcaccgcctgccacgcggtgggcagaatgtctgacaggaacagcactttctcatccgacagtaccgacggcactttaaacgggccggtattggctttcggcacccggacatattccgcctgtccaccgggcacaccgccatagagtttgctgaaaccaaacagggccgcgggcggcgtgatgtttttccggttcaggatggcaccacgtccgctgttggtattttcacaggcagcatactggctcatcaggcagaaaaaacagtcgccacaggcgataacaaacgggatcaccacccgatcgcctttggccacggcggtcactgcgctgcctgcttcaaccacttcgcccataaactcatgaccaaagatatctccgtgcccggtaccggggattttgccgcggtaaaggtgcaggtctgaaccgcaaatagcggtggcggtcacacgcagaataatgtcatctgcggcttccagacccggatcgggcacgttatcgacgctgactttatgggggccgtgataagttaatgctttcatctgttcatctcctgatgattaggggacggcggccaggccagaaggcgtggccacgcacgggaaagactcaggaaacctgaaatcgaaacctgtcagaagtgtagtaattctttaaggagtaagcagagcggtgcagccggctggtcagtttcagccgggctgacagggcggctgcacctgcgttgtggcggccgtcacgacttgggtgtcgggttgccagagagcgaggtcggcaaacgcacgacgataaaccgtgtcgatttgtgccggaacctgttcgatgtagtgccaggcatgctcacgcgtttcaccggtgagttgctgcagatagtgccgcgcgtcgtccagcgtcgggatctggccttcgacacccgccatgcgggcaggcagaccggtccagatcagaccttctatgcctttggtcttagcccattctgccagtggtcccgctgaggtcgccgtcaccgtcatcatcccgatgccatcgatacggctgtccggaatggcttcacggaggcgcaatgcgtggcaggcgctctcaagtgaggcggtattcagccaggcccagtataccggcaccgggctggcgttaagacagatcgcggtcgacagctcgccgccgtcagcgatgcgcacaaactcaatcggtagctcaggaccatcatgatgccactgactggccaccggcagtgcgccagctttccagattaacgatccccatccgaggcaggcaattttcattctcttctcctgtgcacctgtcggcgtgatcgcgacagaatctgttaaagcgtagcccgttgcgctgaaccgttacagggatcacctttttaggggcggtaaaaccgctgcaaagatggcatgatcgccgcgcagtcactttgcacaacctgacggttttttcagcaatccatgcgtgtttatctgcacggcttgaacttttatcgtcaggtagtgtaaaaattggcgcacgcaatcgattacctatgcacggacgggtcagcatcacgttgactgatccggttgcagctgaggcgcagagtggggcggacatttgcctgcctgacggctcaggttactggcggcttttaaaacggaagatctgatgaaaaccacgcaaactggcacgctgggcgcgcttgagagtgacgtcgatacgggatggcgcaaaaccgacaccatgtggatgctgggtttatacggcacggcgattggggcgggtgtgctgttcctacctatcaatgctggcgtcggcgggctgatcccgctgattatcatggcgatactggcgtttccgctgaccttttttgcacaccgtgccctgacccgattcgttctctccggtaaaaatccggccggggatatcaccgaggtggtcgaggagcattttggcgttggtgcgggcaagctgattacgctgctctatttcttcgctatctatccgattctgctgatgtacagcgtagcgatcaccaacacggttgagagcctgatggtgaatcagctcggcctggtgccgccaccgcgtgtgctgctgtcgctgctgctgattgtcggactgatgaccattgtacgtttcggcgagaagatgattgtcaaagcgatgagcgtgctggtttatccctttgtggcggtgctgatgctgatggcctgctatctgatcccgcactggcacggcgctgtgctttcgaccctgaacgttcagcccgcgggcagcagcctgtggatgacgctgtggctggcgattccggtgatggtcttctcctttaatcactcgccgatcatctcctcattcgcgctggcaaagcgggaagagtatggcgatgccgcagagaaaaagtgttcgcgcattctggcctgttcgcacctgatgatggtggtgacggtgatgttctttgtcttcagctgcgtgctgagcctgtcgcctgaagatttacacgccgccaaggcccagaacatcaccattctttcctatctggcgaaccattttaaggtgccgatgatcgcctggctgggaccgctgattgccattgtggcgatcacgaaatcgtttctcggtcactatcttggtgcgcgcgaaggatttaacggcatggttaataaggcgctgcgcagtcgcggcaaaaccatcgcgcccgccagactgaatcgcctgaccggactctttatgctgctgacgacctggctggtggcaacgctggaccccaatattctcggcatgattgagacgcttggcgggccggtcattgcgatgattctgttcctgatgccgatgtacgctatccagaagatccccgcgatgcggaagtacagcggtcacatcagcaacctgtttgtggtgctgatcggactgattgccatctccgcaatcttctattcgctggtgaagtaacacttagcgcaacaggcgcatctcaatccccctgggatgcgcctgccattctgcccgcccttcgccattctctccgttcacctctacgcattcagcgatctcgccccgtgatttgagcccggtgccgcgttgttaatgccgcctctcagacgcatctggttagcaatagttacatttggtacttatcagcatggtagagttaacgcgaataattattattccctaaaaggacaggagaaaaatgaaaatcgggatagttgctgccaccacacttttactgtcaaccacctgtgcggctaccacctatccggtcacggtgaccgatatggatggtcagaaaattacgctgcaaaaagagccgcagcatgtgattttacaggatgggcgtgacgtgatggcgctggcattactggatcgccagaacccgtttcagcgtgtcgttgcctggaacaacctgccgaaaaagcaggatacccagacctgggacctgctgaagcagcgctggccgcaggcggcatcgattgttgatatgggctttaacgatcaggggcaggtcaatctggagagcgtgctggcgaagcagcccgatctgatgattgcgcagctgcgcgccaaaccggccctgacgcagtcaggcgtgctcgccaccctgaaaaatctccatatcccggtgctgttccttgatgttgaacttcatccgaaagagaacaccctgaagagcgtgaaagtgctgggcaccgttctgaatcgcgaagccgaggcgaaagcttacgccgatttttaccagcagcgctggcagatgcttcagcagaagattgcgcaggtgccgcacaagccaaccgtgtttattgaaccgattgccggtaacagcgacaactgctgctttacacacggtcataacggctggggcgcgctggtggaagcggtcggtggcaagaatatcggttctgcactgctgcccggcagctcaggatttgtgtcgctggagaagattatcgccatgaagccggacgtctatatcatgaccggctctaaacgcccgaacagtaacgtgctgccgtttggttacggtgccagtcagaccgacgtgaccgccacctttaaccgcctgcagagccgcaccggtctggagcagatcgaaccggtgaaacagaaacgggtgtatggcgtttatcaccatttctataatcacccttacaacattatcggcatggaaattctggcaaaagatctctatccggaagtgttccgcgatctggacccgacggctgattaccaccacatcgtgacgcactttaccgggttaccggatgcgccagtgatcctcagcacgccataaccgcaaaaatgtcagggtgcgtttcagcatcctgacttttcatcggccatcatccgtcaaccagagcgtgattttcagacagcgcaggttgcccggttaacctctggattgcgtcagcaacgttgtcatcgcatgtcctgtgttaagaaagcgctaagcaagcgtaatagtgtgtaagttaccggattttaagacttttacagatgtctcccgccacaattattgccatgatgccgatcaacggtgcctgaacagccgttattttcggaggcagtatcatgaaaaaaacaacattaacgcttatcgcttcacttttgacatgcagcacactcttttctcaggcctcacgggcagacgatcgtgatgacgcgcaccgcaagcctgtgccgcatcagaacggtgaccatcgtgctgacaatcgcggttctgaccagaatcaggagcgtggcaacaaccgtcatgacagcgtcaatcatcgcccggatcaggacaacaacggtcggggcagagaggcacgtaatgaccgcgaccatttcgcctggcagggacacgacttccgtcgcgggcatcctgtcccgcaagagtaccgcggcgaccattaccgcgtagccgactggcatgaacgcggtctgcgtgaaccgccgcgcggttatcactgggcaaacatcgacggcaactatgtgttgattgctgctgcaaccggggtaattaccgcgctggtgctgaacagcgccctgaactgatccccaggggatggctgcggccatcccactttctttccgttttgccgcgccagcggctatcctgacactccacgctgaaaattccctgtgtaaggagtcatgatgacgacggttaagatggttgcggtagatatggatggcacctttctggacgataacaagcagtacaatcgatcccgctttctcgactgctatcagcaactcaccgcccgtgacatcaaatttgtggtggccagcggcaatcagtattaccagctcaaatccttcttcccggagatcgccagcgatatcgcctttgtagccgaaaacggcgcatggattatcgatcgtgatgaggaactgttttgcggtgcctttgaacgccgcgatgttgacgcggtgatcgataccctgcaaaacggcgactatccgggtctgcgttacctgctgtgtggccgggagagcgcctggtacttcgacggcatggaagagaactggctgaagaagatgcgccattactgtcaccggctgaagccgattcatcatctggatgaggtgcagcatgaccggctgtttaagttcgcgctgaatctctctgatgactatatcgagccactgatggcggatattgaacgtctgcatcaggggcgagtggcagcgacctcaagcggtcacggctcggtggatttgatcgtgccggggaatcataaagcgcacggtctggatctgctggcacaacgctgggggatcgcgcacgaccaggtgctggcctttggtgatggcggtaacgatctggagatgctcagacagtctggcttcagttttgccatggacaacgcgccacagcgggtgaaacaggcggcacgctatgccgcgccttctaacaacgagcagggcgtgctgcaggtgattgagcagatgctggcaggtgaggggccttttagcgccacgcaggcttagccgtctggcgctgcgattaagccagggcggttagcgccgtgattcagccagccgcctggctcagagagcgggtgcaacaggatagcgctgaggagcagcaaagccgggcgaggctggcaggcccggttgtgcctggtcagcgaatgcgggcaacgcggctcctgatcacgccgtgatttcccaggcctgcgcgatcatcatctgcatctgttcgcggctgtaattcaccagcgaatttttgctgttggctcgcgccagaatccactccacctcggcgcggctcagtgaagggccatcctgccagaatggggtgatcgcctgctgctgcagccactgtttcagaaactgcgccggtgagtccgtggtttcgctgaagagctgcgggtgcagttccgccattagcttacgctgcagcggctgttcgctgtcggacaacagatccaggaacggaaacagcagacgtccgcacacttcaccgtgatggaacggctttatcgcgcccagtttcccccgcaataccgtggatcacccccagacccgcactgctgagactgacaccgcccagccacgacgccatcatcatcgcttcccgtgcctcgtcgccagcagcatcctcacgattaagtgcaggccaggcctgaacaaactgacgcaggccggtcagcgccagctgtcgggtaaagaggttgcctttgccggagagatacgcttcaaacaggtgggtaaacgcatcaataccgcaggttgccagcacccggtccggcgcacctttcagcagatcggcatcgagaatcgccacctccggcacaaagaccgggtgacgcagtgatgcttttatctgaatgtcacgctggtcagtcaccaccgcattttgcgtcacttcactgccggtgccggcagtggtcggaatagcaatcagcggcaatgtgatgggctgaaccgcggtgtcacccactttttccagatagcgggcggttggcaatgggtgttgtaccatcgcactaaacgctttcgccgcatccagcacgctcccgccgccaatcgcgacgacccgatcgacatgaccgcgccagcgcgcaacccagccatcaatctcggcgggtgaggcttcatgactgacaatttcatagccaataatatgatcgttgagtccggcttttagccgggcatatgcggggccttgcagaaaagattgtccacaaaacagcagagtaggctgtgaccgggcggccagcagcggcaccagtttatccaggctgccccggccaaagagggttcgttgattactgtacagctcactcaggttcttactcaccagcgcatcctttttacatttcgctaaaatctgagtgtaacgaaaagcaaggcgccgggactggcaaactttctgataacgcattggcaaaaagttgatcaccttcgcaaaacagaaattcacccccggcggggtggtgctttcctgctgatgttacccttaacatgttatcggtaacagcgtttgtcgggatgtgtaaacatcttacagcgcactgttttgtagccctcaggggatcatgataataaaccgacactgaatgatgttcagtgcacaaggtggagaaaagctatgccattactctatgtggcgattggcgtcgcgttactgctgctgctgatgattcgctttaagcttaatggatttatcgcgctgatcctggtggcgctggcggtcggtgtgatgcagggcatgccggttaataaagtgattacctcaatcaaagcgggcgtgggtggcacactgggcagcctggcgctgatcatgggctttggtgccatgctcggtaaattgctggccgactgcggcggtgcgcagcgtattgccaccaccctgattgaaaaattcggcactaagcatattcagtgggcgctggtgctgaccggttttatcgtcggatttgcgctgttctatgaagtcggctttgtactgatgctgccgctggtgttcagcgtggcggcgtcggcacgtgtgccgctgctctatgtcggggtgccgatggcggctgccctgtcagtgacgcacggctttcttccgccgcatcctggcccgaccgcaatcgcgacgctgtttaacgctgacatgggtaaaacgctgctgtttggtacgctgctgggtattcctacggtgattctggcgggtccggtctacgcccgcttcctgaaaggcatcgacaaaccgattcctgagggtctctataacccgaaaacctttaccgaggcggaaatgcctgggtttggcgtcagcgtctggacggcactggtacctgtggtgctgatggcgctgcgtgcggtggcagagatgctgctgcctaaaggccatgtgctgctgccctatgcggagttctttggcgacccggtgatggcgacactgattgcggtgctgattgcaatcttcacctttggactgaatcgcggtcgcacgatggaacaggtcatggataccctgaccgactcgatcaaaatcatcgccatgatgttgttgatcatcggcggtggcggtgccttcaaacaggtgctggtggacagcggcgtggataaatacattgccagcatgatgcattctactcagctgtcgccaatctttatggcctggtcgattgccgcggtgctgcgtattgctctgggtttctgccacggtagcggccattaccgccgggggaattgtggcaccgctgattgttaccagcggcgccagcccggaactgatggtcatcgccgtagggtccggcagcgtgatcttctcgcacgttaatgacccgggcttctggctgttcaaagagtatttcaacctgacgattggcgaaaccatccgctcctggtcggcgctggaaaccattatttcggtctgtggtctggtgggttgcctgctgctctcctgggcgatttaacctctggccgctggcaagcctgccagcggctctctgctttcgcgtctctcccgctgcctctttgagctttgaacatcccgtcgcgcttggtgcccctgttgccggttaaaccgggatgtgcgggacagacagcataaaaaaggccgcaaggtgcggcctgacagagaagattcagtctgaatctgccacgttaatgaggctgttcaaaaccggctttcaccatctgttcccgcagcgcatgtgcaatgtcacggttgccaccggtaacggggtagataacgttattcaccacatcatcaaggtagtgctcgtcaaactcctgcagagagagctgcgtgccgccttcatcgttgatggcgaaagtccctttgatgtggttaccgctgttttttgccttgaggctgtagcggcccatgctggtattaatcgtgctcataagatctcctcgcgactcattttcaatctcatcactcttgaggcctgccttgccgcctaaattttagccaggagtgttctgtaaaacgaagaaagagagccgttaaaaagtggtgttgcgatcgttatctcagaatttaaataaagctcagggttgatgaacttatgaccagttgagccttaagtgaagcggcagggcgcattttcctgtctataatgcttacaggaaaagtgtttaattggtgaggggaaaggaaatgaaaattattctgtggattattgcgatcatttttatcgttggcttactgaccctgacaggggtgttcaaactgattttctgatatctgttaacgcttcagcaacagcgggcacctaatcaggtgcccgcaatgttttctggctggccaacagagcgtctgtaatgggatccatcggcgtattgggcagcagatcctgtgagcccagaggtttcttacagtatgcgcagcaggcaccatgaaagtttcgctggccctcgcggtaatcagtaaaaacgaatcgggcgcttccacattgaccgcaacgtatcttcatcaccatcctgtgtctcaccctccttttactcagcattaacggatgcttgtgcctgacaggttaagcggactttatctattgcgcggcaatattatttcgcactgcgataagaaaagtagtttcttatgcttttgattgtttgttgccaaatgcgcattcggccactaaaaagcatttcattgatccagatcagtgtttattagttgttggctaaaatatccgcgaatagcctgccatgactgatgataatggcacagccgactcattttttttggcgagggagcgggatctgcgccagtgaatttaagatttatcgtacaataaatagccactggcaggacgcaggcctgaaaaagcagaaaaacgggtttaaggtcatgggacttaccgtccggatgatagaaaaaaattgaccttttaccggcgtaaacgtcattaagaacaggaatatatcttaatcagatttttctttttaacgtcagtaacgtaaccgcttaaaattaaaaagggtttcgtttccagcaggttagcgaccgatacccgctctgcgcctgatacgcgttgagcgatgtttcgcaagtcgaaaagcaggaaagtgtgatggatgtacagaatgtcgatatttatcactttttcatcaaatcatgctggacaaatccctcagcaattgctgtactagaccccgacacagtttagtgtccatttttcatgtaaaggtaatatagatgtctaagatcaaaggtaacgttaagtggtttaatgaatctaaaggattcggtttcattactcctgaagatggcagcaaagatgtattcgtacatttctctgcaatccagagcaacggcttcaaaactctggctgaaggtcagcgcgtagagtttgaaatcaccgacggcgctaaaggcccatctgctgctaacgttatcagtctgtaagttaacagtcagaattctaaaaacccgccttatggcgggtttttttatggctgtaatctgcgcttcatcccgcctgtcgtactctcactctcggcgtgttgccgcacaaactgcgcggcggttcacactaaataaccgtaacatatttataacaacccgatatgcagctttttggcttgcgacgctatataactgtgcgacagaaaacccggtgagtgaggaggcaggatgaacatacgtcaggcagagttgaaagacagttttgcgttgagtgcattactgagcgagttaggctacggcggcactgaaagctttattgaacagcgcctggcgcagttatgcagcgatcccagtgaagcgctgttggtggctgaacatggcagtcaggtgctggggtttctctccttacattttattcctcagctggcgctggccggtgatttcgcccgcatcagctatttctgcattgcagaaggtgagcgcagtaaaggcgtcggccagcagctgattcagcatgcagaaatgctggcggctcgtcgtggctgcgatcgcatggaagtccattgccatcagtcacgtctcaaggcgaatcagttctacacccgtgaaggctatgttgaatccccctgttatctcatcaaagatctgcaagcgagttaaattcccgtccgctggcgatgaccagcgccccggcaatcatctcccgctgttcatccctgaggctggcgatactgacgcgaataaattgggttgggccgagccgacagcgctcgcctggcacgaccgcaataccgcgggcagccagcgtgatcatggcaaactgctctgaagtcaccggaatatagaggcttaatccgtcgcgaagcggcagatcaagcccacgctgtgccagcgccgtgagcaacgcttcacgccgttgccggtaggtcgcgcgtgcggtggcgatctgccgttgcgtttcctcatcctccagcagccacgccactgcatcctgcagaatgcggctggtccagctgacgccaaaatttcgccatgactgaatgcgcctgaccatctccgaggtggcagagagcactgccagccgcaggtctggtccataggctttggaaaacgaacggacgtgcagcgtgcgctcaggaaagattgaacccaggctccagctcgcctccgcggagagatcgccaataccatcatcctcaacgatcagtgtgttgctctgttgcagaacctgcgccattgcctgacgtcgcgccgggctgatgctgttcccggtggccgagtgggtgcggggctgatagatcaacattaccggtgcctgctccagcagaagagaaagaacctctggcagcgggccttgatcatcacacgccagcggcagaatctctgcgccgacgttatccagtatatcgagcagccgggtcgcggtcggatcttcaataatcacgcggtctcccggcgagaccagggtttgcaccagcagattcatcgcgtcaaaaccgccatctgtcgccagaaacgcctctgcagcatagggccagcgcggcgcgatcgcctgaagcagcggcgcggaaatcgcctcacgggtgtagctgttgagctgcggtgagtgcagggccgcctgcagcgcacgctgcaggtcaggcagcagggcggggtcgggcgcggcgagggtcagatcggcgcggatgttatcaccgtagttgccgatcttctcaaagcgaatcggacgcggcatcaccgtattactactgacccagacaccactgcggcccttgcccgccagcactttctgctttcttagttgcgcccaggcagcagaaacggttgccgggctgacacccagctgctccgctatctcccgcaccgcaggcatctgcatacctgtcgcgatctgtccgtcacgaatcagcgcggaggctgcctgtgcaatgcctttcactgaaggcgattttatctggctgcaaaaccagttgaggtcgacgctctctgtcataagaaaatactttgttcagtaacaaattaatgattgttcaggtaagtattccggatctagtatcaaattcaagcactattttatgccccgtcccgacggtgcagcgtaaacggagagatcatggcaaggctactcatcagactggcggtacgcgactgggactacttcaccccgctggcgctgggcgatatcagaccagaaggttttgaactgcagatcgaccgcgtcggcacacttgtgaatgatctggcgaccagccccgactatgacgcgggcgaggtctccttcagccgctatgctcagggccgggccagaggagacgaaacactgcttggcctgccacacttcctgatgcgcggcttccgccagcgctgcattatcaccaccagcagcagccccatcaccacgcctgcgcagctgaaaggtaagagaatcggcgtcaccggctggcaggattcgggcaatacctggacacgcacggtgctgcgtgaagcaggcgtcgaaatcgatgatgtgttctggtatgccggtcgtcttactgccgatcatccgattgtcgatcggctggcgggatttggccgcccgggccgcattgaacccgcgcctgacgagcgaccgctgatagagatgctgcaggcgggtgagctggatgccatcttcacgccatttatgccggagggctttttcctgccgggttcgggattacggcagctgcagaccgatttttatcaggcggagcgggactactttaatcgtgtcggctatgtgccgggcatccacattctggcgctgaaaccggcactggcggcggagcatccgtggctgcctgcggcgttaagtgaggtcatcgatcgctcttaccggctgtggatgcagaaaagagagaaatatgccgacaccacgccgtggctgctggacgatttgcgacgcactgcgcaggaattgcccgctgactggaatcagaatggttttagcgttaacagaaagatgattgcggactttggtcgcgagctctatgagcaagggctgactcaccaggtactgacgccggaagcaatgtttccggccgctgcgggagaagagaaatgatgaaagtagcactgggacaatttgcggtgagccgcgaatggcaggagaaacgcccgtatctgtctggacttaatgcagcgggcgacagaaggtggcgccgatctgctggtactgccggaaggggtgctggcacgtgatatagccgaccccgatttagtgctgaaggcggcgcagccgctggatggcccttttctgagccagctgctggccgccagcaagcagaatgcactgaccaccatgatgagcattcacgttcccaccggcgagcaaaaagcgctcaacgtgctggtagcgatccgcaacggtgagatcatcgccgcctatgaaaagctgcatctgtacgatgcctttgcgatgcaggagtcgcagcgggtcaatcccggccacgtcattccgccgctgattgaggtcgcgggtatgaaagtcggattaatgacctgctatgacgtgcgcttcccggagctggcgcgtcggctggtactggatggtgcagaggtgctggtgctgcctgccgcctgggttaaaggtccgctgaaagagatgcactgggaactgctgacccgcgcccgcgcgctggaaaacacctgctatatggtggcggtgggggagtgcggcccgcgcaatatcggcaacagcctggtggtcgatccgctgggcgtagcggtggcgaatgcggcggaatcgccggcgctgctgtttgccgatctcgatcctgagcgcgtcgcctatgcccgccgggtgctgccggtactggaaaaccggcgctttgcccgtcccgaactcaactgatccgctgaaccaggaatccattatgacgaagagagcaaccgccttaatcgtggcgctggggctgactgcatccctggcgcaggctgccgacgctattccggtgcaaaaagttgaccaggccctgcatgacaggctgccagatgagatcaaaaaatcgggcaaaatgatttcagtgaataacggttcatttccgccctatgaaattgtgaatggcccgcactcaatggagggcgcgtcggcggagttaacgactgcgctggcacaactgctgggtgtgaagatcgagcatgcgacggtgagtggtttatcaggcgtactcaccggcatcaatgcgggtcgttatcagctggcaattgggccgattggtgattatccggaccgtcagcagaaagtggatttcatcgattttgtgcaggagttcgtggtgttcggcgtgcagaagggcaatccggccagaatcaatcagctggacgacacctgcggcaagcgcattgctgtcatggccgctggctctgcggaacaggttatccgtaagcagtcagcctggtgtgtggccgacgggaaaccggccgtgacggtgcaggcctttaccgatcagccttcatcaattctggcggtacgctctaaacgctccgatgcgttcttctcatcacaggcgccgctgacttactttgttaatcaggcgaaagggcaacttgagctggcgggcaaagggcagaaaaacggctttggcgatattttccagggcacggtggtgccgaaaggctcgccgctgggtcaggtggtgctggatgcctacaaagagctgtatcagaacggaacgtatgcggccatcatgaaaaagtggcagcttgagggcaacatgaccaccgcacccggactgaatctggcgaaagaggccagcaaatgagcccgccgcgccatctgcacagcggcgaggcacagctgcgcgacgtggcgtttcgctcgcagcgcccccacttacggacgctggatcagctggattttagtgctggtgatcggcaccaacctattgtggctggcggcgaccaaccctaattttgaatggcaggtggtactcaagtggtttaccgaaggatccgtgctcaaagggttgcaggtcactctggggctgacagtggtgtcgatggtgctcggcacgctgctcggtctgctgctgggtgtctggcggctctctgagaaccggttgctgcgcggcgttgccggactctatatctggttctttcgtggcacgccgctgctggtacagctgatcttctggtacaacctttctacgctgtttccggcgctgtcgctgacgctgccgtggaccgatatcacgctggccagctggaacaccaacgatcttatcaccccgctgacagctgctattgccgggctggcgctgaatgaagcggcctatatggcggaaattattcgcgccggtctgctgtcggtggataacggtcaggtagagactacccaggcctttggcatgagtcgttcacgggcgctgcggcgcatcatcattcctcaggcgatgcgatcgattattccacccaccggcaaccagctgatcagcatgatcaaggcgacgtcgctggtcagcgtgatcgcaatgggcgatctgctctactcggtgcaggcgatctacaaccgtaccttcgagatcatcccgatgctgatggtggcggtgatctggtatctgctgatcacctcgatcctcaatctgggccagtccgccatcgagcgttactacgcgcgtggcactcgtcgggtggccagcgcccccagacgcgccaccatcgcggctaacgtgcaaccccagcaggaggagcaatgagtcagcgtgaacccctggtctgcgcccgcaacgtgcagaaaaattacggcgacaatcaggttctgaaagggatcgatctggatgtctggcccggtgaggtagtggtgatcctcgggccatccggttccggtaaatccacgtttctgcgctgcatcaatcatcttgaagagatgaacgccggatcgattcgggtcggtgatgagcagatcgggtatgtacttaaagggcatgtgctgcaccggttgtcgccacgccagatcgcccgtcagcgccagaaaattggcatggtgtttcagcagttcaatctctacccccatatgaccgtgctgcagaacatcactgaagcgcccatcggcgtgcataaattcccgcgtcaggaggcgatggcccatgcccgatcgctgctggcgacggtaggattaagcgataaagcggacgcctggccacgtcacctctcgggcggacagcaacagcgtgtggcgattgcgcgggcgctggcgattaagccgcagctgatgctgtttgatgagccgacctccgcgctcgatccggaactggtgggcgaagtgctggcgaccatgcgtaccctggccgaccagggattaacgatgatcgtggtgactcatgagattagctttgcgcgggaagccgccgatcgcgtggtctttatggatgggggtgtggtggtggagcagggcacgcctgaagaggtgatcgcgaatccacagcatccgcgcacccaggcgttcctgagtcgcttcatctgagatcttactctgttacagattccagttgtcgccgcaggcaaactgcgcgtaaatatcagtcaccgtgattcgataaagttgaaaggttaaatatggaaggtatcagtattgccaagctgctgattatcggtgcgcttatcgtactgctttttggtaccaacaagttgcgctcactgggtggcgatctgggctccgcaatcaagggctttaaaaaagccatgaaagatgaagataccagcgcaacccgaactgcggctgaagacgtgccggcagaaacgcgtcgttcataaagattaatcggttatttgctgcaaataactgttactttttatttcaggcacagataaaaaaaccagactgtttccagtctggttttttgtttttcaggcttcctgaagcaaaagcgtgcttatttcacttcttcgcctttggcctgcatatccgcatgataggaagagcggacaaacggaccgcacgcggcatgggtaaagcccatcgccatcgcttcttctttcatctcatcgaactcagccgggctgacgtagcgctgaaccggcaggtggtggcggctcggctgcagatactggcccagcgtcagcatagtgacaccatggcgacgcagatcgcgcatcacttcaacgatttcggcattggtttcgcccaggcccaccatcagacccgattttgtcgggatgtgaggatgcgcctctttgaaacgttcaagcagcttcagtgaccactcgtagttcgcgcccggacgcacctggcggtagacgcgcggtacgttttccagattgtggttaaacacatccggtggcgtcgcggtgagaatctccagcgcgcgatccatacggccacggaagtccggcaccagcgtttcgattttgatcgtcggatttttttcgcgaatcgcgctgatgcagtcggcaaagtgctgtgcgccaccatcacgcaaatcatcgcggtcaaccgaggtgatcaccacgtagcgcaggcccatatcggcaatcgtctgcgccagtttagcgggttcgttagcgtcaggggcattggggcggccatgtgccacatcgcagaaacggacaacgacgggtacagattgcgccaaggatcataaaggtggcggtgccgtggttgaagcattcggcgaggttagggcaggatgcctcttcacagactgagtgcagcccgtttttgcgcatcgcggccttaatgccctgaatacgactggagtcagctggcagcttgattttcatccattccggcttacgcaacatctcctgccgttcaacagccacggttttcaccgggatcagcgccattttgtctgcgtcacgatatttgacgccgcgttccatctgaattggtttactcataaatcagcaggttccggtcggattgcgatttgaaagcgttcccactcaaaccgggaaggctgctttcaactttatttgaaaaaagtgcaaaaattatatcatcacatcgcctgcgaagcagccacagtcagcgcggataagttacatatttgtaaattcgcattctgcgttaaggtttaacaggcagatcccctgaaatccattcaacattttcataacctgacagccgtgcaaacgcgttgaccagcggagagtgtacctgctccgtcgtcacctctggctggaaatttttcaactgggtcatgctcatgccggcgtaaccacagggattgatgcgcaggaaaggcgacaaatccatagcaacattcagcgccagaccgtgaaacgagcagcctttacggatgcgtaatcccagtgagcagatcttctcttccccgacgtagacgccaggtgcatcagcacgggcgcgggcgctgacgccaaactctgccagggtggcgataaccgtctcttccagaatggtcaccagctggcgtacgccgagcttacggcgttttacatcgatcaggacgtacatcacctgctgtcctggcccgtgataggtgacctgacccccacggtcactctgcaccaccgggatctcgcctggcatcagcagatgctctgctttgcccgcctgaccctgagtaaagaccggaggatgttcaaccagccagatttcatcacgactctggtcgctgcgctggtcggtatagtgatgcatggcgtcggagacagattgccagtcgcgcagacctgactggcggacaagaagagtttcaactgacaaaacgaaagcccgctaaaggaaaaaacgctgaggataacgtcggcaaaccgtcaggcagaggcgccttgccgacccgtaaattacagtaccatccgcacaatttcgatgttgcccagctcttcgtacaggcgttctacctgctcgatgtgggtggcggtgatagtgatgttgacggagtgatagttgcctttgctgctcggcttaacttcagggctgtagtcgcctggcgcatggcgttgcaccacttcaaccacttgatcaaccagctccggttgtgccagacccattactttgtaggtaaacggggtaggaaattcgagcagctcattcagtttggttttcatattaactccggtgcataaaaaacaggctcccgcctgagcgggagcaacataatatcgtgtaatgggggcgaaggggtgatttttcaatcacccgccacgcttaaccgaaccagtgatggaacatcagcttgatgtaatcaacgatacggccaaagaaacctccttcagagatctcgttaagcaccaccagcggacgctgttcgatagtcttgccatccagctggaagttgatgctgccgaccacctgatttttcttcagtggtgcatgcagttccgtgttggtcagcacatagctggctttcagatctttcatgcggccacgtgggatggtcaggtaagcatctttttccacgcccaactgcacacggtcgttatcgccgaaccagactggctcagaggcgaactctttgcccgctttcagtggcgccacggtttcaaagaaacggaagccccaggtgagcagtttcttactctcagtttcacggcctttgtaggtatgaccgcccattaccgcggagatcaggcgcatctggccttcagtcgcagacgccaccaggttgtaaccggcagagttagtgtgaccggttttgatgccgtccacattcaggttggtatcccacagcagaccgttacggttcatctgacggatattattgaaggtgaactctttctctttataaacagcatactcttccggcacgtcacggatcagcgcctgaccgatcaacgccatatcgcgcgcggagctatactgaccttccgcgtccagaccatgaacggtctggaagtgggtattctgcaggccaatcgctttgacgtagttgttcatcagattaacgaacgcatcctggctgccagcgacatagtcagccatcgcaacacaggcgtcgttaccggactgcagtacaatcccacgggtcagctgagagaccggcacgcggtcgcctggcttcaggaacatcagcgaggagcctttgaacaccgggttgccggtcgcccaggcatccgggccgacggtgaccatatcgtcctgatgaattttacccgctttaacggcctgaccaatgacatagctggtcatcatcttggtcagactggcaggatcgcggcgtgcatcggcatttttctctgccagcactttgcctgagttgtagtcgataaggacgtacgcttcggcatcaatgtccggcacgcccggaatcatggtcttgagattgacgtcatcagcaatagcagcatggctgagagagaaagcgatcagtgatcccactgtcaggcgtttcagcaaacgagatgatttcagcgtgttcatgtgtaggactacaacatccgtgagtttgaggttgaaaatgtcactcatcatacccaatgccagattaactggcaccgggcgtgatgattgggttgttagcagacgtaacgtgcagctgtctgataaacggttcagcgacgcgtgttagtaataaatgaggcggcctggccttcactgctcagacgctgttgcagcgcagccgcttcggcgcgggaggcgtaaccgccgagctgaacgcgatacacattgttgcccgcgtcttctaccttaccgggcacgccataacgctggctcaggcttttcatcatctgctgggcacgcgccgggtcattcagcgcaccgacctgcactacatatccatcggcaccaccactgctggctgcaggcgcggcgctggctgctgcgggagcagcattgctgactgccggtgcggaactggcgggtgcggcggctggcggttcattaccttccagtacgccggttgctaatggctggggtgcaccaagaaagccgctgctctgcaccggcgcgcccatgttgtcaccgctttgcagcgtactgttgctgatggcctcaacattttgcgcaggcggctctgagggggctgcgctgccgccgttcatcaccgcgccaccactcaggtccggacgggcaggcagagagtagctctgttttgccacgacggtcccgatggtgccggggccagagagcgagccgtctggggcgaccttgatgtaatcaacccgcacgcgcgaattgttggagatattcaggcggtcaccggcagcccgcgacaggtcgataatgcgtcctggcgtgtaagggccgcgatcgttaacgcgcaccacaatctgacggccattcgcgatattggtcacgcgcacatagctcggcagcggcagagtagggtgggccgcggtcagcgcatcaggatcgtaggcttcgccggtagcggtgcggttgccctgcgcctcttcgccgtaccaggtggccaggccgacttcactgtagttcgacggatctttgatgacgcgataatttttgccgttcacgctgtaatcctggctggtgcctggattgatcggctcataacgtggctcaacgcctggaatctccaccaccggtccattgtaagccggttgcggcggcgccgtattttggggtttccggcgtggtacaggccgccagaaccagtgatgccagtgcaacgccaagccattccttacgcatctgcagcctcttagacacttttagataacatttttcggtgagtgtggatcgacatcacaatgccgaatcccgccataagcacgataagcgcggagccgccataactgaccaaaggcagcggcacgccaactaccggtaagataccactaaccatgccaatgttaacgaaaacataaacgaataaaatcagcattaaaccgcccgccattacccggccaaaggtggtctgcgcccgggctgccaccaccaatccccgcatgatcagcagcagataaagggccagcagcagcagcacgccaaccaggcctaactcttcggccagaaccgcaaagataaagtcggtatgacgttccggcaaaaactccagctgagactgggtgccctgcagccagcctttaccgcgcaggcctcctgagccaatagcaattttcgactggataatgtgataacccgctcccagcggatctgtttccgggtcgagcagcatcatcacgcggtcacgctgataatcgtgcatcaggaaaaaccacaaaatcgggataaaggcggcgaccagcaacacggctacgccaatcagtttccagctcatacccgagaggaacaacacaaacaagccggaggcggcaatcagaattgaggtgccgagatcgggctgtgccgccaccagcagggtgggcaggaagatcagaatcagcgcaatgccggtatttttcagcgtcggcggacagacatcgcggttgataaagcgcgccaccattaaaggcaccgctatcttggcaatctcagagggctgaaaacgcacaaagccgaggtcgagccagcgttgagcgcctttactgatctgcccaaaggcatccaccgccaccagcagaatgacgcagacaatatagagatagggcgcccagccttcatagacgcgcggcggtacctgcgccagcacaatcatgatgaccagccccatcgcgatctgaccgagtttacgctccatcatgccggggtcctgaccactggcgctccagatcaccacagcgctgtaggtcagcaggccgagaatgatcagcataaacagcggatcgatgtggatgcgcatccagatcgaacgtttctgcggactatcttgcatcgacatgtttattcaccttcataaccgggcggcacaggagcggcgtccggcaggactgtattgttatcacccaacataatgtgatccagaatctggcgcatgacggtgccgacagccggaccggcgccaccgttttccaggataatggtcacggcgacccgaggtttgtcataaggggcaaacgcggtcattaatttatggtcgcgtaatcgttcagcaattttatgggcgttataggtttcgttctctttcaggccaaagacctgagccgtaccggacttagcggcgattttatagggcgcatcggcgaagctcttgtgcgcggtgccgttgggccggtttcgccacgccatacatgccatctttagcaatttcccagtagccggaatggatatcaccaatcggggcttcaggcggctggcgataaggtaccagggtacggccttcgcgggtggcgcgcagcatatgcggcactttgacgacgccgtcgttgatcagaatcatcatcgctttgttcatctgcaacggcgtagcggtccagtaaccctgtccgatccccaccggaatggtatcgccctgataccacggctttttaaagcgtctctgtttccagtcacgggtcggcatgttaccggcgctctcctgcggtaaatcgatgccggtacggctgccgtaaccaaatttattcatccactccgacagacggtcgatacccatgtcataggcaacctgatagaagaaggtatcggcagactcttccagcgctttggtgacgttcagacgtccgtggccccattttttccagtcgcggaagcgtttttctgaaccgggaagctgccaccagccgggatcaaacaggctggtattacggttaatcacgccagcactcagggcagagaccgccacataaggtttaaccgtcgaagccggtggataggcagcctgaatcgcacggttatagagcgggcggttttcatcttccagcaggccgcggtaatccttactggaaataccgtcgacaaacatgttggcgtcatagcttggcgttgagaccatggcgaggatttcgccggtgcgcggatcgctgaccacgacggccgcgcgactgcccgccagcagggtctcgacatattgctgcagtttgagatcgatagtcagatagatatcacggcctgcctgaggggactcctcatgcagctggcgaatgacccggccacggttgttgacctcaacctcttcaaagccggttttgccgtgcagcaaattttcgtaataggcttcaatgcccagcttaccgatgtcgtgcgtcgcggcgtagttaggccatatgccctctttgtcgaggcgtgcaacgtcacgatcgttgatttttgagacgtagccgaccacatgcgtcagcgtggcaccgtaagggtagtagcggcgctggtaacctttaacttccacgccggggaagcggtactgattgaccgcaaagcgcgcgacctgcacgtcattcagaccagttttaaccgggatagaggtgaaccgacgcgagcgtttacgctctttctggaagttttcgaggtcgtcgtcagtcagctcaagaatcgggcgtaagttttccagggtctgttgcagattatctactttttccggaaccagttctgcctgatagatggtgcggttcagcgccagcggcgtgccggtacgatcgtaaattatgccgcggctgggggccacaggcaccagtttgatacggtttctggttggagcgggtgctgtaatcatcaaagcgaaggatctgcaggtggtaaagattaaccaccagtactgaagagagcagtaagataccgacgaaggcgataaaggcccgacgtacaaagagtttctgttcggcgctgtaatcgcgaaaggcgttgctttgtaatttcatccgctacttgtcatgtctgatgtgggctgatcggtcattcacgatgataaggatgatttgtcgttatgctccaggcccgatacagactttcggctaccagcacgcgcaccagcggatggggcaacgtcaatgctgacagtgaccagctctgctctgccgccgctttacaggcgggggccaggccttcaggcccgccaatcagcaggctgacatcgcgaccatccagcttccagcgttcaatctgctgtgccagctgcggggtttcccacggatgaccaggaatatccagcgtaacgatgcgattgcctttgccgaccgccgctaacatcgcttcaccctctttttcaaggatgcgtttgatatcagcatttttaccgcgtttacctgcggtcacttcggtcagctcaagcggcatatctttcgggaagcggcgcagatattccataaaaccggtctgcacccagtcaggcattttcgtgccgacggcaacaagttgcagtttcaccgattagccccagagtttttccagctcatacagctggcgactctcttcctgcatcacatgcacgatgacatcacccagatcgaccacgacccagtctgccgcgcttttaccttcaatgcctaatggcatcaggcctgctaaacgcgactcctgctctacgtgttctgcgatcgaagtcacatgacgcgtggaggtgccggtgcagatgatcatgaaatcggtgatgctggatttgccctgaacgtcgatggtgacaatgtcctggcctttgagatcatcaatcttatcaataacgaactcttggagtgctttaccttgcaaaaggttccccttggaatctggtggtaacgagccggctgtaagcccggagagtgcagccaaaaaattaagcggcgtagtatagcatgcccggatcagtcgcgatataagccttcgcggtcgatataatcgataaccgcagcgggcaacagatcgtcgcagggctgattctggtggcgacggcggcgaatttcagtggccgaaatgtcatagagaggggtgtccgccagccagatatggcctgcgggctgctgatgcagctgccggatatcctgagcgaggtgttgctcaagccagcgctgcatgtcaggcgagtcgaaccgggtcggatagccggggcgctggcacaccagcagatggcagagtgacagcagatcctgccagcgatgccattttgataagctcagcaatgaatcctgaccaataataaaccccagcggctgttctgcaccgcgttcggtgcgccaggcttccagggtggtcacggtccaggacggcgtgtcgcgttccagctcgcgggtatcgatctcaaacagcggcaggtcgcggatagcgcagcgcagcatagcaacccgctgggcagcgctggcttccggttgcggacgatgcggcggtacattgttgggcagcagcgtcacacgctgcaggccggtctgttgcgccagcgcttcgaccgggcgcagatggccaaaatgaatcggatcaaaggtgccgccaaacagtgcgtgtaactcagacatgggcaaagctcgtcggaaaagcacgactgctgagcagcagcgtcagggtctgtaactgcggccacaccggctgtccataatcctgcttcagggtgatctcaatctgactcagcagatgaatggcgcgttgcagacgcgtggcatccagtcgttgcagcgcgtcggtaaacagcgcacggcggttctgccagatgcgctgctgatccatcagcgtacgaagcggctgcgctgtctggtggcgttgcagatgcagcagcgtcagcagatcacgctgcagcgtacgcagcagtatcaccacttcgctctcttctttctccagctgatgcagaatatgcagggcgcggcggctttttcccgccagcagggcatccacccagtggaaaggagtaaagtgcgcggcatcactgaccgcctcttcaacccggggcagggtcagcttgccgtcgggccactgcagcgagagtcgctccagcgcctgcgccagcgccagcagattgccttcatagcagtaacacaacagttgcacggccgcgtcatctaccgataacttcagcgccttagcgcgattaacgacccagcgtggcagttgcgcctgttcaggcgtctgacagggcaccagtaccgcagaggcggacaacgctttaaaccaggcgctgttttcctgcgctttggtcagcttcgccatccggcagatcagcagaatatcggcgtgcagcaactgcgacagcttaaccagctgttctgccatcgcggcgttagggccattatcggggaattgcagcgtcatggtctgacgctgagcaaacaggctcagtgactggcaactgacgaacaggctctcccagtcagtctgtgcatccagcgtaaaactaaaatgttcttcgaatccctgcgcggttgcggcgacgcgaatcgcatctgaactttcctgcagcagcagcggttcgttaccggctaacaaataacaggcgcgcagcccctcacggagctgcgcgctgagttgctcaggataaatcctgatcattgcaggctggtagcagaggaagtgggcgcttcctgtgaaccctgacccggcaccggaatcactgacgccggtaaggtctctttgctgttgatctgcgcggcgtgtaccgtcagcagtttacgtaccagctgttcagcagcacgctgacgcatctcctgcgtaatcagatcctgctcggcatcttttgccagcgcagcgttcgggttatcgaagaatgaccgataaaccgtggtgctgataggatagatacctttgcccggcagcagcacctgcgccgtgagggtcatcaccagctgatactcggcagtggtgccgctgataaagaccgaagccgtgttacggcccgaggattcaggccccaggcgcagcgtcggaatatcggtgcgattctgtttgctgtcttcaacaattttgacatcgttgatacgcagctgctgacgcacagtacgcgccagcggcccataaggatcgccggttgaaacaatcagggttttcagttcgctgggcacctgagtggtgccgcgcggatgaaaaccacagccagcggtgatcaccaccgccagcatgacaaacagcctgataatcggatgtcgcacagttcctcctgaacttaacctacgaccaggttaagcagtttgcccggtacataaatgactttacggatagtcacgccgtccagatacttcgctaccagatgctcctgcgcagcgcgtgcctgaacctgttcctgtgttgcatcggctggcacggtgattttaccgcgcactttaccgttaacctgaaccactaccagcagcgaatcttcaaccatagcggcttcatccgcaaccggccagctcgcttcatcgatagtgccttcgccacccagcgtctgccacagaacatagcaggcgtgcggggtaaacggatagagcagacggacgatggccagcagcgcttcctgcatcagggcgcgatcctgctcgctttcctgcggggcgcgtgccagtttgttcatcagctccatgatcgccgcaatggcggtgttgaaagtctgacgacggccaatatcatccgccactttggcgatggttttgtgcagatcgcgacgcagcgatttctgctcgtcattcaggctctccacatccagtgccacggtcgcacctttctgtgtatgctcgaagaccagcttccagacacgtttcaggaagcggtttcgccccttcaacgcccgactcctgccactccagcgtcatatccgccggtgaagcaaacatcataaacagacgcacggtatccgcgccgtaacgctcaaccatcagctgtgggtcgatgccgttgtttttcgacttcgacattttgctcatgcccgcgtagatcacttcgcggccctgcgtgtctgtggctttaacaatgcggcctttctcatcccgctcaacctcaacgtcaaccggtgaaacccagttacgctcgccgttggcaccaaggtagtagaaggcgtcagccagcaccatgccctggcacagcagacgtttggctggctcattggagttcaccaggcccgcgtcacgcagcagcttgtggaagaagcggaaatacatcaggtgcatgatggcgtgttcaataccgcccacatactgatcgaccggcagccagtagtttgccgctgccggatccagcatgccttccttgtagctggcgcaggtataacgcgcgtagtaccaggaagactccataaaggtgtcaaaggtgtcggtttcacgcagggcaggctggccgtttaccgtggttttagcccactccggatccgctttgattgggctggtaatgccatccatcaccacatcttccggcaggatcaccggcagctggtcttctggtgcaggcataacggtgccatcttccagcgtcaccatcgggataggggcaccccagtagcgctgacgggagacaccccagtcgcgcaggcggtagttcactttacgcacgcccacgccttttgccgccagcgaatccgcgatggcgttaaaaccggtggcgtgatccatgccgttaaactcacctgagttgaacagcgcacctttgtcagtcatcgccgcaatgctgacatcaggaatggaaccatccagattcaggatgaccggcttaatcggcagatcatatttagtggcaaactcccagtcgcgctgatcgtgcgccggaaccgccatcacagcgccggtgccatattccatcagtacgaagttggcaacccagaccgggataagctcgccggtcagcggatgaacaacagacaggccggtcgccatgcctttcttctccatggtcgccatatcggcttcggccactttggtattgcggcattcagcgataaagtcagccagcgccggattattgaccgacgcctgggtcgccagcggatggcctgcggcaacagcaacataggttgcgccgataaaggtatccgggcgggtggtgtagacggtgaccttctcttcgctgtcagccacatcgaaggtgatttcgacaccttcagagcggccaatccagttacgctgcatggttttgacctgctcaggccactcttccagcgtatccagatcgtttagcagctcctccgcataatcggtgattttgataaaccactgcgggatctctttacgctcaactttggtgtcgcagcgccagcagcagccgtcgatcacctgctcgttcgccagcaccgtctgatcgttcgggcaccagttcacggcagaggtctttttatagaccaggcctttttcatacagtttggtaaagaaccactgttcccagcgatagtactctggctggcaggttgccagttcacgactccagtcatagccaaagcccagcagtttgagctggtttttcatgtaggcgatattgtcgtaagtccacggcgccggagcggtgttgtttttcaccgcagcgccttccgcaggcaggccgaaagcatcccagccaatcggctgtagtacgtttttgccgagcatacgctgataacgcgcgattacgtcgccgatggtgtagttacgaacgtggcccatgtgcaggcggccagaaggatagggcaacatggagaggcaatagtatttctctttaccttcctgctcagtcactttaaacgtttcgttttcatcccagtgctgctgcacacgggattcaatttcttccgggcggtattgctcttgcatggctgcctgtggtcctttatgaaaaacatttttctggctctaagatccgcatagcatacccataaggccgcgtatcaacaacacttcccacttttgccggcacgatttctgccgaaagcgtcagagccttcacccttttgtaattcactgtacagacgacacggcaaaagcaacattacgactaaacttagttcagcgagggtctgcataaaggagaacaaaatgaataaagtggctcaggaatatcgcgagtcgttagccgtattgaccgaacgtcttcgtcagggcgatcgtaaccttgatgagctgattgccgggcgacgaagccagttgctggtgcgcgatgatatgacggaacaggagattgaccaggcgctcagctcagtgcgccgtgatctgggcgagtttgcacgcagctacaccgatgtggaagaaccgctggcggactcactgtttatgcgcattatccgcgagagcgtctggaaagagctggcggatatcaccgataaaagtcagctggagtggcgagaggtcttccaggatctgcatcatcacggggtttatcagagcggggaagtggtggggctgggcaatctggtctgtgagaaatgccagttcacccgggcaatctacacgcctgaaacgctgtcacgttgtccggaatgcggcaacgatcagttccagcgtcagccgtttgaaccctgatagtgcggcgtagctaaatgaagcgggccaccctgggtgacccgcctgtttcgtcaggtttagtgcagaatttttgcgaggaaatctttagcgcgctcagactgtgggttattaaagaagtcatctttgttggtgtcttcgataattttcccttcatccataaagatcacgcgattggcaaccttacgggcgaagcccatctcatgggtcaccaccatcatcgtcatcccttcctgtgccagttcaaccatcacatccagcacttcgttgatcatttccggatccagcgcggaggtgggttcatcaaacagcatcgctatggggtccatacagagcgctctcgcaatcgccacacgctgctgctgaccacctgaaagctggccgggaaacttctcagcatgggcggatagacccacacgcttcagcagcttcagccctttatcgcgggctgccgctttgtcgcgcttcagcactttcacctgcgccagaaccaggttgttgataatgctcagatgcggaaacagctcgaagtgctggaacaccatcccgacctggctgcgaagctgcgcaagattagtctttttgttattcacctcggtgccgttcaccgcaatcacgccctgctgaatcggctcaaggccgttcaccgttttgatcagcgttgatttaccggagccggacgggccgcataccaccaccacttcaccggttttgacgtcggttgagcagtcggtcagcacctgaaagtgaccataccacttagaaacatttttcaggctaatcatttaaaccgtcctttttctttttagatagctgaccaacagcgatgcgctcaggctgataacgaagtagaccagacctgcaaacagaaccatttcaacctgggtgccatcacgctcaccaatggtggatgcggtacggaagaagtccgccaggcttaagacataaaccagcgaggtatcctggaacagcacgataccctgcgtcagtaacagcggaaccatggcgcgaaacgcctgtggcaggatgattagtcgcattgcctgccactgcgtcatgcccagcgccagagccgcactgccctgtccacgcgagatactgatgatgccggcgcgaataatttcagagtagtacgccgcttcgaacagcgaaaaggcgaccatggctgaaatcagtcggatatccgttttgggcgacagccccagcacctgctgcagaaaactcggcacgaccagatagaaccacagcagcaccataaccagcggcaccgagcggaacaggttgacgtaaattttagcgaaccagctgataggcttaaacgtcgacaggcgcatcaccgccagcagagtgccccacaggatgccgaagaccacagcggtaatcgtgatcttaaaggtgatcactaagccattaagcagatagggcaggctgggtgtaatcgaactccagtcaaactcgtacattacttgcctcccgcattgcctggcagccggactttgcgctcgaccagactcatcaacaacataatcaccaggttaatcgcaacgtaggccagcgtaatggcggtaaaggattcataggcgtgggcagaatagtcgagcagtttgcccgcctgcgccgccatatcgaccagaccaatggtggaggcgatagcggagttcttcaccaggttcagcatttccgaggtcatcggcggcacaatcacgcgatacgcattcggcagcagtacatagcgataggtctgcggcagggttaagcccatcgccagaccggcattcttctgtccactcggcagtgactgaatcgctgcgcgcacctgctcgcagacgcgggcggcggtaaacaggccaagacagatcatcgaggagaggaagaactgaatgttgggatccagctcagacttaaaccacatgccaagcttttcgcccaccagctcgggcgccaccagataccagaagaagaactggacgatcagtgggatgttacgaaacagttcgacatagcaggtgccaatggtcgacagcaggcgattaggcacggtgcgcagaatgccgaaaaatgaacccacacagaaggcgataatccaggcgcagcaggagacggcaattgtcacctgaaaaccggaccacagccagccgaggtaggtcgtgttaccgaacggggcctgttcgaggaatatgccccagttccaatcgatacccataacgagctccggaaaaaaagggtagctaagctaccctgaagattgatgaacggcgttttatttcctgactcaggggaacgacccgtgtcagtctgtctgtccatgccgcggtttcagcaatcgagagggcagccaggccgcccttgttatacccgtcgtctttcaggatgcatttttgttggctacattcactcacccgaatcacttaccggagtaggctcatcgggagtcatttttctgctgcctcaatgcaatctgaaatccattgggtatttttttgttaattcagtgctttatcatttggtgttttgaacagcgctttcatgtcatcagagagctcaaagttcatgttcaggttctttggtggaatcggctgtttgaaccaggtgtcgaaccatttttctgcctggccagaggtctgggctttggcaatggtttcatccaccagggctttgaactgcggatcatctttacgcagcatgcagccataagcctcttttgactgtggcgtgcccaggatttcccagttgtccggctttttggctttggcgcgttcgcctgccagcagggcatcatccatcataaaggccacggcacgaccggtttccagcgtacggaaggagtcaccgtgatcttttgcgctgatgatgcgcagatccagtttctgttcgtcgttgagtttgtgcagcagcacttcagaggtggtacctgaggtcaccactacggttttgcctttcaggtcagcgaaatctttgatcgggccatctttcttaaccagcagacgggtgccgataacaaaaatagtgtctgagaaggcggcctgtttctggcgctcaaggttgttggtggtcgatccacactcataatcgtaggtgccgttttgcagcagcggaatacggttttgtgaggtgatcgggatcattttgacctgcagatcaggcttgttcagctttgctttaatcgcttcaacgatggcgtttgagtaagcctgtgagtagccgacgactttttgctggttgtcataataagaaaagggaactgatgattcgcgatgcccgaccacaatgacgccattgtcattgatcttcttcagggtgccgctgagatcttccgcctgggccgctcccgccgctgcgctgatcagcagaagagataatgccactttgcgtagttgcatgttccaactccttcgtatgaaaaaggcacaggatataacctgcgctgattatgatgttgtgtctgttttctgctgcgtttctgctcattctgcggtttaaacgggcgcagaagagtcattaacatagcggattgttaacgcaatgaaacaaaaaagtttcttttttgcgaggtgatacgcaccaaaaaaaggcaattttttcaccctgcgcgttaatggtgcagcagcgtcaattgttttggtgcaacccgcccggcatcagcgcctgcaatcagcctgtttgcgaaaagcagtgaaacattttgcaatcatcgtgccagaaagaggttatgcgttagaaagacagcagagtgtgcggcgtggggagtgaaaaaaaccggagagtcaccatgaaaaaggcgaagcaggtgcttcgccttcagtgagcacaggaggggaggttatcgacgccgacgcaggagtgctatcaccgccgccagcagcgtcagtgaccacactggccagatgccagctcgcgcatacggggtttctccctgcgttggcgtaaccttgctggtcagcacatcgcgggtaaactgcggcagcatggcttccacatcaccactggcattgaccaccgccgtcacaccattattggtgctgcgcaacagcggacgtcccagttccagcgcacgcatcctcgccatctggaagtgctgccatgggccgatagagtgaccaaaccaggcatcgttcgaaacggtcaacaggaagttggtgtcgggatggaagttggcccgcacctgttcacccagcacgatctcataacagatggcgctggtcaggttatagcccgccacgctaagttgtggctggaggtagttgccacgactgaaggccgacatcggcagatcgaagaacggggccagcggacgcagcagatcggccagcggcacaaattcgccaaatggcaccaggtgattcttctggtaacgattgccgctgaagtagttgtacggcgctttgccgcccagcacgatcacggtgttgtaatcgtgatatcggttctgctccagccgggagtccacaatgccggtgattagcgagctgccgcgctcacgcagttcgtcatccagcgaacgcaggaacggctgctgattactctccagatcggtaattgccgattcaggccagataataatcggcgctttgcccatcagcggctgactcagaccgttgtaaatgcgcagggtagtgagtaactgctgcggatcccacttcatcgattgcgggatgtatccctgcaccagcgccacctcgacggcccgctcgggcatcggctgaacccactggatgtagcgcaacggccatggcaatgccagcagcagcagcgctgctcccagacttctgacgttgcgctgttgcagggcataagccagcaggccagccaccaccatcagcaggaaggtcagcgtctctacgcccgccagcggggccaggccttttaacgggccatcgatctggctgtaaccaaactgcagccacggaaagccggtcagcacccagccgcgcaggaactcggtgatttgccacaatgccggtgccgccagcgccaggcgccacagcgtcgttcgcggccagatgcgattcagtacgccggcaaacagcgccgggtagatcgccagataagccgccagcagcgccacgataaagacattgaccgggccaggcatgccgccaaaggtggcgacactgacataaacccagttgatgccactgccgaacagacctaaaccccagacaaacccaatggcgctggcctgcgggctggagcggttaagagtcagcagctgtaagccgcacagcgagagcagtgcggcgggccagaaatcgtagggagaaaaggcgagggtgccaagtgcacccgttattaaagccagcagcaggcgaaacccgctgacgcgggtagagtgaggctaaagccatagacttattcgtcttccagttgaggttgtggcgaattttccggaatagtcacgtgaacctggatgatgcggcggctgtcagccatcgccaccttgaactggtaaccctcaatctcgatgctttcaccgcgagcgggcagatgaccgaagccctgcatcaccagaccaccgatggtgtcgacttcatcgtcgctgaactgggtgccaaacacctcgttgaaatcttcaatggcagtcagtgcacgcacggtaaaggtgtgacggttgagctgacggatatcacgatcttcttcgtcgtcatactcatcttcaatttcaccgacgatcagctccaggatgtcttcaatggtcaccagaccggagacaccgccaaactcatcaatgacgatcgccatatggtaacgctgggagcggaactctttcagcatccggtcgacacgcttactttcaggcacaaccaccgcaggacgcagcactttctcaatgctgaaaggctcagattcgctgctcataaacggcagcagatctttcgccatcagaatcccttccacatgatctttatcttcgctgatcaccgggaaacgagaatgggcggattcgatgatgacatccagacactcttcgaggctctgattacgtttcagggtgatcatttgcgagcgcgggatcatgatgtcacgcacgcgctgctccgcaatatccagtaccccttcgagcatgtcgcgggtgtcctggtcaatcagctctttgttattcgagtcgcggatcagctccagtagctcatcacggctttttggttcaccgtgaaagagttggttgatcaacagggagaaaaatccctttttactactgggtgcatcgctgttttgagaatggtcgtcgctcatggcggtttttatagatctctctggtgaggaataggtgctgtcagtagcctgtactgacagcaggattgactgaattcaggattcaggcgtcttctttctccgaaatgtacggatcaggatacccaagagcaagcattatctcggtctccagcccttccatctcgtccgcttcgtcgtcttcaatatggtcgtaacccagcagatgcagcgtgccgtgtaccaccatatgtgcccagtgggcttcagcgcttttaccctgttcagcggcttcctgctcaacgacctggcggcagatgatcagatcgcccagcagcggcagctcaatgcctggcggtgcttcaaacgggaaagagaggacgttggtcggcttgtctttgccgcgataagtcagattaagctcatgactctccgcttcatcaaccagacgcaccgtaacttcgctttcgggctgaaaaggggtgacagccgctgacagccagcgatgaaactggctttcagcaggcaggtcagcggtgctgtcacaggcgacctgcaggtcgagaatcacctcgctcatttgctctcctgcgtggcgctctgtgcagccagtgcttcacgtttacgctcttcggcctgctggtcacgacgggtctgatcggccgcttcccaggcttcataggcggtgacaatgcgggcaaccaccggatggcgcaccacatcttcgctgtggaagaagttgaagctgatctcttcaacgtccgccagcacctcaatggcatgacgcaggcctgacttaacgtgacgcggcaggtcaatctgggtaacgtcgccggtaatcaccgctttagagttaaaaccgatacgcgtcaggaacattttcatctgttcgatggtggtgttctggctctcatcaagaatgataaacgcatcgttcagggtacgaccacgcatgtaggccagcggggcgacttcaatgacgttgcgctccatcagcttttccacccgctcgaagccgagcatttcgaacagcgcatcgtagagcggacgcagataagggtcgactttctggctcagatcgcctggcagaaagccgagcttttcacccgcttcgacggcagggcgggtcagcatgatgcggcgaatttcctgacgctccagcgcatccactgccgcggctaccgccagataggttttaccggtacccgccgggccgacaccaaaggtgatatcgtggtcgagcacattagcgatgtactgggcctggtttggggtgcgcggcttgatcacaccgcgtttggtcttgatattgaccgctttaccgtactccggcacgctctcagcggtttgctccagtacccggctctctttgatcgccaggtgaatctgatcaggctcgatatccgggatgtcgccacgcacaggcgcggtatcgacatagagggttttcagaatatctgctgccgcattgacgcaaagtggacgtcctgacagcttaaaaacgttgtcgcgacgattgatctcaatgcccagacgacgctcaagctgttttacattatcgtcgaaaggcccacacaggctcatcagacgacggttatcagccggttcaagggcgatttcacgagtttcgatattcaaacgaatcctttgggtcactcagggccagttatgggatgtgtctgacgcaccgttaagcttaaccggatgcaccataacgaaattatttatgccgtaacgcctgggcgcaagcttatggagagatatttgggcgacactttcagaaagcaagtggtgcaaagtgaaattggcggcaacgcgatgcgcgctgccgcacagtaaagcgggcatcacggctggaacagactcacgccgatttcattttctttacgggtacgggcgatcacggacgccgggctttccgccatgcgcagccccatctcttcttcagtacgcaccagtttgccgcgcagcgagttggtgtagacatcgacaatttcaacatccacaaagcggccgatcatttcaggcgagccttcgaaattcaccacgcggttattttcggtgcggccagagacttccatcacgtttcttgcgggagatgccttccaccagaatacgctgcactgtgcctaccatgcggcgactgatcgcctgcgcctgctggttaatgcggtcctgcaggatccacagacgctgctttttctcctcttcgctgacatcatccggcaggtcagcggcaggcgtgccgggacgggcagagtagataaagctgaagctgacgtcgaaattgatctcggcaataagcttcatggtctgctcgaaatcctgctgagtttcaccggggaaaccaatgatgaagtcagagctgatctcaatatccgggcgcgccgcgcgcagcttgcggataatcgccttatactccagcgcggtatgagcacgcttcatcagcgtcagaatacgatctgatccactctgaaccggcaggtgcaggaagctcaccagttccggcgtatcgcggtagacctcaatgatgtcatcggtgaactcaatcgggtggctggtggtgaagcgaatgcggtcgataccgtcgatggcggcgaccaggcgcagcagctcagcgaaggtacagatttcaccatcaaaggtggcaccacgataggcgttaacgttctggccaagcaggttaacttcacgcacgccctgcgctgccagctgagcgatctccagcagaatgtcatcgctcggacggctcacttcctcgccacgggtgtaaggcaccacgcagaaagtacaatatttgttgcagccttccatgatggagacaaaggccgtcgggccgtctgcgcgcggttccggcaggcgatcaaatttctcgatttccgggaagctgatgtcgaccaccgggcttttggtgccgcgcacggtgttgatcatctccggcaggcggtgcagtgtctgcggaccaaaaacgatatccacgcagggcgcacgctggcggatatgatccccttcctgcgacgccacgcagccgcccacgccgataatcacatccgggttgcgctctttgagttttctccagcgtcccagcaggtggaatactttctcctgcgctttctcacgaatagaacaggtgttaagcagcagaatatccgcctcttcaggaacctcggtcagcgtatagccgtgcgtactgttcagcagatcagacatcttggatgaatcatactcattcatctgacatccccaggttttgatatgcagtttttttgtcatcgcgctaaccattgattcagtgcagtgaagtgcggggcgcgtattgtaatgctttgatgctgttgtgaccagcctcagggcttttctgccagcaatccggttttccggtacactttgctttattcagacccgtgttgcgcaggctggcgggaataagagagggacataagcaatgcaggataatcagtttgatgtagtgattgttggcggtggcatggtcggtgcggcgctggcctgtggactgacgcagcaacattttcgcgttgcggtcattgagcgtgccgaacccgcgccttttgatgccgacagcgatcccgatctgcgaatttcggcgattggctcatcctcggtggggttgctgaagcagctcaacgtctggcctcgggtagaggcgatgcgcagcgcgccctatcgcaggctggaaacctgggagtggcagacggcgcaggtgagttttgatgcggcctcgctggggctgcccgagctgggctttatggtcgagaacagcgtgcttcagcgggcgttatgggaggagatgcagtcgctgggcgtgacctgctattgcccggccacactggagaacctgcagccagaaaatggcggctggcgcatcgacctcaacgacggcgttgccttacacgcccgcctggtggttggggctgatggcgcgaaactctcaggtgcgacagatggccgggatcggtattcatggctggagctatgcgcaatcctgtttactgatcagcgtgacctgcgaacatccggcaggcgatgcgacctggcagcactttacgcctcagggaccgcgcgccttcttgccgctgtatggcaaccgggcctcgctggtctggtatgacgcgcctgcaagagtccggcagctacaggcgatgccgatggcccagctggaaaaagagatagccagccatttcccggcgcggctgggacgttttaaagcccacgcggcgggcggcttcccgctggtgcggcgtcacgcttcacggtatgtcctgccaggactggcgctggtcggtgatgccgcgcataccattaatccgctggccgggcagggcgtgaatctgggctatcgcgatattgatgcgttgattaatgtgctggtcagcgcacgcggtgcggcggaggattgggcatccgagcgcgtattgcagcgctatcaccggcaacgtcgtaaagacaatatgctgatgcagggcggcatggatctgttctattttgccttcagcaatcagctggcaccgctgcggtttgcacgtaatctcggattgattgccgccgaacattccggagtactgaagcggcaggtattgcgctacgcactggggttatagcagattgcgcatgtcggctcgccgcacggcgggcctgcaatcaggaaggggaacgacaaaaacaacaaagcccgcaaaagcgggccaggttgtgcaatttggctggggtgcagggattcgaaccccggaatgctggtatcagaaaccagtgccttaccgcttggcgacaccccaataatggtgtttttcaaattgtcttttgtatggctggggtgcagggattcgaaccccggaatgctggtatcagaaaccagtgccttaccgcttggcgacaccccaattatatggtggctacgacgggaatcgaacctgtgaccccagcattatgagtgctgtgctctaaccagctgagctacgtagccaaattgtactgcatttcaatgatggctgggatacctggattcgaaccagggaatgccggtatcaaaaaccggtgccttaccgcttggcgatatcccattcgtccgttctcagcctcgagaatcatcgaaattggctgggatacctggattcgaaccagggaatgccggtatcaaaaaccggtgccttaccgcttggcgatatcccatccacgctgccgaataatgaaatggtgcgggaggcgagacttgaactcgcacaccttgcggcgccagaacctaaatctggtgcgtctaccaatttcgccactcccgcaaaaaaagatggtggctacgacgggaatcgaacctgtgaccccagcattatgagtgctgtgctctaaccagctgagctacgtagccatctttttttcgcgttaccttcatcggcgttgcggggcgcattatgcggagttgaccagacagcgtcaacaatttttttaccgttttttgccagataatcgctgtttgactggcttataaccagcctggatgtttattcggcaatttttcagtgaatacaacgctaatcgtaaaaaaaatgggccacaacgggcccattcttgttgctttctgccggcttatttataggctgactgatgcacacccacggcacgaccagagggatcgtccatgtttttaaacgcttcatcccattcaatcgctttggcagaagaacaggcgaccgatggaccgccgggcacacactctgccgcgctcgccagcgggaacagctcttcaaagatctcacgatagagataggcttctttcgaaacccggcgtgttgaacgggaagcggaagtgagcggtagccagctgctgatcgctgatttgcttcgcagccacttctttcagtgagtcgatccagctgtaacccacgccatccgagaactgctctttctgacgccacgccacgctctccggcaggtaagaggagaaacattcacgcagaatgtgcttctccattttaccgttgctgccacacattttatcggccgggttaatacgcatcgccacatccaggaattttttatccaggaacggtacgcgggcttcaacgccccaggcggacatcgctttgttggcacgggcgcagtcgaacatatgcagcgcctgtagtttacgtacgttttcttcgtggaactctttggcgtttggcgccttgtggaaatagagatagccgccgaagacttcatctgcgccttcgcccgacagcaccatcttaatgcccatcgctttaattttacgcgacattaagtacattggcgtagaggcacgaatggtggtgacgtcataggtttcaatgtgataaatcacatcgcgaatggcatccagaccttcctgcacggtgaaatgaatttcatggtgtacggtgcccagatgctccgccaccgatttcgccgcttttaagtcgggtgaaccttccagtcctaccgcgaaggagtgcagctgtggccaccacgcatcacttttatcctgatcttcaacccgcttcgccgcgtaacgcttggtcacggctgaaatgatggaagagtccagaccgcctgacagcagcacgccgtaaggcacatctgacatcaggtggcttttcacggactcttccagcgcatgtttcaggccagcggcgtcggtggtgttgtgctcaacgtttttatattccatccagtcgcgctgccagtaacggcggatctcgccatcggtgctggagaggtagcttcccggcgggaactctttgattgaacggcaggcaggtaccagcgctttcatttctgaagcaacaaacaggttgccatgctcatcgttacccatatagagcgggatgatgccgatgtggtcgcgaccaatcaggtacgtttttttaacggtgtcatagaggataaaggcgaacatgccttccagctcatcaaggaaatcgacacctttctcctgatagagcgccagaatcacttcacagtcagaaccggtctgaaacgcgtagcgatcgctgagttcagcgcgcagtgcctgatggttataaatttcgccgttaactgccagtacgtgggtgtgatcggcgttgtacagcggctgtgcgccattgttaacgtcaacaattgagagacgttcatgcgccagaatagcatggtcatcggcgtagacgcctgaccagtccgggccgcgatgacgcattaagcgtgaacattccagcgcttttttgcgcagctcaacaggatcggttttcagatccagcacaccaaaaattgaacacataactgactcctgagctcaccttacggcgatgttttcttttgcgtttgtccggcagcctgatgctgcgtgatacataagaaaatgcgctatttggtgcattcaatgcaagaggaatcgtgatttactgataaaaagattgcttgcatggcaataaaattaaataaacgataattttaaagccgtttcgttgctggatcagcaataaaatagcttttgtgagcagaaatcagacagtaaaagtgggagatatagcgcaaaaaggggggacgcatcacagattagccggatgcgtcataagagaaatgaatcagaacaggtcaatatcggccacagaagggtagatccagtccggacggaacggcatggcatcgatatcactcagcgtcgagacgccggagagcaccagcaccgtctccagacccgcctgaaaaccggccagaatatcggttcgcagattgtcaccgacaatcacggtctcttccgagtgggcctgcattttgttcagcgcggcgcgcatgatgtaggggctgggcttgccgacaacaaacgggcgacggcctgatatcttctcaatacccgcacagagtgcgccacaggcaggaataaaaccgcgcgcatgggtatccggattggtggcaataaagcgagcgccattagccacgaagaaggccgctttatgcatcatgtcccagttaaacgagcgcgtctctccgacaatgacaaaatcgggattcacatcggtaatggtaaagcccgctttgtagagttcatgaatcagtgcgccctcaccaatcacatacgcctttttgccctcctgacggcgcaggaagtcggcggttgccattgcggaggtatagaaaacggagtcgggcacctcgacaccggccgaggcaaagcggttagccagatcctgctcggtttgcgagggatagttcgtcagcaccaccagcggcatctctttggccagaatgcgctgtaaaaactcctgtgcgccgggaaacggccgtgttgtcgtgcatcagcacgccatcgatatcacaaattacgcttttaatggtcatagtcagatccgatatggcccgccacagcagcgggttagcttagtcttccagaagatgttgcagcagaatgccgttaagcatggcacgtttagcgagcgcaaaggcgccaatagcggaacgatgatccagggtggaacgcacgaccggcagatttttacggaaggcctctaatgcctgagtattaatgcagccctcaatcgcgggcagcagcactttttctgcttcagtgatctcacccgccagcaccactttttgcggattaaacaggttgatcgcaatcgcgatagctttgccaagataacggccaacgtgctcaaccacttcgcaggccagtgcatcaccctgattggccgctttgcagatgtgggatatctggcacgcctccagcgtcagtacgctgggatagccctgattcagcagatggcgtacccgattttcaatggcgccgttggcggcaatggtttcaaggcagccaaagttgccgcagtggcagcgctcgccaagcgggtcgacctgaatatgaccgatttcgccaacgttgccgttgctgccgagaaaaatatggccgttggcaataatgccggcgcccgtgccccggtgtaaacgcaccagaatcgagtcagcacagtcgcggcttgcaccgaaatagtgctcggccagcgccaggctgcgaatatcatgacccacaaaactggtaacgttaaaacgttttttcagactggcgaccagcggccagcggctgacagagatgtggggcatataacggatcacgccgttaatcggatcgaccagccccggcaggatcactgaaatcgcgatcagctcgcgaattttacgctggtgctgctcaatgaagctgctgatggcgttaaacagcgcatgttccagcgtctcctgagtgcgttccggcagcgcataatcttcctgcgccagcgatttaccgctgaggtcaaacagagtcagggtggcgtcgttgcgtccgaggcggacgccgatggtatggaaatggcgggtttcagtgataatggagatggcgcggcgaccaccggtagacgcctgctggtctacctctttgatcaggccgcgctcaatcaactgacgggtaattttggtgacgctggcgggcgcgagctggctaagttcggcaatctgaatgcgcgatatcggcccctgttgatcaatcagccggtaaaccgctgcgctattgagttgcttaacaagatcgacatttcctatttgtgactggccgccagtggtcattcagtgcttactcgctcaggacgtcgtctccgttgacaaacgtctttatgattttaaagtcgcgcgtaaacacagtcaggttcgcgatttttcctgcttcgatcgagcctgactgcctttccacgcccatcgcccgtgccgggtagagtgttgccatgcgcaacgcttcgtccagtgcgatccctgcatgctcaacgctgttttgtaccgcttcaatcatcgtcagggcagaaccacttaatgtgccgttttcgtcgacacagagcccatcgcgataatagattgttttgcctgcaaaaataaactcgcttatgtccgcgccagccggtgcagtggcatccgtgaccagcaccagtttgtcgcctttgatgcattttgcattgcgcacgttagcgtaatgtacatgtaaaccgtccgcaataatgccgcagtatacatcaggcgaatcaaacagcgcaccgataagcccgggttcacgtccggcaaaggtgggcatggcgttgtagaggtgcgtcgcgaaactcacaccagcagaaaagcccgctttagcctcttcataggtcgcattcgagtgaccggctgagacaataatcccggcatcagtcaattgacgaatcacatcgctacccgcattttcaggggcaagcgtgactttggtgatgacgtccgcgttgtcgcacaggtactgcaccattgccgcatccggcaggcgaatcagcgccggatcgtgggtgccttttttcgctttgctcagccagggcccttccagatgcagacccagcgcctgattctgatgtttctgcaggtaggcgcgcatggtttcaatcgcccgcttcatcagggcgtcgctgctggttatcagcgtcggtaaaaagctggtgcagccagacttttcattggcgcgctgcatcgtttccagcgtttcaatgctgagcgcctcaaggctgtcattgaactgcacgccaccgcagccattgagctggagatcgataaagcctggcgcaatatttgcccctgccatatcccgctgctcaatatccgccgggagggcttcacgcggacagacgcgtgcaatacgcccatcggcaaccaccaccgcgtgattatccagaacctcatggccactgtagattcgaccgttaactaatgcgtacatctctcttctcccgtcctggcctgctgtcactcagcgtaacagcagggcatgacaatgttctgttacacgcctttcatattttccgcttccatttcgcggaaatatttcacggttttcactttcagttccatggtggccggctcatcgcacactaccaccgatttcgcgtgcagctgcaggcagctgatggtccacatatgattaacgttgccttcaaccgccgcctgtaatgcctgcgctttaacatggccggtaaccagaatcatcacttcctctgcatccagcagcgtaccgacgccgaccgtcagcgcatatttaggcacctgatcaacgtcaccgttaaagaagcgggagtttcgccacgcgggtgtcatgggtcagggttttaatgcgggtacgggaagcgagagaggaagccggttcgttaaaggcgatatgaccgtcgttgccaacgccgcccatgaacaggtgaattttacccagcgcgcgaattttctcttcgtactgacgacattctgcgtcaatatcgggggcattaccattcagcaggttgatattttccggttgaatatcaacgtgatcgaagaaattgcgatacatgaagctgtgatagctctcaggatgctcctttggcaggccaacatattcatccatattgaacgtcacgacgtttttaaaactgacctggcccgctttgtgcatatcaatcaggtgtttgtacgcttccagtggcgtaccgccggttggcagacccaggacaaaaggtttatccgccgtcgggttaaacgcattgatacgattaacaatatgtcgggcggcccattttcccacctgggttggtgtcgctaaaggaatcagtctcatgtttcacctcaattgaaaatagaaaggggatggctaagccgttgcgtgagtcaccaatctgaacagatgattcattgtcgccatggccagcgcataattcaatatttcggatcataaaataagtttacggtcatagccagatgttgccgtatgaaacgatgttttttagtgataaaaatcacatttaccaggcttttaatttgcgaggcgaattaatttatcattacacttcgctgcgtgatatgaagtgtattaacgatctttgcagctgacataacaacattaagcagcgcaaagcgacaagtcaggctcatagggggaaggggatatgttaggttacttacaaaaggtggggcgcgcactgatggtgccggtagcaaccctgccagcagcagcgatattaatgggcgtgggctattggatcgatccagacagctggggcgcaggtaatgcgctggcggcattgctgatcaagtcgggtgcggcaatcattgagcacatgtcggtgctgtttgcgatcggtatagcctacggcatgtcaaaagataaagatggtgccgctgccctgactggctatgtcggctttctggtggtcaccacgctctgctcaccagctgcagtgtcgatgattcagaaaattcctttggatcaggttccagcagcctttggcaaaattgaaaaccagtttgtcggcatccttgtcggtattctgtcggcagaggtctataaccgcttcagccacgttgaactgcctaaggcactctctttcttcagcggacgccggctggtgccgattctcgtttcgtttcctgatgatctttgtcgcttttatcctgatgtatatctggcccgtggtgtttaatggtctggttaactttggtgaacatatccagaagctcggctctgccggtgccggtatctacgccttctttaaccgcctgctgattccggtcggtctgcatcacgccctgaactcggtgttctggttcgatgttgcgggcattaatgacattcctaaattccttggcggtgcacagtcactagctgacggatcggcaactgtcggcatcaccggtcgttatcaggcgggcttcttcccgatcatgatgtttggtctgccgggtgctgcgctggctatctaccactgtgcgcgtcctgagaaccgcgtcaaagtgggtagtatcatgctggccgcggcgtttgctgccttctttacgggtattaccgaaccgctggagttctccttcatgttcgtggcacccgtgctttatctgatccacgccgtcctgactggtatttctgtcttcatcgctgccagcatgcactggattgccggatttggtttcagcgccgggctggtggatatggtgctgtcgacccgtaatccgctggcgacacactggtacatgctgatcccgcagggtctggtcttcttcgttatctattatgtggtgttccgctttaccatcaaaaaattcaacctgatgacgccgggccgcgagctggcggttgatggtgatgaaactgatggttatgacgttaacgttgataaaacggatagcggtgaaagtgccacagagtcactggcgcgccgctacattggggcgattggtggttcagctaacttaaccagcatcgatgcctgtatcacccgtctgcgtcttaacgtgaatgactcggcgcaggtgaatgaggcggttgctaagcgtcttggcgcgtccggcgtgatccgtcttaacaaacagagcgtgcagatcatcgtgggtacccaggcagaaagcatcgcctcggccatgaaaaaagtgctgaccaaaggtccggtcgctgcagcggctaccagcagtgcgccggccgagccggatgttaaaccgcaggcggtgctgaacagtgagaagcaggtcatcgccacgctgctggcgccggtcagcggtgaagtcgtggcgctggatgatgtgccggatgaagcctttgccagcaaagcggtgggcgacggtctggcgatcaagcccagcgacaaatgggtagtggcaccgattgccggtacgctggtgaaaatctttaacaccaatcatgccttctgtctggaaaccgacaatggcgtggagattgtggtgcacatggggctggataccgtggcgctggaaggtaaaggctttacccgtctggttgaagagggggccagcgtggtcgccggtcagcgagtactggagatggaccttgaattccttaacgccaatgcccgctcaatggtgagtccggtcgtggtcagcaacagcgacgatttcgccggtctgactttactggcacagggtcaggtaatagcaggggaaaccccgctgtatgaagtgaaaggctaatccccgcaacagaaccccacaggcaggaagcgattcctgccttttttgttttaaaggcttaacaaacggttgtttccctcagacgctttgtggatcatactccgttacttcgtggtacaaatcacccgttattcgtattgaggatttttgagatgagtgaggctgaagcccgcccaactaactttattcgtcagatcattgacgaagatttggcgagcggtaagcacagcagcgtgcatacccgttttccgccggagcccaatggctatctgcatattggtcatgcgaaatcgatctgtctgaattttggcatcgcccaggactatcaggggcaatgcaacctgcgtttcgacgataccaatccggttaaagaggatatggaattcgttgaatccatcaagcgtgacgttcagtggctgggttttgagtggagcggtgaggtctgttactcatcaaactatttcgatcagctctacaactatgccatcgagctgatttccaaaggactggcctacgttgatgaactgagtccggatgcgattcgtgaatatcgcggcaccctgaaagagccgggtaaaaacagcccttatcgcgatcgcagcgtggaagagaatctggcgctgtttgagaagatgcgaaacggtgagtttgccgaaggcaccgcctgtctgcgcgccaaaatcgacatggcctctaatttcatcgtgatgcgcgatccggtgctttaccgcatcaagttcgcggaacaccaccagaccggcaagaagtggtgcatctacccgatgtatgactttacccactgcatctccgatgcgctggaaggcattacgcactcgctctgtacgctggagtttcaggacaaccgccgtctctatgactgggtgctggacaacatcactattccggttcatccgcgtcagtatgaattctcgcgcctgaatctggagtatgcggtgatgtcgaaacgtaaactcactcagctggtgaccgagaagcacgtagaagggtgggacgatccgcgcatgctgaccgtttcaggtctgcgtcgccgtggttacaccgccgcttctatccgtgagttttgtcgtcgtattggcgtgaccaagcaggataacatcgtggagatggcctcgctggagtcctgtatccgtgatgatcttaacgagaatgcgccccgcgccatggcggttttagatccgcttaaagtggtgatcgaaaacctgccagcaggccatagcgaaatcgtcaccatgccaaatcatccgggtaaaccggagatgggcacgcgtgaagtgccgttcagccgcgagatctggatcgatcgcgcggatttccgtgaagaggcgaacaaacaatataagcgtctggtgctgggcaaagaagtccgcctgcgtaacgcctatgtgattcgtgctgagcgggtcgccaaagatgaagcgggcaacattacctgcatctactgcaccagcgatgttgatacgctgagcaaagatccagccgatggccgcaaagtcaaaggcgtgattcactgggtttctgcggatcacgcgcagccagctgagttccgtctgtatgatcgtctgttcagtgtgccaaacccggctgctgcagaggatttcctggcggtcattaatcctgaatcactgaccatcaaaaacggctttgttgaacccagcctgcgcgatgtggaaccgacaacaccgtttcagtttgaacgtgaaggttatttctgcgccgacagcgtttactcgaaaccgacgcaactggtgtttaaccgcaccgtcggtcttcgtgatacctggaccaaaacgggcgaataaattttttggggctgacctcataaaatgacaaaagggcgatttatcgcccttttttattgccccgatttttaccatcgccgacgtttattctgcactaaccacaaccggttcaataccgacttgtgggagtaatctgagtttaaaaaaattaatcaatttcaggatgtgaattgtcagctttcaggtaggctatccgctctcagaggttgcaaagcgggttacagaaggaaaaaaaatgacagttctcgcccaggaagccaaacacagtgtcgtcgttttacatcagctcattgaacgtatttttaatcagccagccggatctgacgacagtttccagctgctgatgtcctattttcatcctgaatttcgcatggtgaccccaaagggcaaagagtataatctgaacgaggtcgaggatcttttccagcagttacaagggcagcgggaagggatgcgcattgccacctgtgaacatgtcattctctctcatcatgaaaaagagatcgtcgtacagtatcgcgaaatgcagatgatgaacggcaataaccagagccgcatttcgctggccattctggattgcagcagctccattccacgctggcgctatctgcaggagacgctggtcgcctgaggtgagggcagaaaacagacgaaaaaaaaccggtgaattcaccggtttttttatttcaggccgcgccagcgttactggtcgtgcagcgtttcgtcttcacggcaatcgcccagcgtacagtgtccatagagatagaggctgtggttggtcagcttgatgccatggcgggtcgcgatttcacgctgacgtgtttcaatcgattcgtcgctgaactcgataaccttgccgcaatccaggcagatcaggtgatcgtggtgatgctgctgcgtcagttcgaagacagacttgccgccttcaaagttgtgacgagtcacaataccggcatcatcaaactggttcagaacacggtaaacggtcgccaggccaatctcttcgccaatatcgatcaggcgtttatacaaatcttccgcactgacgtgatggcactcaggtttcctgaagcacttccagaattttcagtctgggcagcgttactttcaggccagccttctttaatgcggtgttgttgtcagtcatgcggattttgtcctgttactaatattcacttttgtggcttatcgccttgaatgtcgatctgtgctcattctcatttgcgtctcattatagaactgaagcgatgaaatgaaaaccagagggcgtgtctgaatcatcatgggctattggggattcgtcaccgggccggggaagattctgacagaggtctgttagcacatcacttagtcttgccgcctgagaaaataagcggaagatcgatgcgggtattctacagattaaacggagaaagttaaaaaaatgtggctattatttctataggcattttcattgcctcaatgtgagctggcgctcacattgagtcgggcaggatcaggcttcgatgatctctttcagctgcagttcatcaaaaatctgcttaacccactggtcaacacgctggctggtcagctcaggctggcgatcttcgtcaatggccaggcccaggaagtgggtatcatcggccaggcctttcgaagcttcgaagtgatagccttcagttggccagtgtccgacaatcacggcaccgtgcggttcgataatgtcgcgaatcgtgcccatggcatcacagaaatactctgcgtaatcttcctggtcgccacagccaaacagcgcaaccagcttgccgttaaaatcgatctcttccagcgtcgggaaaaagtcatcccagtcgcactgcgcttcgccgtagtaccaggtcggaatacccagcagcaggatatcaaacgcttccagatcttcttttgtgctttttgcgatgtcatggacttctgcaacatctgtacccagctgtttctggatcatttttgcaatgttttcggtattgccggtatcgctgccgaagaagatgcctacgagtgccatgagtaaaataacctcttaaatcctgatgatgagatgtgtgccgcagcacatttcagcgaataatagcagacgagagaaaaccggtgaacggttaaagccccgacatttgctcctgcgtgcgatttgcccgcattaatccagtttgagctgtgccagtagcatctgttcaatcagttcgctacggctgagattgcgctgttctgccagcgtattgagtgcatcgacggcgtcactgttcattttcagttcgacacgacgaagcccgcgtcctttgtcacgtttcagttgattgcgcttgttaatgcgcagctgttcatcacgcgaaagcggactggttttgggtcgaccagggcggcgctcatcagcaaagagatcgagcgtcgtgcggtcagtctgttcttttgccatggcttagtaaaactgaatgggggcgggcgccagacactcaccgcgcagattataaattattggccattgccgcagcaaaactgacccgcagcaaaattttagcgcgccatcatacttcacgcttacgccggacgccaatcctaaacttttaccgccatctatttgcttttaaagcgcaaaaaagcgacggacactgcgcaaaacggcatcgggtttctctgcatgaacccagtgtcctgcgccaccgatcacatgcgcctgagcggccgggaaaactgctgcagcaacgcatcgcgatagctgttatccaggtagctggagtcgccgccgcgaataaacagcgccgggtgattccaggcgggaaccggctgccagccagagatcgtggtgtagttatcccacagcaccggaacgttgaagcgccactccccctcctggaaggatttcagcaggaactggatcaccccttcttcctctatcagcgttcgcatgaccttcgccgcctcgctgcgggatgagacgcccgcatcggtgacggcacgaatgccggcaaatatctggtcatgacggcgcgtctggtaatccaccggggcgatatcgatcatcaccaggcgctcaatgcgttccggcaccagcgcgctcatggtcatggcgattttaccgcccatcgagtgtccgatcaccgcgacgcgatcaatgccatgtgcatccagtgtttcgaccatatcctgcgccattacagcgtagttcatctcgtcagatcgtggtgaaagtccgtggttgcggacatctacctgcagcaacggaccggcatctttcagcccgcgcgccagcacgccaaggttatcgagactgccaaacagaccgtgaataagcaggatgggcagagaatcagcaggggattgttcagtttgcagacgggcgttcaaaatcatagcaaagttcttaagtttgagacctgagcttaggttatcatggtttcaccttttcaggcgcgccggttccggcggcattaggacatattctgacttttgcccgtaaaccgtttgattgctaacaacccgcctgactttaactttataatcctgatgttagaacccacacaccctttgaattgcctgactatactcagagcttttcaggaaacaggtggttctgtcatgagaaagaaccgtacggaataagatgaaaacgatcgaagttgacgaagagctctaccgttatattgccagccacacgcaacacattggtgaaagcgcatccgacattctgcgtcgtatgctgaagttcacggccggtcagactgcacccgcttcgcctgcacagccagcctcaaaagatgcagcgaaagagtcccagcctgcgtctgtgggttcgcgcccgcaggatcgtgtccgcgcggtgcgcgagctgctgctttccgatgaatatgcggagcagaagcgggcggtgaatcgctttatgcttatcttgtcaacgctctatcgtcttgataccgcagcctttgctgaagctactgcatctctgcagggccgcacccgcgtctattttgcaggtgatgagcatacgctgttgcagaatggcacccatactaagccgaagcatgtgcccggcacgccgtactgggtgatcaccaacaccaatactggtcgtaaatgcagcatgatcgaacacatcatgctctcgatgcagttccctgcggaactgaccgagaaagtttgcggcaccatttaaaacttaagcgtcagggagcagcgccaatggccaatcacccacgtgccgggcaacccgcccagcagagcgatttgattaacgttgcacaattaacgtcacaatattatgtcctgcagcccgatgtggcgaacccggaacatgcggtgaaatttggcacttccggccatcgcggcagtgcagggcgtcaaagcttcaacgagatgcacattctggcgatcgctcaggcgattgccgaagagcgtaaaaagaatggtatcaccgggccttgctacgtcggtaaagacacccatgcgctgtctgaacccgccatcctgtctgtttctggaagtgctggcggcaaacggcgttgatgtgatcgtgcagcaggataatggctatacgccgacccctgcgatctcgaatgcgattcttgagcacaacaaagcgggtggcgcgctggctgacggcatcgtgattacgccgtcgcataacccaccggaagatggcggcatcaagtacaacccacctaacggcggacctgctgataccaacgtcaccaaagtggttgaagatcgtgccaatcagctgatcaaagatggcctgaaagaggtgaaacgtctgccgctggagcaggcgatggccagcggtcatgtggtcgaaaaagatctgatccagccttatgttgaaggtctggcagagattatcgacttcccggcgattcagaaagcgggcctgaagctgggtgtggatccactgggtggttccggtattgcttactggcagcgtattgctgagcactacaagctggatctgacgctggtgaatgacgcggtcgatcagaccttccgctttatgcatctggataaagatggcgtggtccgcatggactgctcgtctgaaagcgcaatggcaggcctgctggcttaccgtgacaagttcgatctggcgttcggcaacgatccagattatgaccgtcacggcattgtgaccccggcgggtctgatgaatccaaaccactatctggcggtggcgatcaactatctgttccagcaccgtccacagtggggtcaggatgttgccgtgggtaaaaccctggtctccagcgccatgattgaccgagtggtcaacgacattggtcgcaagctggtggaagtgccggtgggtttcaaatggtttgttgatggtctgtatgacggcagcctcggtttcggtggcgaagagagcgcaggcgcttcattcctgcgtttcgacggtacgccgtggtctacggacaaagatggcatcatcatgtgtctgctggccgctgaaattactgcagtgaccggtaaaaacccgcagcagcactatgacgaactggcagcgcgctttggcgcaccaagctacaaccgtctgcaggcatcagccacctcagcgcagaaagccgcgctgtcgaagctgtcaccggagatggtcagcgctgatacgctggcgggtgatcctatcaccgctcgtctgactgccgcgccaggtaatggtgcatctatcggcggtctgaaagtgatgacggagaatggctggtttgctgcccgtccttcaggcaccgaagacgcttacaaaatctactgtgaaagcttcctgggcgctgaacaccgcgcgcagattgagaaagaagccgttgagattgtcagcgaagtgctgaaaaacgcctgattagtcgggcagataaagaggcgcatcgcgcgcctcagactgctggtaaagcgcggccttcatcgctgtgaggccgtgtagctagctcaggaaacgcggccagatcggaaagacgcaaaagccgtcatccatgacacgctcggcccacgcgattacgcacctcatccctgaggtgcgcccgttgccgggccaacgcgttgcgttgttcaaaaacgctcccggcgtttttgtccctggcgtgggacgctttcctcttctggccgtgttccctgcgctttgaatttattcattgcggtgagattcacaggatttggctttatcagcactctgaaggcgcctctggcgcctttttttatggcataaagcgatagccgatcccggtttccgtcagcagatgagccggttgtgtcggattggcttccagtttctggcgcagatgtcccatatagatgcgcagatagtggctgtgctcaaccgcattgggtccccagacctggctcagcaactgccgctgcgtcagcaccttgccggcattgttaagcagaatactcaacagacgaaattcaatcggggtaaggtgaatctcactgctgccgcgctgtacccgtcgtgcggcgaaatcgacgctgacgtcggcaaacgtcactctggcatccggctgctggccactatgacgacgcagcgcaacccggacgcgcgccagcagtttcgccaatgccaaagggtttagtcagatagtcatctgcccccgcatccagtgcggcgatcttatcctgctcatcgctgcgcgctgacagcacaatcaccggtatggcgctccactgtcgcaggtcacgaatgaaatcggtgccatctccatccggcagacccagatccaggatcactaagtccggcttgcgggtcgccgcttcaatcagtccgcgttgcagtgtatcggcatcaaacaccttaagggcttcattttccagcgccagccggacaaagcgccggatctctttttcatcttcaacgatcaaaaccgtggtcacgcaatacctgccttgagtggggaccgaagcgctactttatcaacattttatgctggcgtccgtgaccataatctgtcggccctttcaacgctaacgcaaccaagcggtaacctttttgtaacttaattacaggttaattcttaaacagcaaaaatagcagcaaataagtggtcagatgagtagtaaaattacacaacctggcgtaaagttgaacacagatcacattcacactttttcacttaccgggaggagaaaccatgtatcgggcttatccacgttataaaattattgcgcgacgtacgctggtggttcttctcggcgtactggcgcttcctgttatgctgtttcgacaggatcgggcacgtttctacagctatctgcaccgcgtctggtgtaagaccagcgccaagccggtctggctggcgcaggctgaagcgagtggtagcgcgttctggtgatttcccatgccgcaaaacaggcctggtcaactgaccgggcttttttttgcgttttttctgagaataagcgatccggaatcccgttttaaccctttattcctgaccattttacgctacacttaaacctctacaagatttcggaggttgtacaagtatgagcaaaaaaatccccgttggaatcagtgcatgcctgctcggcgaccgcgtcagatttgatggtgggcataagcgtcttacttttgcgaccgacgatctcactccatttgtccgttttgagcccatctgccctgagatggcgattggtctgccaacgccgcgcccggcattgcgtctggtgaagcagggcgatgatgagctgcatctctgcttcagcaaagatggcggagaagaggttacgacgcagatgcgtgactggtctgctgagcgggtaaaatcgctgcatcacctctgtggctatatcctctgcgccaaatcacccagttgtggcatggagcgggtgcgggtctatgagcccgataacaacaataaccgcaaagcaggcaccggtatttttactgaattcctgcagcgcgagatgccctggctgccgctggaagaagatggtcgtctgcacgatcccgccctgcgtgagaactttatcggtcgtgtctgcgcgctgcatgaatttaatcagatgtgggaaagcggtctgacccggcagggactgatcgccttccacagccgttacaagctgatgatgctggcgcattcgcaggagaaataccgcgagctgggaccctttgtcgcctccatgagccagtgggagtcgctggacgcctttgcctttgaataccgcaatcgcatgatggaactgatgtcacgtcccgcctcacgtcgcaatcacaccaatgtgctgatgcatgtgcagggctacttccgcacgcatctgagttcaccgcagcgccaggagctggcaacgctgattgaccgctatcgtcagggcacacaaccgctgctggtgccgattaccattctcaaacactacatggcggagtacccgcacccgtggctggcccagcaacgctatttcgatccctatcccgaagccttgtgcttacgctacggacagtaatacaggaggagtatgaccacccatctggtctggctgcgtaacgatttacgcgtcaatgacaatctggcgctgcacgccgcctgccgcgacagcgatgcaaaagtgattgcgctctaccttgccacgccagcacagtggcagcagcatgacatgtcaccgaagcaggcgacgtttatccacgccagcctgttgcaggtgcagcgtgcgctggcagagcggggcattgaactgcactatcaggcgtgtcacgccttcagcgacagtattgatgcgctgctgcagttttctgcgctaagcagcaggtcgatcagctcttctacaattaccagtatgaagttaatgaacgccagcgcgatgcggaggctgaaaagcgtctcgacgacgcgggcgtgatttgccagggctttgatgacagcctgttgctgccgcccggcagtgtgcagagcggcgatcgctcgatgtataaggtgtttaccccgttcagcaaagcctttgtccgccgcttgcagcaggggctgcctgagtgcgtgcctgcgccgaaagcgcgcgaaggcgcaccgctgaaagcctccccgattcccgcctttgactatccaaccgaagactttgatcaggatctgtttccgccaggcgaagcggcggcgctgaagcggttgcgccatttcgccacgcaactggttctcgactatcccgctaagcgcgaccttccggcgctggacgccaccagccgtctgtcggtttatctggcgaccggcgtactgtcgccacgtcagtgcctgcatcgcgtgctgcatgaacatcccgatgcgctggacaacagccgcgcgttcacctggctgaacgagctgatctggcgtgaattctaccgtcatctgctggttgcctggccggcgctgtgccgacacaagccgtttatcgactggacgcgtaatgttgaatggcagcgtaacgacgcacatttcgacgcctggaaagcgggtaaaaccggctatccgattgtcgatgccgcaatgcgtcagatgaaggcgctgggctggatgcacaaccgcttacggatgatcaccgccagtttcctggtcaaagatctgctgatcgactggcgtgaaggtgaacgctatttcatgcagcagctgattgatggtgacctggccgcgaacaacggcggctggcagtgggcggcctcgaccggcaccgacgcggcgccctatttccgcatctttaacccgaccacgcagggcgagcgcttcgatgagaagggggattttatccgtcactatctgcctgaactggccggggtccctgacagtgatattcaccagccccatgtctgggcggagaagcatcataagaaactcgattatccggcaccaatcgtggatcataaggtggcacgtaaaaagacattagacgcctttgagcgcgccaagagcgcagcctgaggcctcgaaggagcctgaatgaaccattacgaattagagacgctgatcaatcagcaactcgatagccacagtttcagcgattacgcccccaacggtttgcaggttgagggacgcagcgagatcaaaacgattatcaccggcgtcactgcctgtcaggcgctgctggatgaggcggtggcgcgtcaggccgatgcgattattgtccatcatggctatttctggaaaagtgaaccggccgcgattaaaggtatgaagcgccgtcgtctgcggaccctgctggccaacgatatcaatctctatggctggcacctgccgctcgacgcgcatcctgaactaggcaacaacgcccagctggcgaaactgctggatatcgaagtgcgcggcgaagtgatgccgctggtattctggggtgagctggctgagcccctgtccggcgaaacagctggcccgccgaattggtgagcggctgggacgtgaaccgctgcattgtggtgacaacgcgccagcgctgatccgtcgcattgcctggtgcagcgggggcggacagggctttatcgaccaggcggcggcggcgggcgtcgatgcctttatcactggtgaagtctctgaacagactattcacagcgcgcgtgagcaggggctgcatttctttgccgcaggccatcacgccaccgagcgcggcggcgtaaaagcgctgggcgactggctggcgcaacaccacgatcttgatgtgaccttcatcgatatccccaatcctgcctgactctctcccttgtcctgcgcgcctgcgcaggacctaaatctgttgacacatccctgtcactttcgcataactgtttgctttacgtagataagcaatgggctgcaccgggcatccggtcaggtcggccaggcgcgatctcaactgagcgggaggtagctgttgcaacgagcacggtgttatttattgggtgaacgcgctgtcgtgctggagctggaaccgccggtatcactggagagccagcaacgaatctggggactgaatcagcgcctgcacgactatgccagcgtgctggaggtgatccccggcatgaacaacatcaccctgatcctgcgagatccccagcagagcgcgctggacgcaatagagcggcttcagcgctggtgggaagagagtgaagcgcagttgccggagtcgcgtcaggtggagatcccggtgatctatggcggcgagtctggccccgatctgacggtggtggcggaacacgccgcgctgacgccccgtcaggtggttgagctgcacagcagcagcgactatgtggtcttttttatcggctttcagcccggttttccctatctgggcggactggatcagcgcctgcacattccgcggcgtgctgagcccagggttgcagtgcccgccggctcggtgggcatcggcggcagccagaccggcgtctatccgctggcttcgcccggcggctggcagttgattggccagacgcgcaccgcgctgtttgatcccctgcagcaaccgcccacgctgctccgtcccggtgacagggttcgctttgtgccgcaacaggagggcgtatgttaaacattctgcgagccggcctggccgcgactattcaggatgcgggccgttacggctggcgtcagtatggcatcagccctggcggtgtgctggatcatcccgcgatgttcaccgccaatgtgctggtgggcaatgatcccgacagcgcggtactggagatggtgctcggccagttcaaagcggagtttacccgcgatggctggtttgcgctgaccggcgcaggctgccatgcggagcttgacggccagccggtctggacgggctggcgtaccccggtgaaacgggggcagctcctgtcactggcgatgccgcagcgcggcatgcgcagctatctggcagtgcagggcggttttgatatccccgcgatgctcggctctgccagcaccgatctaaaagcaaaatttggcggattccaggggcgaaccttgcaggatggcgatcagctcccgctgggtaaaccgacccgcacgtttgaccgtaaagtcggggtgcggcaactgctatggggcaaccgcatccgcgcactacctggcccggagtatcacgagttcagccgcgaagcgcagcaggcgtttctggcgtaccgcatggaaactcagcccgcaaagtaaccggatgggataccggcttgagggacgcaagcttgagcgcgagagcccgcgcgagttgctgtcacacggcgtgatgccgggtgtgattcaggtgccgccgaacggacagcctatcgtgctgatggcggatgcccagaccaccggcggctatccgcgcatcgcctcggttatcgaagccgatctctatcacctggcacaaatccggctgggtgagccgattcattttattcactgcaccctgccggaagcgatgctggcacgtcagcatcagcaacgcgcactggaccagatgaagtggggactccatgaaaattgatttaaacgccgacctgggcgagggctgcgccagcgatcaggcgctgctgcaactggtgagttccgccaacatcgcctgtggctttcacgcaggtgatgcgcagaccatgctgcagtcggtgcgctgggcacaggcatctggcgtcgcgattggtgcacatcccgcttttcccgatcgggaaaactttggccgcagcgccatgcagctgccgccggaaacggtctacgcccagatgatctaccagattggtgcgctgaaaagtctggcggaaagcgaaggagcgcggctgcttcatgttaaaccgcatggcatgctctacaaccaggctgcggccgatccggtgctggcggacgccattgcccgcgccatcagggctgtcgacagccagctgattgtggtgggactggctaacagcgaatcgattcgcgcggcggcgcactacggcctacgcacgcgggaagaggtgttcgccgaccgtggctatctcagtagcggtgcgctggtgccgcgcagcgagccgggcgcgctgattgaagatgaacagctggctatcagtcagacgctgacgatggtgcagcagggcaaagtcaaaagtatcaccggagaatgggtagcggtgaatgcacagaccgtctgcttacatggcgacggcgcgcacgccctgcaatttgcacagcggttgcgtgatgcgtttgccgatcagcagattcgtgtcaccagcaactgaataaccacacttagcccggcgtatgccgggtttttcaactctgagggaaatccatggatagtgcagtaaatctctggccattactgggcatcgccgccatcgtcgtcggcttcctgttacggttcaatccggtgctggtggtgattgtcgccgggtttgtgaccggtctggccgcgatgatgccgctggcggacattctggaaaagctcggagcgggttttcttaacacccgcaacctgccgctgatcctgctgctgccgctggcggtcattggcctgctggagcgtcacggactgaaagagcgggcgcaggcgtggattgcacagatcaaaacggcaaccgccggacggctgctgatcgtctacctgtttgtgcgcgaaatcaccgccgcgctggggttaaccagtctcggcggacatccgcagatggtgcgtccgttgctggcaccgatggcggaaggagcaactgaaagccgctatggcgagatctcacctgagctgcgccatcggctgcgcgcgatgtcagcggcgaccgataatgtcggcctcttctttggtgaggatatcttcgtggcgtttggcgcgattatctttatgcacaactttatgcaggagtcagccgggattcagaccgaaccgctgcacatcgccttatggggcattccgactgccgtcgccgcgtttcttgatccactcggcacgtctggtgcggctggatcggcaactggcgcgagagctgcagcagttgaaccgtcaggcgctgaaagccaaaggaggtgagtaatgttccagcaacaatatctgatgtggctggcgggcattatcctgctggtggtggcggtgctttcctggcgtgacagcgcgaatccgcgtcgttttaccaccggactgttctgggctttgtatggcctggtttttctggtcggtgactggacgacgcaactgatgagcgcctggatggggtcagatgcggcgggcacccgtatgctgcacatcggcatcggtgtcattgtggtggtgatggcgctgattgccgggtttggcggtgtcaggctgggtcgctatcatcagcgtagcgatgaagagaaacaggccagtgcgctgcgtctgcgcaataaactgtttctgcctgcactgtcgattccggtcgtgaccgtggtcggtgtgctggcgtttaaccatattcccggtttgcaggatgcggtgttcggccccggtaaccacgccacgctggtgacgctgttttcaatgatggtcggctgtgtgattggctggctggtggcgttaaaactgacccacgagaaaccggtgcagtcgatgcaggagacccgtcgcctgctggattcgattggctgggcctttatcctgccgcagatccttgccaccctggggctgctgtttaccagcgcaggcgtgggcagtgcgatttcgcatctgacagaaacctggctggcggtagataatcgctttgtcgcggtcaccgtctatgccgtcgggatggcgctgttaaccatgatcatgggtaatgcttttgcggcgtttccgataatcaccgcaggcgtcggcatcccgattcttgtgttgcagcacggcggaaatccggcagtgatggcggcaattggcatgttctccggctattgcggcacgctgatgacgccgatggcggccaacttcaatatcgtcccggcagcgctgctggaactgcccgatcgtaacgcggtgatcaaggctcagattccgaccggtgtgctactgttaatcgttaatattttcctgctctatttcctgatgttcctgtgaggttgcatgaaaactgtcctgatgaccgcctttgaaccttttggcggtgaaacgattaacccttcatgggaagcggtgcgcgcgctggaaggtaaacagattagcggggcgacgatagttatacgccagttgccggtggtattcagcgacgtactcagggtgctgaatcaggcgctggaagaggtgaaaccggatgcgattctgtcggtggggcaggcgggcggccgtagcgacattaccgttgaacgtattggtattaatgtcgatgacgcccgtatcccggacaacgccggtcatcagccggtggatgagcccgtcgtagcaggtggcccggcagcctatttttcccgtcttcccatcaaagcgattgtggcggcggtgcgggaagcggggatccccgcttcagtgtcgcaaacggcgggcacctttacctgtaaccgcgtaatgtacggcctgctgcactggcttgagcagcatgacagtccggtgcggggaggttttatccatattccttatctgccagaacaggcggcgcagcatccgggcgcaccgagcatggcgctggcgtccattattcaggcgctggaaattgcggtaaaggtcacgctggagaccggcgaggatatcagacaggctggcggcgccacccattaagaggatgaacgatgcctgaaggaccggaaattcgtcgcgtggcggataaacttgaagacgccattgtgggtcagccgttaacggaagcgtggttcgcgtttcctcagctcaagacctatgaaccggcgttgattggtgagcaggttcaggcgattgagacgcggggcaaagcgctgctgactcatttcagcaatggcctgacgctctacagccataaccagctttatggtgtctggcgcattgtaaaacctgacaccgaactgaattccacccgtcagttgcgggtgcgactggcgacggcgggcaaagcgattctgctctacagcgcctcagatattgagctgctcaacgcagatacgctggcggcgcatccgtttcttaatcgtatagggccggatgtgctgaacagtgccctgacagtggaagaggtgaaagagcgactgctgtcaccccgtttcaggcggcggcagttcagtggtctgttgctggatcaggcttttctggccgggctgggaaactatctgcgcgccgaaattctgtggctggcgcagctgctgccaaatcatcgggcgcaggatctcagtaacgatcagctgactgctttcagcgaagcgctgctttcagtgccgcgccatgcctatcggatgcgtggaaccatgaagaaatatcatgaggaagcggcgtttcagtttgaggtttttcatcggcagggcaaaaaatgccgacgctgcggcacggtgattgagaagggcacgctctcatcacggcctttttactggtgtccgggttgtcagagataggcacttgaagaaagcaaaagcggggtagtgtagttctggtctgcggtgagatcgagcctgctcaggaaacacggtcagatcggaaagacgcaaaagccgtcatccctgacctgctcggcccgcgcgattacgcacctcatccgtgaggtgcgcccgtagccgggctaacgctttgcgttattcaaaaacgctcccggcgtttttgtccatggcgcgggacgctttcctcttctgaccgtgttccctgcgcgttaaacttcttcattgctgccagatgcgcccttatgtgggcttctcaactggctgagcggagatccctctccgctatccactgagccttactttttcagctgtgagctgaattcgcgctcggtataaccggtgtagagctgacgtggacgggcaatcttcatgccttcgtcgtgcatctctttccagtgtgcaatccagccaacggtacgggccatcgcgaagatcaccgtaaacatggaggatggaatacccatcgctttcagaatgataccagagtagaagtccacgtttggatagagtttacgctcaatgaagtacgggtcgttcagcgcaatgtgttccagctccatcgccacttccagcaggtcatccttcatacccagctcattcaggacttcatggcaggtatcgcgcatcacggtcgcgcgtggatcgtagtttttgtaaacgcggtgaccaaagcccatcagacggaaggagtcatttttgtctttggcgcgtttaacaaattccggaatatgctcaacggtgctgatctcttccagcatacgcagggtcgcttcgttggcaccaccgtgcgccggtccccacagggaggcgatcccggcggcgatacaggcaaacggattcgcgccgcttgaaccggcggtacgaacggtagaggttgaggcgtttctgctcatggtcagcatgcaggatcaggatgcggtccatggcgcgttccagcaccggattcactttgtactcttcgcacggcgtggcaaacatcatgtgcaggaagttacccgcataggagagatcgttgcgcggatagacaaacggctggccgatagaatatttgtaacacatcgctgccatggtcggcattttagaaagcagacggaatgctgcgatttcgcggtggcgctcaatgtttacatccagcgaatcgtggtaaaacgcagccagtgcaccagtaacaccgcacattaccgccatcggatgcgaatcgcgacggaagccgtggaacaggcgggtaatctgctcatgaatcatggtgtggcgggtaaccgtggtacggaactcatcaaactgtttctggtttggtgcttcgccgttcagcaggatatagcagacttccagatagttagagtgggtcgccagctcagaaatagggaaaccacggtgcagcaggataccttcatccccatcgataaaggtgattgcagattcgcaggacgcggtagacgtaaaaccgggatcgaaggtgaacaggccacttgaacccagagtgcggacatcaacgacatcctggcccagcgtacctttcagcacgtccagttcaatagatgttccatcttgcagggttagcgttacttttttatctgtcattttcgtctccatagcgccttatgtaggtaaggatctttagacacctgaaacgcgttcatgttgcggttggcaaaactacacagtatcactctgcggggataaaacgggtgcagggtacagagtgagcggcgcgtttcccagcgggaaccggtgagccatggacatgctgcatatcgcggttgttaaagatccggtcaggacataacttcttggtaaccaataacctgatgctttttaatgctcattatcgcaatgttacataacttgcgcttaggggaaagtgtatccccataacttttgcgcatcataggaatttacaggcttagtttgtaactgaattgttgaactattgtcaaatcagataattaaaattgtatcaattgtgaaaatcgtgagtaggatcactgttccacctaaaatataccaaagagtttgtaggggaattgtaatcagaatgtgatcctcctatactccaggcaggtctccggaacaccctgacaccaggagccacccagcgtttactaccgcgtcaattaacactggatgttgcttttttggtgacggttaaagtctgccacgcgttgtgattagactccgcctcaggtccggaggaagcaaaataaaaaagagctgtgtgggcaaaaccgtgaaaaaacaaagacctgtcaacttggatctctcgacgatccggtttcccgttactgcaatatcgtccattcttcaccgcgtctccggcgtaatcacattggttgccattggcatcctgctgtggctgctcggtctctctctctcctctcctgaaggtttccagcacgctgcgtccatcatggatggcttcttcgcgaagttcattatgtggggcatcttaacggcgctggcctatcacgcggtgagcgggattcgtcatatgttgatggattttggttatctggccgaaacgctgcaggttggtaagcgttccgctcatatgacttttgtgatcactgtcgtgctggcaattctggcgggagtcctcgtatggtaagcaatgcatccgcattgggtcgcaacggaattcaggactggctgctgctgcgggcaactgcaattctcataacgctctacatcgtctatatcctcggtttcgtggtgatgacagacacgctgacttatgacctgtggcgtggcttcttcgcttccgcattcaccaaagtgttcacgctgctgacgctgttctccattctgatccacggctggattggcatgtggcaggtgttaacagactacgttaaatcactgccaacccgcttgttgttgcagtttgtgattgtcgtggcgctgttgtggtatgcgatttatggatttgttgtggtgtggggtgtgtaaatgagtttgccaatcagagagttcgatgccgtggtaatcggcgcaggtggcgcaggaatgcgagccgcactgcaaatctcccagggcggccagagctgtgccctgttatctaaagttttcccgacccgttcccacaccgtatctgcgcagggcggtattaccgttgcgctgggtaatacccatgaagataactgggaatggcacatgtacgacaccgtcaaaggttccgactatatcggtgaccaggacgcgattgaatatatgtgtaaaaccggcccggaagcgattctggaactggaacacatgggtctgcctttctcgcgtctggaagatggtcgagtctaccagcgtccgtttggtggccagtcaaagaatttcggtggcgagcaggcggcacgaaacggcggctgcggctgaccgtaccggtcacgcattgctgcacaccctttatcagcagaatttgaaaaacaaaaccactatcttctctgagtggtatgcactggatctggtgaaaaacgccgatggcgcagtcgtgggttgtaccgctatctgcatcgaaaccggcgaaaccgtttatttcaaagcgaaagcgaccattctggccaccggcggcgcgggccgtatctatcagtccaccaccaatgcacacatcaacaccggtgacggcgtaggtatggcactgcgtgcgggcgtaccggtgcaggatatggagatgtggcagttccacccaaccggtatcgccggtgcgggcgtgctggtcaccgaaggctgccgtggtgaaggcggctatctgctgaacaaacatggcgaacgcttcatggagcgttatgcgccgaacgccaaagatctggcgggccgcgacgtggttgcgcgctcaatgatgattgaaatccgtgaaggtcgcggctgtgatggcccgtggggtccacatctcaaactgaaactggatcatctgggtaaagaggtgcttgagtcacgtctgcctggcatccttgagctgtcacgcacctttgcgcacgccgatccgattaaagagccgattccggtcattccgacctgccactacatgatgggcggtattccgaccaaagtgaccggccaggccctgcgcgtcaatgagcagggcgaagatgtagtgattccaggcctgttcgccgtcggtgaaatcgcctgcgtatcggtacatggtgccaaccgtctgggcggtaactcactgctcgacctggtggtctttggccgtgcagcgggtctgcatctgctggcgagtattcaggagcagggcgacctgcgtgatgccacagaagatgagatcgccggggcgatggcgcgtttcaaccgctgggaaaataacaccacgggtgaagatccggttgagattcgtaaagcgctgcaacgctgcatgcagaataacttctcggtattccgtgaaggcgaagcgatggcacagggtctggaagagctgaaagagattcgccagcgtctgaagtcagcgcgtctggatgaccgctcaccggatttcaacacccagcgtattgagtgcctggagctggataacctgatggagacggcctttgccacggcggtagcggctaactatcgcaccgaaagccgcggtgcgcacagtcgcttcgacttcccggatcgtgatgatgaaaactggctgtgccacagtctttatgtcccggaaaccgaaagcatgacgcgccgtgaggtgaacatgcagccgaaactgcgcgcggccttcccgccgaaagtgcgtacctactaatttcggagacgatcatgagactcgagttttcaatttatcgctacaatccggatgtcgatgacaaaccgcgcatgcaggattacaccctggaagcggaagatggtcgcgacatgatgctgctggacgcgctgattcgcctgaaagagaaagatccgaccctggcgtttcgtcgctcctgtcgtgaaggcgtctgcggttccgatggcctgaacatgaacggtaaaaacggactggcctgcattacgcccgtctcggcgctgggcaacggcaaacagaaaattgttatccgtccgctgccaggtttaccggtggtgcgtgacctggttgtagacatgagccagttttatgcacagtatgagaaaattaagcctttcctgttgaataatggggaaaatccgccagctcgtgaacatctgcagtcgccggatgagcgtgaacacctggatggcctgtacgaatgtatactctgtgcctgctgctcaacctcatgcccatcattctggtggaatcctgagaagttcatcggtcctgctggcctgctggccgcgtaccgcttcctgattgacagccgcgacaccgaaaccgaggcgcgtctcgacaatctgaatgatgctttcagcgtattccgctgccatagcatcatgaactgtgtgagcgtatgtccgaaagggctgaacccgacgcgcgccatcggccatatcaagtcgatgctgctgcagcgcggcgcataagcagtttctgccgggaacctcaggttcccggtgttttacggaagcctctgtaagcgcggtgattaccacgtttacaaaggttcccttacgggccacgcgcgctgcgcaaagtgctcgtatcgctgaactcactacggcaaaccgcgaaagcggcaacaaatgaaacctcaaaaaagcatagcaatgcttaagggatcacaatgcagaacagcgcgatgaagccctggctggactcttcctggctggccggcgcgaatcagtcttacatagagcagctctatgaggatttcctgaccgatcctgactctgtcgatgcagtgtggcgctcgatgttccagcagttaccgggcaccggaatgaaacctgagcagtttcactccaccacacgtgagtacttccgtcgcctggcgaaagacgcatctcgttacacctcatctgtctccgatcctgaaaccaactccaagcaagtaaaagtgctgcagctgattaacgcgtttcgtttccgcggtcatcagcacgccaatcttgacccgcttggtctgtggaaacaggaccgggtagccgatctcgatcccgcttttcacgatctgaccgaggccgattttcaggaaagctttaacgtcggctcttttgccattggcaaagagaccatgaagctggccgaactgttcgaggcgctgactcagacttattgcggctcgatcggtgcagaatatatgcacatcaacaacactgatgagaaacgctggattcagcagcgtcttgagtcagtcgcgggccgtgcagccttcagcaatgaagagaaaaaaggtttcctgaaagagctgaccgcggccgaagggctggaaaaatatctcggagcgaaattcccgggtgccaaacgcttctcgctggaaggcggcgatgcactggttccgatgctgcgcgaaatgatccgtcatgccggtaagagcggaacccgtgaagtcgtattgggtatggcacaccgtggccgtctcaacgtgctgatcaacgtgctgggtaaaaagccacaggatctgttcgacgagttcgccggtaagcacaaagagcatctgggcaccggtgacgtgaagtaccacatgggcttctcgtctgacgtggaaaccgaaggcggcctggttcacctggcgctggcgtttaacccgtcgcacctggagatcgtcagcccggtggtcatgggttcagtgcgtgcccgtctggatcgtctggatgagccagccagcaataaagtcttaccgatcaccattcatggtgatgcggccgtgattggccagggcgtggttcaggaaactctgaacatgtctcaggcgcgcggttatgaagtgggcggtaccgttcgcatcgtcatcaacaaccaggttggctttaccacctccaacccgaaagatgcgcgttcgaccccttactgcaccgatatcggcaaaatggtgctggcaccgattttccacgtcaatgctgacgatccggaagcggtcgcgtttgtgacccgtctggcgctcgactatcgcaacacctttaagcgtgatgtgtttatcgatctggtctgctatcgccgtcatggtcacaacgaggcggatgagccaagtgcgacccagccgctgatgtaccagaaaatcaaaaaacacccgacgccgcgtaaaatctatgccgaccgtctggaaggtgaggccattgccacgcaggaagatgcgaccgaaatggtcaatctctaccgtgacgcgctggatgcgggtgagtgcgtggtgccggaatggcgtccaatgagcctgcactcctttacctggtcaccttacctgaaccatgagtgggatgaaccttacccggctcaggtcgacatgaaacgtctgaaggagctggcgctgcgtatcagccaggtgcctgaagaggtggaagtgcagtcgcgtgttgccaagatttacaacgaccgtcgtctgatggctgaaggcgagaaagcctttgactggggcggcgcggaaaacctggcatacgccacgctggttgatgaaggcattccggtgcgtctgtcgggtgaagataccggtcgcgggaccttcttccatcgtcacgcggtagtgcataaccaggcgaaacggctcaacctatacccctctgcaccacgtgcacagcggtcagggccagttcaaagtctgggactccgtgctgtcagaagaggcggttctggcctttgaatatggttatgccaccgcagagccgcgcatcctgaccatctgggaagcgcagtttggtgacttcgccaacggggcacaggttgttatcgaccagttcatcagctccggtgagcagaaatggggccggatgtgtggcctggtgatgctgctgccgcacggttatgaaggtcaggggccagagcactcctctgcgcgcctggaacgttatctgcaactctgcgctgagcagaacatgcaggtctgcgtgccgtctacccctgcgcaggtttaccatatgctgcgtcgtcaggcgttgcgcggtatgcgccgtccgctgattgtgatgtcgccgaaatcactgctgcgtcatccgctggcgatctccacgctggatgaactggctaacggcagcttccagcctgcgattggcgaagtcgatgatctggatccgcagggcgtgaaacgcgtcgtgctgtgctccggtaaagtctattacgacctgctggagcagcgtcgtaaaaatgagcagaccgatgtggctatcgtgcgcatcgagcagctctatccgttcccgcatcacgcggtacaggaagcattaaaagcgtatgctcacgtgcaggattttgtctggtgtcaggaagagccactgaatcagggcgcctggtattgcagccagcatcatttccgtgaagttgtgccgtttggtgccactttacgttatgcaggccgcccggcatccgcctcaccggccgtgggttacatgtccgtacaccaacaacagcagcaagacctggttaatgacgcgctgaacgttaattaattaaaaggaaagataatgagtagcgtagatattctcgttcccgacctgcctgaatcggttgccgatgcctctgtggcaacctggcataaaaaaccaggcgatgcagtcactcgcgatgaagtgctggtcgaaatcgaaactgacaaagttgtactggaagtgccagcctctgcggacggtatcctggaagccgttctggaagaagagggcgccaccgtcacttcccgccagatcctgggtcgtctgaaagagggcaacagcgccggtaaagagagcagcgcgaagtctgaaagcaaagagtctaccccggctcagcgtcagactgcgtcactggaagaagagagcaacgatgcgctcagcccggcgatccgccgtctgattgcagagcacaatcttgatgcctcacagatcaaaggcagcggtgttggcggtcgtctgacccgtgaagatgttgaaaaacatctggccaacaaaccgcaggctgccaaagccgctgcaccagctgctgatgcggccgccgcgcagcagccagtggctaaccgcagcgaaaaacgcgtgccgatgacccgtctgcgtaagcgtgttgcagagcgtctgctggaagcgaagaaacagcaccgcgatgctgaccaccttcaacgaaatcaacatgaagcccatcatggatctgcgtaagcagtatggtgaggccttcgagaagcgtcacggtgtacgtctgggctttatgtccttctacatcaaagcggttgttgaagcgctgaaacgctatccggaagtgaatgcttctatcgatggtgaagatgtggtttaccacaactacttcgacgtcagcattgcggtctctacgccacgtggtctggttacacccgtcctgcgtgacgtggatgcgctgagcatggcggacatcgagaagaaaatcaaagagctggcagtgaaaggccgtgacggcaagctgacagttgaggatctgaccggcggtaactttaccattaccaacggcggcgtctttggttcactgatgtccaccccgatcatcaacccaccgcagagcgccatcctgggcatgcacgccatcaaagatcgtccgatggcggtcaatggtcaggttgtggtgctgccaatgatgtatctggcgctctcctacgaccaccgtctgatcgatggccgtgaatcagttggttatctggttgcagtgaaagagatgctggaagatccggcgcgcctgctgctggatgtctgattttcaccgggcgcgccttgccgcgcgcccaacctcattactcttttcagacctgaatggatagaacatcatgaacttacacgaataccaggcgaaacaactgtttgcacggtatggcatgccggcaccaacgggttacgcctgtactacaccacgtgaagcggaagaagcggcctctaaaattggcgcaggcccgtgggtagttaaatgtcaggttcatgccggtggccgcggtaaagcgggcggtgtgaaagtggttaacagcaaagaagagattcgcgcttttgctgaaaactggctgggcaaacgcctggttacctatcagacagacgcaaacggccagccggtaaaccagattctggttgaagcggcgaccgatatcgatcaggagctctatctgggcgctgtggtcgatcgcgcaacgcgtcgcgtaattttcatggcctccactgaaggcggtgtggaaattgaaaaagtggcggaagagaccccgcacctgatccacaaaatggcgctggatccactgactggcccgcagccttatcagggccgtgagctggcgttcaaacttggcctgaccggcaagctggttggccagttcaccaagatcttcatgggtctggcgacactgttcctggagcgcgatctggcgatggttgagatcaacccgctggtgatcaccaaacagggcgacctgatctgcctggatggcaaactgggtgccgatggcaatgccctgttccgtcagccagagctgcgcgaaatgcgcgatccaagccaggaagatccgcgtgaagcccatgcgacacagtgggaactgaactatgttgcgctggaaggcaacatcggttgtatggttaacggcgcaggtctggcgatgggcaccatggacatcgttaaacaccacggcggtcaaccggccaacttccttgatgtcggcggcggcgcaaccaaagagcgcgtgaccgaagccttcaaaatcatcctgtctgacgatgcggttaaagccgtattcgttaacatcttcggcggtatcgtacgctgcgacctgattgccgacggcatcatcggcgcagtcgctgaagtgggtgtgaacgtaccagttgtggtacgtctggaaggtaacaacgccgagctgggcgcccagaaactggcggacagcggtctgaacatcattgcagcaaccagcctgacagacgccgcacagcgtgttgttgctgccgcggagggtaaataatgtccattctgatcgacaaaaacaccaaagtcatttgccagggtttcaccggtggccaggggactttccattctgagcaggcgctggcatacggcacccaactggttggcggcgtgacgccaggcaaaggtggcacgacccatctcggcctgccggtgttcaacaccgttcgcgaagcggtagaagcaaccggcgcgaccgccaccgtgatctacgttccggctcctttctgtaaagatggcatcctggaagcgatcgacgcgggcatcaaactgatcatcaccatcaccgaaggcatcccgaccctggatatgctgaccgtgaaagtgaagctggatgaagcaggcgtgcggatgatcggtccaaactgcccaggcgttatcaccccaggcgaatgtaaaattggcatcatgccgggccacattcaccagccgggccgcgtcggtatcgtgtcacgttcaggcaccctgacctatgaagcggttaagcagaccacggatatcggctacggccagtcaacctgcgttggcatcggtggtgacccgatcccaggctctaacttcatcgacatcctgaaaatgttccaggatgatccacagactgaagttatcgtgatgatcggtgagatcggcggtagcgcagaagaagaagctgcagccttcattaaagagcacgtgaccaagccggttgtaggctacattgctggcgtcaccgcgccaaaaggcaagcgtatgggccatgctggcgccatcattgccggtggtaaaggtacagcagatgagaaatttgctgcgctggaagcggcaggcgtgaaaaccgtccgcagcctggcggatatcggtgacgcagttaaagccgtattaccggctaaataagtcagcgtcatctgagactaagccaccttcgggtggctttttttatgcctgtaaatgagagctataacgcaggaagctaaagagaagagtgcgcggtaaaatagctggcccgcggctcattacgttaagaaaaagtgtcaaaggtaaattattccttcgcgctttatttcattactgacatctcattaacaagaaacctacctgactctatctggaaacttattgcgttaatccagatcaattaatcgcgacttatatccaactatatctctggcaaagcgcaacgctaagggcgtaaattgcgctgcatcaatccagccttttacacaaattttcaaacgtctgctcaacccgggataacacccgctttcctcctgttaaagcacgcgttaacgaaagcgctgattgacaattttctgagctgcttcattcgctactcgcctgttcgggcagctcacagacctgttctgcgggtaataaaaaactggaatcaataaacagtcgttgctgactctgattgcgttcgatctgatcgcgcgcgtgacggagacaaagcgaggagcaaggagtccttatgttagatatcgtcgagctgtcgcggttacagtttgccttaacggcgatgtaccattttctgttcgtccctttaacgctgggtatggcgtttttgctggcgatcatggaaacggtatatgtcctgagcggcaaacaaatctataaagatatgacgaagttctggggcaagttatttggtattaactttgcgctgggtgtcgccaccggcctgaccatggaatttcagttcgggactaactggtcatattactctcactacgtcggcgatatcttcggcgcgccgctcgccattgaaggtctgatggcgttcttcctggaatccacctttgttggcctgttcttttttggctgggatcgcctgggcaaagtgcagcacctcgccgtcacctggctggtggcgctgggctcaaacatgtcggcgctgtggattctggtggctaacggctggatgcagaatccgatcgcctctgagttcaacttcgaaaccatgcgcatggagatggtcagcttctcagagctggtgctgaaccctgtcgcgcaggtgaaattcgttcacaccgtagcagccggttacaccaccggagcgatgtttattatgggcatcagcgcctggtacatgctgaaaggccgtgacttcgcctttgctaaacgctcgttcgctatcgcggccagctttggcatggcggcggtgctgtcagtcatcgttcttggcgatgagtcaggttacgaaatgggtgacgtgcagaaaaccaaactggccgctatcgaagcggagtgggaaacccagccggcaccggcctcgtttaccctgtttggcctgcccgatcaggccactcaggagaaccgatacgcagtacagatcccctggctgctgggcctgatcgccacccgatctaccgatacgccggtaaccggcctgaaagatctgatggcacagcatgaagtgcgcatccgcaacggcatgaaagcctatgccctgctgaatgagctgcgcggtggcagccaggatccggcggtgcgtgacgcgttcaacagccacaaacaggatctcggctacggtctgctactgaagcgttataccgacaacgtggctgatgcgaccgaagcgcagattaaacaggcgacgcaggactctatcccgcgtgtcgccccgctctatttcgccttccgcatcatggtgctgtgtggcgtactgctgctgggcattatcgcgctggcattctggagcgtactgcgtaaccgtatcggtaaaaatcgctggttactgaaagcggcgctgtttggtattccgctgccgtggatcgctatcgaatcaggctggtttgtggcggagtatggtcgtcagccctgggctatcggtgaagttctgccgactgcggtagccaactcctccctgaccgttggcgatctgctgttctccatgatcctgatctgcggactctacacaatgttcctggtggctgagatgtacctgatgttcaaattcgcccgccttgggccgagcagcctgaaaaccgggcgttatcatcatgagcagatcacggcaatcacccagccggtacagggataaggagagcgaccatgtttgattatgaagttctgcgctttgtctggtggctgttgattggcgtactgctgattggctttgccgtcgcagatggttttgatatgggtgtcgggatgctgacgcgcattctgggccggaatgatactgaacgtcgcatcatgattaacagtatcgcaccacactgggacggtaaccaggtctggctgatcaccgcaggtggcgcgctgtttgccgcctggccgatggtttacgcggcagccttctctggcttctacgtagcgatgattctggtgctcgcgtcgctgtttcttccgtccggttggcttcgattaccgttcgaagattgaagacaatcgctggcgcggtgcctgggactgggggatttttattggcagcttcgtgccgccgctggtgattggcgtagcgtttggcaacctgttacagggcgtgccgttccatgccgatgagtatctgcgcctgttctataccggtaacttcttccagctgctgaatccgtttgggctgctggcgggtatggtcagtgtggcgatgattctggcgcagggtgcaacctatctgcagatgcgcactaccggcgaactgcatctgcgttcacgcaccgcagcacaacttgccgccctggtgatgatgatctgctttatcctggcgggcgtctgggtgaaatatggtatcgatggttatgtggtgaccagcaccatggatcacttcgctgcttctaacccactgggcaaaaccgtagtgcgcgaagcgggtgcctggatggtcaacttccagaaccaccctgtgctgtggctgttcccgctgctgggcgctgtgctgccgctgctgaccatactctgctcgcgggttgagaagggcgcctgggcgttcctgttctcctcactgacgctggcctgcgtcatcatgacagccggcattgcaatgttcccgttcatcatgccatccagcacggtgccgggtgtgagcctgaccatgtgggacgcaacgtccagcctgctgacgctgcaaaccatgaccgttgccgccgctatctttgtgccgatcattctggcctacaccacctggtgctactggaaaatgtttggtcgtatcaccaaagagcatattgaaagcaacagtcactcactctattaattaaggagacgtcgcatgtggtattttgcctggattctcggcacgttgctggcctgtgcctttggtatcgtgaccgcgctggcgattgagcacattgaagcgcaggatgagcctcactgatgcgaacgctaattcggatgctgtatgatctgatggataagggcccgttacgggccctttcactgctgctggcgctgctgaccgcaggcggcgtgatgtgggatccgacacgctttgccagtcaggcaggccagttaccggctctgcaggggctggtgctgatctgggcggtctgcagtggggtgatccacggtgtgggcttccggccacagcaaacccgatggcaggcgctgtttgccccgttacccgccatgctggtgctatttattgcgctttaccgtttttatctttaagaccccttctcatcggcgctgtcagtgaatttttgtcagcgtctggtcaattaatctccctgaaatcgttccgtttgttacggagcgataattattttcgcctggctctgacgagccattcccaaccccaattctcttgcgtatagtaacaacgtttaaaacgaggccgggatgtagagtgagtacaacgctgtttcgctggccggttcgggtctactacgaagatactgatgccggtggtgtggtttatcacgccagctatatcgctttttatgaacgagcacgtactgaaatgttgcgacagcaccatttcaatcagcagacgctgttagaacagcagatcgcttttgtggtacggcgtatatcggtggactatctggcggcggcgcgtcttgatgaccttctggagatccagagcgaggtcacatcaatgacacgggctaccatgacgttcactcagcgtatcgtgaatactgaaggcaaagtgctcaatgaggcagaagtcctgattgcctgcattaacccacatctaatgaagccgattgcgcttcccaagtctattgtcgcggagttcaagcagtgactgacatgaacattcttgatttgttcctgaaggcgagccttctggtcaaacttatcatgttgattttgatcggcttttctattgcctcctgggccatcattattcagcgcacacgtattctgaatgcggcgggaagagaagcggaggcgtttgaagacaaattctggtccggcatcgaactctcgcgtctctatcaggagagccaggagcgccgggaagaactgggcggttcggagcagattttctattccggctttaaagagtttgcccgcctgcatcgcgccaacagccatgcgccggaagcggtcattgatggtgcgagccgtgcgatgcgcatctcgatgaaccgtgagctggaagcgctggaaaaccacattccattcctcggcaccgtcggtttctatcagcccttatatcggactgttcggcaccgtctgggggatcatgcacgcctttatcgcactgggtgccgtgaagcaggcaaccctgcagatggttgcaccgggtatcgctgaagcgttgattgcgaccgctatcggtctgtttgccgcgattccggcggtgatggcgtacaaccgtctgaaccagcgcgtgaacaaactggagcagggctacgacaacttcatggaagagttcactgccattctgcatcgccaggctttctccagcgatagcgctaagtaaatagaggttaatgatggccagagtacgtggtcgcaaacgccgcgacctgaagtcggaaatcaacatcgttccgctactggacgtcctgttggtgctgttgctgatcttcatggcaacggcgcccattattacccagagcgtggaagtggatctgcctgatgcgaccgattcgaaaaccgttgccagcgatgataatccgccggtgattgtcgaagtggcgggcgtgggtcagtacagcctggtcgtggatcacgatcgtatggatcaacttccgccagagcaggtaatcagcgaagcgcagcgtcgactggaagcgaatcctaagacggtctttttgatcgggggcgcgaaagaggtgccttacgatgaaattattaaagcgctcaacctgctgcaccaggcgggtgttaaatctgtcggtttgatgacgcagccgatttaaaatcgaaccgttttttgggaaccgagtgtgtcgaaggcaaccgagcaaaacgagaagttaaagcgcgcgataatcatttcggtgattctgcatatcgtgctgatcgcgctgctgatttggagctcgtttaatgagcacattgacgccagcagtgcgggtggcggaggcagtgatattgatgcagtgatggtcgatcccggtgccgtcgtgagtcaatacaatcgtcagcagaaccagcaaagtgacagccagcgggctgagcagcagcgtaaaaagcaggcgcagcagcaggctgaagagctgcaacagaaacaggctgctgaacagcagcgtctgaaagcgctggaaaaagagcgtttagccgcgcaggaaaccgcgaaagaagaggcaaaacagcaggctgagcagcagaaggctgccgaagacgctgctaagcaggcgcaggagcagcaaaaaacggcggaagcggcggctgccaaagccaaagcggatgcaaaagctcaggcagatgcgcaggcaaaagccgcggctgagcaggcgaaacaggccgcagccgaagcaaagaagcaggctgatcagcaggcgaaagccgccgctgccgctgctgcaaaagagaaagccgttgcggaagcgaaggcgaaatctgaagcagatgcgaaagccgcagctgaagccaaagtgaaagcggcggcggatgccaaagccaaagcggctgaagaggctaaacaaaaagctgctgaagccaaagcaaaagccgcagaggcggcgaaagagaaagccgcagaagccgcaaaagagaaagcggaagcggctaaagaggccgccaaagagaaggcggaagctgccgcgaaagcgaaagccgatgccgcggcgaaagccaaagccgatgctgccgctaaggccaaagcggatgctaaagcgaaagccgccgccgatgctgccgctaaggccaaagcggatgctaaagcgaaagccgccgccgatgctgccaacgacagcgatgtcgatgatttgctgggtggactcgcttccggtaaaaatgcaccgaaaagcggcacctctggcggcgcagcagggcagggaaaccagaagaaagcgggtgcatcaggcgcggaaatcaactcttacatgggtcaggttgtgagtgcgattcagagccgattctatgatgcggatctgtatcgcggaaaaacctgtgatttgcggattaaacttgcgcctgatggcttgttgattgatgttaagtcagagggtggcgatcccgcgctctgtcaggccgcgattgctgccgcaaaacaggcacgtattccgaagccgccttcgcaggcggtctacgaagtgtttaaaaacgccccaatgcgttttaaaccgcaataatgcagtaacgggcggcaagttgatctatgtttagcgtgccgtacttaagttgtactcgtggtttccaggaaacagtgccaattatcgtggactgaggttcagataagggagataaaatgaagcaagctcttcgcgttacgttaggcttttttatcctgctgtgggcagccatgctgcatgcagaagttcgaattgagatcacccagggtgtcaacactgcgcgcccgattggcgtggtgccgtttaaatgggccggtgctggcgcagcgccggaagatatcggcggcatcgttgcagctgacctgcgcaacagtggcaaatttaatccactggatcgctcgcgtctgccacagcagcctgccagcgcgcaggaagttcagcctgccgcgtggagtgcactcggcattgatgccgtggtcgtcggtcaggtcgcgtctaacccggatggcagctatcaggtttcgtaccagctggtcgacactggcggtgctcccggtaccgtgctggcacaaaacagttataaagtgacgaagcagtggctgcgttatgccgctcacacggccagtgacgaaacgttcctgaagctgaccggcatcaagggcgctttccgtacccgtatcgcctatgtggtgcagaccaacggcggccagttcccgtatgagctgcgcgttgctgactacgatggttacaaccagtttgtcgtgcatcgttcaccacagccgctgatgtcgccagcctggtctccggatggcagcaaagttgcttacgtgacctttgaaagcggcaaatctgcgctggtggtacagacgctgtcgaacggtgctatccgtcagatcgcctcctatccacgtcacaacggtgccccagcgttctcgccggatggctctaaactggcgttcgcgctctctaaaaccggcagcctgaacctctatgtgatggatctggcctcaggtcagacgcgtcagattaccgatggtcgctataacagcaccgaaccaacctggttcccggacagccagacactggcttacacctccgatcaggctggtgctccacaaatctacaaagtcggacttaacggtggcgcgccacaacgtattacctgggaaggcggtcagaaccaggatgcggatgtcgcaacagatggtaagtctatggtgatgattagcaccaacggtggtgctcaacacgtcgccaaacaggatctggaaacgggagccgttcaaacgttaacggacacgttcctggatgaaacgccgagcctggcacccaatggcacaatggtaatctacagctctactcagggtatgggttccgtgttgcagttggtttctaccgacggccgtttcaaagcgcgtcttccggcaactgatggacaggtaaaatttcctgcctggtcgccgtatctgtaatgtctgacagttcagacatcacaaacaataaacaataatgggattttgaaatgcaactgaacaaagtgctgaagggtttgatgctggctctgccggttctggcagtagcggcttgtagctcacacaagaacaacaacaatgaccagactggcatgggtgctgatggcggcgcttacggtgcaaattctggcatgaacggcaacggcggcaacatgtcttctgacgagcaggctcgtctgcagatgcagcagctgcagcagaacaacatcgtgtacttcggcctggacaagtatgacgttcagtctgattacgcacagatgctggatcagcatgcaaccttcctgcgcagcaacccgtcatacaaagtgaccatcgaaggtcatgcggatgagcgcggtacgccggaatacaacatcgccctgggcgaaacgtcgtgctaacgcggttaaaatgtacctgcagggcaaaggcgtgtcggctgatcagatgtctatcgtatcttacggtaaagagaagccagctgttctgggtcatgacgaagcagcgtattctaaaaaccgtcgtgccgttctggtctactaagagaatcacatggttagtaacttcagacatcacctgttgagtctgtcgttactgattggcgtagcggccccctgggccgctaatgcccaagcgtcaatcagtagcgttggctccggctcggtcgaagaccgtgtcaccactcttgaacgaatttctaatgcccaggcacagctgatgcagcaattgcagcagcagatgagcgataaccagcgtgatatcgacgcgctgcgtgggcaaatccagcaaaacacgtatcagttgaatcaggtggttgagcggcagaagcagctttaccagcagattgacagcctgagcagcgccagcaccagcggcggtcagcaggcagccggcagcagtgccgcagcggataccggcgcagcagcaaccgcaggcggggcagcatcaacggatagcgcacctgcgcagaccggtgacgctaacagcgattacaatgcggctgtggcgctgattctggagaagaaacagtatgatcaggcgatcagcgcgctccaggcgtgggtaaaacgttacccgaattcgacctatcagccgaaacgccaattactggctgggacagctgaactataacaaaggcaaaaaggacgacgcggcttactattacgccacggtagtgaaaaactatccgaagtcgccaaaagctgcagaagcgttgttgaaagtgggcgtcatcatgcaggagaaaaaagacacagcgaaagctaaagcggtcttccagcaggtgatcaaactttatccagacaccgaatctgctaagcaggcgcaaaaacgcctgacaagtctgtaatctgtacggttcaggccagatatcgtgtgatttctggtcttgccgtatgaaaggtaagcaactgaagcatttagcagaaataagagttgcgctaccccgctaaatcagtaatatatgccgccgttgccgggacacattgcaaagtgtctggtaagcctgaagatgggtcgttagctcagttggtagagcagttgacttttaatcaattggtcgcaggttcgaatcctgcacgacccaccatcttcctcagacgcgcttttaccgcgcagttttaagaagaacacttcagcattgcttcacaacctaagatgggtcgttagctcagttggtagagcagttgacttttaatcaattggtcgcaggttcgaatcctgcacgacccaccatcttatctcagccgcctggcgtgttgaacggttgtaagcccccagcgggtcgttagctcagttggtagagcagttgacttttaatcaattggtcgcaggttcgaatcctgcacgacccaccaattaagaaaaaagcgccctcagggcgctttttttgtttctgtggcactactcactttgaagaagcaaaacacctcaagggcttgaggttgtcgctgcccgctgtttgatcgagcctgcgcagagaacagggtcagatcggaaagacgcaaaagccgtcatccctgacctgctcggcccgcgccgtccctggcgcaggacgctttcctcttctgaccctgttccctgcgcgttgagcttctgtattgctggcagattttccccccactctcgccgtcacgcctttttctttgcctttgccactgccaggctctcccagatatgcatcactgcatagctgcgccagggacgccatgactgcgatcgcgcctccgcttctttcgatgacatgccgcccaggttattccggatggcaatatcctctttgggaaaggcatccggccagcgcaaagcgcgcatcgcgatgtagtgcgcggtccagggaccaatacccggcaggctgaccagctttttgatgacctcgtctggcgcctgagcggcactaagacgcagatctccgctggcgcaggcatttgcaaaggcgatgatggcgcgggagcgggcggcactgacaatccccatcggcgcgacatcgtctaccgtcagtccggcgatgcgttcaggatgggcggtgtagcgggtcagatcggcgaaacggcgtctcacagggttcgccaaaggcggcggcaaaacggctgctgaccgtggtggccgctttgaccgtcacctgctggccgataatggcgcgcacgcccagctcaaaggcgtcgaatgcgccaggcacacgcagacccggatgcgagatcaggctgggtgccagcagtgggtcctgcgccagacaggcggcgatacgctgcggctgtgcgtcgagatcgaacagatcacgcagacggcgcagcagcagaggcagaaccggcgtcagcgaggttgagagcgtcacctgcagcgcgttcttttgcggcagatgcgaaacagagacccagccccggcagcggccgagcaccacggtgcgtcgccagcagccatcttccaccgcctcgacctctttcatcagatgcgtctgcaaaaaccagattatcgccgcccagtcatagggagggcgataggccagccgcagcgtcacgcggtcgccgggctgcgcgcattgagtgcccgtatcgtccctgcgcagcgcgcctggcgtcatgcggtaacgcgcctggaagacatcattaaagcgccgcaggctgccaaagccgctggcataggcaacgtcaataatcggcagccgggtttcggtcagcagctgtttagccagcagcatgcgccgcgtctgcttcagttccagcggcgagacacccagctcctgctgcacaatacggcgcagctgacgcaggctgataccgaattcagcggcaattgcctccagtccttcacgttcctccagcatgccttcctcgatacgctgaaccagccgctctgccacacgatgcggctgatcaaccggcgcattaccgggtgccagttcgggccgacagcgcaggcaggggcgaaagcgggctttctccgccgcttccgcgctgctgaagaaaaggcagttcttctgcatcggcgctttgaccgggcagaccggacgacaatagataccggttgaggtcacgccaacaaagaaaacgccgtcaaagcgggtatcacgagaggtcagcgcctgataggcaatgtcgggatcgagcatggcagttctccggtaaataagcgcagcctacaccggtgaatcccggcagactggctgttttcggaaagcacaacagtttatcgccatgaccgaaaacagccagtcaggctgatgaaaagtgcgataataggcgacagaaaccgtgacgggagaatcaccatgtactacttcaaaccgatagtcaccccggtgggtgaactgaaactggtcgccagcgatagcggcctggcgggtattttgtgggaaaacgacgatccaaaacgcacccggtttttgccgcaaacgcgcgatgacgatcatcccattctgatcgaaactgagcgtcagctcagcgagtacttcaccggtgctcgtcgctgctttgagctgccgctcgattttgtcggcactgagtttcagaaaaaagtctggcaggcgctggtggctatcccgtttggtgagacgcgcagctacagccagattgcgcgggagatcggccatccgctggcggtgcgtgccgtcggggcggccaatgggcgtaatccgctctcgattgtcgcaccgtgccaccgcgtgattggagccaacggcaagctgaccggctttgcgggcggactggatatcaaagcctttctgctggcactggaagcgccgcaaaaaccgctggtactggcagatgaaacgcagcccggcagggtcggcgctgtgatgcagacagaataaatatcgcacgacacagccaggcttttccgctatcgtgtttagcatataaaacacgatggcggattggacgccataagtcgccggaacaggcgattttcgttaattagacaaaacgagagctgtgtcatgagtgtgatgttcgatccagaaagcgccgtttatccctttccgcccaaacccgctcgcctgagtgacgacgagaaggcgttctaccgtgagaaaattaaagcgctgctgaaggcgcgaaacgcggtgatggtggcgcactactacaccgatccggaaattcaggcgctggcagaagagacgggcggctgcgtttcggactcgctggagatggcacgctttggcagcaaccattcggcgacgacactgctggtggccggcgtgcgctttatgggggaaaccgccaaaatcctcagcccggagaaaaccgtactgatgccgacgctgcaggcggagtgctcactggatctcggctgcccgattgaagagtttaacgccttttgcgacgcccatcccgatcgcactgtggtggtctacgccaatacctcggcggcggtaaaagcgcgggccgactgggtggtgacctcaagcattgcggtcgagctgattgagcacctcgacagtctgggcgaaaaaattatctgggcgccggatcgccatcttggccgctacgttacccaaaaatcgggtgcggacgtgctctgctggcagggcgcgtgcattgtgcacgacgagttcaaaacccaggcgctgcagcgtatgaaagcgctctatcccgacgcggcagtgctggtgcatcctgagtcaccgcaggcgattgtcgatctggccgatgcggtcggctcgaccagccagctgattcaggccgccaaatccctgccgcatccgcagatgattgtggcgaccgatcgcggcatcttctacaaaatgcagcaggcggtgccggataaagagctgcttgaagcgccgaccgccggtgaaggtgccacctgccgcagttgtgctcactgtccctggatggcgatgaacggccttaaagccatcgcagaggcgctggagtcgggtggggtggaacatgagattcaggtggatgagacgctgcgtgaggcggcgttactgccgcttaatcgcatgctatcctttgcagcggaacttaaactcaacgtgaagggaaacgcgtaagcgttttccggacaggtgctcagcatggatttcttcagcacacataatattctggttcacattcctctgggtgccggaggctacgatctctcatggattgaggctatcggcacgctggcgggcttactctgcatctggtttgccagcctggaaaaaatcatcaactatccctttggcctgattaacgttacgctgtttgcggtgattttctttcagatccagctctacgccagcctgctgctgcagctcttcttttttgccgccaatatctacggctggtacgcctggagtcggcaaacctccgatcatcaggcggcgctgaaaatccgctggctgccgctgcctaaggcgctggcctggacggcgggctgtgtgattgcgattgcgctgatgaccctctatatcgatcctgtgtttgcgctgttaacccgtgcggccgtcacgctgatgaacggcgttggcctgtcggtggcgatgcccgcgctgcagccggatgcgttcccgttctgggactcctgcatgatggtgttgtcgattgcggcgatggtgctgatgacgcgcaaatatgttgagaactggctgctgtgggtcatcatcaacgtgattagcgtgatgatttttgcccgtcagggcgtctatgcgatgtcgctggagtatgtgattctgacgctgattgcgctgaacggctcacgcatgtggatccgcagcgcgcggcaacagggttcccgcgcgctgtcggctcagtgagtgtgcacttcgcctttagcgtgagcatgctcatggtcgtgtgaatggctgtgatcatggccggtggcagcagcgccgcttaagccgagttcacactcggcaccggcacagggctgatactccatctgcacggtcgcatgcgcaatctgatagtgctggcgcagatagtcgtggatacgatgcagcagcgcatcgtgatcgtaaggcgggatcacctgcgcatgcagcgtcagcatcggcttttcgcccacctgccacagatgcacatggtgaacattgcgcacctctgcgatgttcagggtgagatcacgtatcagccggttcacatccagcgaacgcggcgccccttccagtaactcctgcagactctcacgcagcagcgcccaggcgctgcgcagcaccagcagtgacaccagcaacgacagaatcggatcgattggggtccagccggtcagcataataatcaccgccgcgacaatcgcacccaccgagccaagcaggtcgcccatcacatgcagcgccgcggcccgcacattgagattcttctcttcgctgccgtgatgcagcagccagaacgacagaatattggccagcaggccgccaatagcaatccccagcatcaggccgccggtcaccggttgcgggtcggcaaagcggcgcaccgcctcccagacgatcagtgcggtaatgcccagcagcgcaatggcgttaacaaatgcggccagcgtggtcagacgcagcaggccaaaggtgtggcgtgcattgggtttacggcgcgagaactgcaccgccagcagcgccatcagcagcgcggcggcatcggtcagcatatgcccggcgtccgccagcaacgccagtgaacccgagagccagccgccaatcacttcagccaccataaagacaacggtcaccccgaaggcggccgccagacgcgtgcgattactatcctgcccgctatgagtgtgggtatgtgccataagattccagttttttcagtaacctgtttgctaataatatcagtaattgccacgtctcagacgtgtcctgatgctgttttgcctgctccgccagttgctggctgagctgtgcgccgtgctccagtcccaccagtaaccagcttcctttcatccggtgtgccgcttcggcgaacggcatccacgcctcgcgctcgcgtgcttcgcgcatcacggccagatcctgtgtcaccgtgctgtgcagcgtctggctcagacggcggaggaatttctcattctgctgtgccagttgccacagattgtcatccagcgccgccagcggatcttcctgccactctgccagcagcgcgctgagatcggctaactgcaccggttttatcattacccgctcccgcgcctccagcggtcgtgacagcagctgggcatccgcggagcagagcacccgcatcgcctgacgcttccgctgacggtcacgccgccgcaatatccgcagcagcagcgtgccgtcaggccgcggcatcatctggtcgataaacagcaggtcataaggctgttgcgcatcggcctgcagtagtgcgcgtccctgctcaaagatgtcagcctgaatcgcaaaacgcgacagctgctgctgcatcaccagcagattggtcggatggtcatcgacaatcgccacccgcagcggtggaaggtcgggaagggcggtttcatccacgtggtttgctggtgcgcagaccgccagtggcagcgtcacggtgacctgggtgccgtgaccgggttcagaggcgagccggatgtcgccgcccatccgctgcaccatttcccggcagataaacagccccaggccgctgccctgcaccgaaaccgatttaccggacggcgcctgataccagggatcgaacagcttctgctgctcctctggcggaatgccgctgccgctgtcgctcaccgtcagaatcagctgttgttgctgtgcggccagcgtcaggcgaatcgcgccgtggcgggtaaatttcagcgcattggtcatcaggttgttgaccacctgctgcaggcgatcggcatcgatcatcacggcatcaggcagcggcgtcagtgcctcgacgatcagatgcgggccgtcttcgcgcattaacggatgataaaagtgctgctgctgattgagccactgcgccagcgccagcggacggggcgccagggtaaaactgttgctctcgatgcgcgcatgatcctgcagatcattcagcaacgtcagcagcgattgcgcactgctgtgcagcagcgtcaggttctggctgctgtgctgctgcttctccagctccagcagtcccaggatcgcctgcatcggcgtgcgcagctcatggctgacggtcgccaggaactggctcttcatcgcattggcgtgctcagcctgttcacgctgctgacgctcccggcgctgttgccagtagcggcgcgccagcagcagcagcagcagcgcaatggccgcacctgccaccgccagcaccatcatcggcagcgaacgcatcaccatcacgctgccgggctgtggcggggttgaccagctgtcgcgcatctgactctgtgtgtcagccgggatctgctgcagcgcgcgatccagcagggtgcgcagcaccggctggtcagccgtcacgcccagcgcgatcggccaggcgatgtcgctggcggcaaaggcgaggtggatgcgcgcatcatcgcggctggcgatacgccagcgggcggagagcacgttatcgaccagcgcatcgatctgcccttttgccagcgcgtcatagaggctattacgatcggcaaactgctgcggctgcagatcctcaggcagcagacgcagcgccaggtcatcctgcaacacgccgacccgcttgccgcgcagatcgcgccagtgcgccagcgtatcgggctggagggtgtagatgccccacagcgcgcgccacaccggcagcgaggtgctctgcatcgcatcgccgttcagcggctgcatcagctgcagcatcgcctgctgctgaccgatcagcgtgttcgcctgacgcggattgctgacccacaccggttcaaactgcaggccggtgctctgagctatcgctttcagcaaatccacgccatagcctctggcggtcccgctggcatcgcgataactccagggatagttgtccggttcggcggtgtaagtaatacgcggatgatcggcaatccaggcgcgctcagtggggctgagcatcagggtctgcgtatcctggtagcgcggcagggtactgctccagcgcgcctgcagcgtgttcatcagttctgctggcaactgacgcaggctctgattaatccagctgataagctccggatcgcgggagaccgcgcgcaggttgagctgtccggcctcgatgtgtgaggcgatctgataaatctggccctgttgcagctggctcagcagaaatccggcgctggtctcatccgccaccacataatcattctgctgattcagcagggtatagagcgcctgcagatcactgctgtagcgtcgccagctgtggcgggccgccagcgcaggcggcagttgtgccagcgtgctttcgctgatcgccagttgggcattctggctgttaaacatcacggcacgctggttttgctgattgcggtagacccgaagcgggctgctgtaccagttatcgctgctcagcgcgccggctggcaggggagaaatccacatgccaagcgcaaaatcgatctggccgctgttcagcgcctgcatcagatgcggctgatcgctgtagaggttgaggctgaactgcgcgccagtcagctggcgcagtgcggaaagatagtcagcattgatgccatacaggtcgttgccgatgcgcatcgcccagggggcgtggttctcttccagcaggccaacacgcagaattttgccctgcatggtttccgcgtgtgtcaccggcagcatcatcggcagattgatgctgctcaccggacgcacctcagccagaacggagccgcacagcaacagcagcatcagcaggagagttctcactgctgcgccttccacaggtcagccagttccaccaccgaacgggcgccggttttttccagaatgttctttttatgggtgctgaccgttttattactgatgtgcagctgggcggcgatttgcagattggacaggccgctggccagcagcgccagaatctgacgctctttctgggtcagcgggagttccggctcatcatccatcaccggaaacgccgtctgaccgcccagcaccgccaggatagcgctaagcagttgcgccatgcgctggctcttcaccacataaccggcggcacccagcgcctgggcacgacgcacatagtggcgggtctgctgagcagagtagatcaataccggacagtcggggcgatggatcttcaggcgacgcaggaactccagcccatcgctatccggcaggccaatatccagcacgatgatgtccagtggctgctgaagcaggggacgggcggctttttcactgctggcagagaggagctgaaccggaatgggcgactggctcagagcggcttcaagtgccacttcaaccagcggatgatcgtcaatcagaagcaaaacggccatgaaggatttcctgtaaaattcacaggattagcatagcggaagagtgggacagaggggagaaaaaccaggagagcgtcagctctcctggctaaacagaattactgggtggtgccgtcggttttggtatctacgtcaccgccgcccactttagtctgaacttttttattgatgttcggacatttaccatctttacactgggcgttctggtccatttcgttagcagacatattaccatggctggtggtgctgccagacgttgcaggattggtatcgttgccagtgttattaattttgctgttatcgacattatttggcggcagattctctttcgctccgcccgctgctgcacctgcactggctgcctgattcgatgtaccgttattgctgctgctgtctgcagccagtaccgcaccgctgctcagtgtcattgctgctgtcaaaaagagtaaggcaaactttttcatcattatgctcccgttaataaatgaagatgctttaagcccagaggtgcaatttcgggtaagaaaatccctgacgaaatataattcgccggttggcttaaacagggtgatttaatttggtaagcgggacgttcctcagtgcttaccattaaaaagtctagtcgctaacctgattaatgcaaatatcacccgcacatttaacccgcagcgggaatttacaccccaggcgcttcgggctacattgggcaggttgtgtccggcgggcgccgggccagaaataatatggaatcagtatgaattaccagaacgatgatttacgcatcaaagagattaaagagctgttacctccggttgcgctgctcgaaaaattcccggcgaccgatcgtgctgcacagaccgtttcacaggcccgtcaggcgattcatcagatcctgcagggcaaggacgatcgcctgctggtggtgattggaccctgctcaattcatgacactgaagcggcaaaagagtatgccgaccgcctgctggcgctgcgtgatgagctgaaaggtgagctggaagtggtgatgcgggtctattttgaaaagccgcgcaccacggtgggctggaaagggctgatcaacgatccctacatggataacagctaccagctcaacgacggtctgcgtctggcgcgtaaactgctgctggatattaacgacagcggcttaccggcggcgggcgagtttctggatatgattaccccgcaatatgtggctgacctgatgagctggggcgcgattggcgcgcgcaccacggaatctcaggtacaccgtgagctggcgtccggtctctcctgtccggtcggcttcaaaaacggcaccgatggcaccattaaggtggcgatcgatgccattaacgcggcgggatcgccgcactgtttcctgtctgtgacgaagtatggtcactccgccattgtggaaaccagcggcaatggtgactgccatatcattctgcgcggcggcaaagagccgaactacagtgcgcagcatgttgcagaggtcaaagagggcctggcaaaagcgggtctgccacagcaggtgatgatcgatttcagccacgccaacagcagcaagcagttccagcgtcagatggttgtggcagacgatgtctcacagcagctgattaatggtgagcaggcgattgtcggtgtgatgatcgagagtcatctggtggaaggcaaccagagtctggagagcggcgagccgctggtctatggcaaaagcgtcaccgacgcctgtatcggctgggaagataccgacaaggtgctgcgtcagctggcggcagcggttaaacagcgccgcggccgagtgggataactgacaaggtctgacccggttcgcgttgaggattgtgcctctgaccgtattccctgcgatttgagccaatcagttgttgccaggctcattgatctctttattctgacaacgaacacagtgcgcagcgtccgtgcgcgcagcccaataaaaaaggccagactttcgtctggcctttttgcatttcagcgagaaattacttcgctttaccctgattcgcaacggctgcagctttcgcggcaatctcgtcctggtcgcccaggtagtagcgtttcagcggtttgaagttttcatcgaactcatagaccagcggtacgccggtagggatgttcagttcgaggatttcatcttcgctcaggttatccagatatttcaccagcgcacgcagtgagttgccgtgtgcggcaatgatcactttctcaccgcttttgatgcgcggcagaatggtgtcgttccagtaagggataacgcggtcgatggtcagcgccaggctttcggtggttggcagctgctctggggtcagtttcgcgtaacgcggatcatggcccgggaagcgctcatctgaacgatccagctctggcggagtaacggcaaagccgcgacgccactgcttaacctgctcatcaccatatttggcagcggtttccgctttatccagaccctgcagcgcaccgtagtgacgctcgttcagacgccaggttttctcaaccggcagccaggcctgatccagctcatccagcacattccacagcgtgtgaatggcacgcttcagtactgaggtgtaagcgaaatcgaaaacaaagccctcttttttcagcagctgacctgctgatttggcttcgccacgacctttctcagaaaggtcaacatcataccaaccggtaaagcggttttcgttgttccactggctttcgccgtgtcgcaccagaaccagcttagttacagccatagcttaactccttaatactgtgatgtttctgtgagattggaaacctgctgctgcccgcctgacacgcgagctgattgcgccataccataacggaaaagcgggcagcgcgtaagcctgtgtgtgacgcactgcgcgtttttcagccggaggctcagcgtggcgtgaagcgataacgcgtcacggattcccagcgatctcccggctgcagccagcaatcaggctgaggccattcatcatgattaggcgaatccggtaaaaattcgctctccagcgcaataccctgaaatgcagtatagctcgcctgctcacgggcacgggtgcccgccaggtagttgccggagtagaactgcaacgccggtgccgaagtggtcacgctgagctgcagtctgccatcttccgaccagagtttctgccgcaggctgagtgtcgtcgcctgcgctgttgagcagaaacgcatggtcatagcccttcaccgctcgctgatcgtcgtctgccagaaactcctgtgccacgactttggcctcgcggaaatcaaaactggttccggcaacctctttcagcggcgcattcgggatgccttcgctgtcgaccggcagataatggtcggcgtgcagttgtaagcgatgctggcgggcgtcgccatgatgcgcatcaaggttaaagtaggcgtggttagtcagattgaccgggcagggctgatcgcagcgcgcttcatagctaatgctcaggcagttctggtcatccagctgatagcgcagatcggcaatcagattgccgggatagccctgatcgccatcggacgaatcaatgcggtagtgcacctcgctgtcagactggctgacaatctgccagcggcgcttatcaaagccttccggtccgccatgcagctgatgtgcgccctggttcggcaccagctggcggttcagtttattcagttttgccccggcgatgcggttagcgtagcggccgaccgtcgcgcccagataggcatcctgatggagatagtcagagggcgtggcgcagccgagcagcgcttcacgcaccgtgccatcctgcatcggcacgcgggcggagagccaggttgcgccccagtccataaaggtggctagcatgccgttggcattgcgcagcaccgttatgcgccacggctgaccgtcgggcgcgtgggagttgacgtcgttcagcattggccggctccttcagaggctttgcagacgtagaaggtctctttgatgccggtcgctgcttcatactgctgcgctacggcggctttgacctgatcgaccagatccagtggcatcagcgcgacgatacagccaccaaagccgccgccggtcatacgcacgccgccgcgctcaccgatctgcgctttcacgatctctaccagggtatcgatcggtggcacggtgatctcgaagtcgtcacgcatcgaggcgtgagattcggccatcagctggcccatacgggtcaggtcgccctgcgtcagcgcatcggctgcttccagggtacgggcgttctcggtcaggacgtgacgcacgcgttttgccacctgcgggtcgagctgcgcctgtgccgcttcaaactcggccagttcaacgtcacgcagcgccttcttattgaagaaacgcgcgcccgcttcacactgctcacgacgcgtgttgtattcgctgccaaccagggtacgacggaagttggagttgatgatcaccaccgcgatatcttccggcatcgacaccggacgcgtgcccagcgtgcggcagtcgagcagcatggcgtgatctttccggcccagcgctgagatcagctggtccatgatgccgcagttacagccgacgaactggttttccgcttcctgaccattcacggcaatggcggcgccatccagcggcagattatagagttgcaccaccacggtgccgaccgccacttccagcgacgcagatgagctgaggcccgcgccctgaggcacgttgccgctgatcaccatatcgataccgccgaaatcggcatgtcgctgctgcagatgtttcaccacgccgcgcacatagttggcccacatcggttcctgcaggctgacgatctcttcatcgagagagaatgtgtcctgcgcattttcataatccgccgcgaccacccgaatctggcgatcgtcacggcgggcacaggcaatcaccgtctggtaatcgatggcgcacggcagcacgaagccgtcgttatagtcggtatgctcgccaatcaggttaacgcggcccggtgcctgaatggtatgcgtagcggcgtaaccgaaggtgtcagagaaaagctgctgcgtgatggtttttaagctcattgttgtgcctcacggaagtgaacgtcgctgacagaaacgcagacgttccgccgcctgttccgccgttaaatcgcgttgggtttcggccagcatttcatagccaaccataaatttacgcaccgttgctgagcgcagcagcggcggatagaagtgagcatgcaactgccagtgatcgttggcttcgtcgttaaacggcgcgccgtgccagcccatggagtaggggaatgagcactggaacaggttgtcgtagcggctggtcagcagcttaagcgccagcgccaggtcagtacgctgcgcctcattgaggtcggtaattcgtttgacgtgcgctttcggcagcagcagggtttcaaacggccaggcggcccaccacggcaccaccgccagccagtgatcggtttccaccacggtgcggctgccatcctgctgttcacgtgccagataatcgaccagcatcggcgagccatgtttagcgaaatagtcgcgctgatgatcatcttcacgctgcgcttcattcggcaggaagctgttggcccagatctgaccatgcggatgcgggttggagcagcccatcgccgcgcctttgttctcaaacacctgcacccagggatagtgctgacccagatcggcggtctctgcctgccaggtacgcaccacctcttccagtgcgttcagcgacatctccggcagggttttgctgtgatcgggcgagaagcagatgacccgactggtgccgcgtgcgctttcacaacgcatcaggatatcgtcgctctcgggcgcgtctggcgtgtcggtcatcagcgcagcaaagtcattggtaaaaacgtaggtgcccgaatagtccgggtttttgtcgccggtgatgcgggtgtttccggcacacaggaagcagtccggatcgtgcgccggtaacgtattgaccgccggggtttcctgcgcgccttgccacggacgtttggcccgatgaggtgaaactaaaatccattgatcaatcagtggattgtaacggcgatgcgggtgatcgaccgggttgaatttttccatgttagatcctggtaagcgtcaaaagccaaagaggcatcggtaaaaagtagcacatcagcgcgcccgaaagcgtgatcaagtctggataaatggtatcgtttacacaagctgaatattcttatttcgtggcaatgtgcgcggatatatgacgtgaaaggtgatgtggaatggtagcgcttacacaagagcgctttaaaacgccgcagcagcggcgtggggtgaagcgttacatgagccctagtgcagggtttcctgctgaaagtgatagccgccgtcatgggcgataaagctcaggcgatgtgtaatgcaggcgggcgcatcttccgcgtgatgcgaaacaaacagcagctgagtccgtccctcgccaatcagcacatcgacaaagcgccgcacgagctggcggttaatcgggtcgagcccctgtagtggctcatccagtatcagcagcgtcggatgcttaaccagcgcgcgggcaatcagcaccagccgctgctgtccccatgagagcgagtggaacggcgcatcggcctgtccgttatccatccccagcagtgccagccactgctgcgccagcgatttttgccggtcagaagccgcctgatagagaccaatggagtcgaagaagcccgacaggatcaccgtgcgcacattggtgctgacgcggtaatcgagatgcaggctgctgctgacatagccaatatgctgcttgatatcccagatggtttcaccactgccgcgacggcggccaaacagggttaaatcattgctgtagccctgaggatgatcgccggtcaccaggctgagcagggtcgatttccctgcgccgttcgggccggtaatctgccagtgctcgccggcgttgacctgccagtttcagcccctgaattactggcttatcgttatacgagacggtgccgttgcgcaggataacgcgcggcgcatcatccgccagcgatggcagctgatccggcgcatccgcctcaggtaacgccattcccatcagctgttcactgtgtgccagctgcgccaccagcgcttccgttaaaatggcctggcgtggcccgctgtgggtgagggtgcactccgccagcacgccaacctgctgaatgaaatcgggaatatcgtcaaagcgattgagcaccagcaccagggtaaatgtcggttgctgcaggccgcgcagcgtgtcggtcaggctggcgcgcgacgccacatccagcccgtcaaacggctcatccagaatcagcaaatctggctggttcatcaatgcctgacagagcagggttttgcgggtttcgccggtagagagatatttgaagcggcgtgaaagcagcgcttcgatgccgaactgctgtgccagctgctcgcagcgctcgggctgctgcacctccgcctgaatcacctctgccacggtcagcccggtatcctcttcaccttcgctgagcatatcggtgttgttgcgctgccactcctgcgccaccagggtttgtagctgctccagcgacagccggaccggccgtctgaaatcgctgctgactgaaccggccagcggcggaagttcaccagagagtgcgcgcgccagtgatgatttgccgctgccgttggctccgacaaacgcccagctttcgccgcgctgcagttccacctgattcagactcagtatccgggtatcgctaagacgaaacgtgccttgcgaaatgtgcaatgaagccatgatctgttccattttttgcatcgtgtcactgagttgtaaccattgcccttaatgaagtcaaatcaaccgctagagcagggtggcgacgatggcgtgttcggcattgaaactggcgatcacggcgtcgccgggctgcagcctgagttgctgcagctgatcgttgctcagggtcgcgcacagggtttcgccgctggcgagcttcatcagcacttcactcatctgctcgccgggtttcgatggcactgaccgtcgctgccagctgattgtcatcctgtgcggcgtcacgactgatgcggatccacggcgccttgatcagcaccagcacctctttacctgcggccagttgcaggcgatcggcgctgcgctgggtcagcgccacattaagctgcgtgacgccatcggccagttgaatcagcagatgctggaccacctgctgcgcatcgttactgacgacggtgccaaacagctggttacgggcgctggtctgcagcgagaaacgggcgatggccgccagcagactgtcgagcggtaacgtatcctgctgcagcgcatcaaaggctttctgctggatctgctccatcagctggaacagctgaatcaggcgttcaccgtagcgggtcagcgttgcaccgccgccgcctttgccaccggtggcccgctccaccagcgtttcatccgccatctggttcatctcattaatcgcatcccaggcacttttgtagctgataccggccagcttcgccccctgactgatcgacccggtctgctgtacgcgtttcagcagctcaatacgtcgcggatcggcaaacagtttctgttgtaaacggatatgaagggacagttcggcttccatgacagctccggcaaagggttaaggcgaaggccgatgatagcggcgttttgtgaccaaagtaaaagcacgaaaagggctgcgcaaaattttgctgacccgttacaatctcttttttgttagcagagtgagactctccatgctggaattacttaaaagcctcgccgttgccatactgatggtgcctgtcgtgatggcgctgatgctgggcatgatttatggcctgggtgaagtgtttaacgtcatctctaaaattggtcatcgcgaaaaatcctcagcccgttcgcacaattaattgcagccacgcccgccatctgcgcgggcgtggtcgtttttatctctcctgatttaaccttttgttccccctgccgataatttactgaacctcactgacattgcgctatattatccgctacacaacgaatagccggagaaaatcatgtcatttaaacactatcgctggggcgtcgcggccctgatcaccgtttcgctggccgggcaggctgtggccgccgacaacatcactgtgtttgccgcggcttcactgaccaacgcgatgcaggatattgccagccgttacaagcaggaaaagggggtgacggtggtctcttcgtttgcctcctcttcaacgctggcgcgccagattgagcagggtgctcctgccgatctctttatctctgccgatcagcagtggatggatgatgcggtggcgaaaaaaagtgtgattaccagtagccgctataccctgctgggcaacgatctggtattgattgcgccacgcagtgccgccgcgaaagcggtgacgctggacccgcagactgactggaaaaccttgctgcacggtgagcgtctggcagtcggcgatccggaccacgtttcctgcgggcatctacgccaaagaggcgctgcaaaagctgggtgcctgggaaggcgttgcgccttcgttagcgccagccaataatgtgcgggcagcgctggcgctggtcgagcgtaatgaaacgccctatggcattgtctacgggtctgacgcggtcgccagcgataaagtgcaggtcgtcgggcattttccggcaaccagccataaacccgtagaatatccgatggcgatcgtgaacgatcacgacaacgccgccgttaaagcgttttatgattatctgaaagggccccaggccgcggctatctttaaacattacggattcacaccgacgaaatgatactcagcgatcccgaatggcaggcggtactgcttagccttaaagtctctggcatagccgtgataggcagtctgccgtttggcatcctgatggcctggattctggtgcgctgccgttttcctggtaaagcgctgctcgacagcctgatccatctgccgctggtgctgccgccggtggtggtgggttatctgctgctgattagccttgggcggcgcggcatcataggcgaaaagctttatgactggtttggcttcagctttgctttcagctggcgcggtgccgcactggcctctgccgtgatcgcctttccgttgatggtgcgtgccatccggctggcgctggaggcggtggatagccggctggagcaggcggcgcgcacgctgggcgccggacgctggcgggtctttttcaccattacgctcccgctgacgttgccgggcgtgatcgttggaacggtgctggcgtttgcccgatcgctgggcgagttcggcgccaccatcacctttgtttccaatattcccggcgagacgcgcacgctgccgctggcgatgtttaccctgatagagacaccgggtgcggaaggggcggcggcacggctctgcgtcatcgcgatcgtgctggccctggcgtcactgctggcgtcggaatggctggcacgtgcaggccgtaagcggatgggaaactgatgctatcactcaacattatgcagcagcagggcgatcacgtgctggaggtcgacctgcagatcccggccaaagggatcaccgctattttcggcgtgtcaggtgccggaaaaacctccctgatcaacgcgatcagcgggctgacccagccgcagcggggacggatccagctgcacgatcgtctgctgtttgatgcagagcagaagattgcgctgccgccggaaaaacggcgtatcggttatgtattccaggatgcgcgactgttcccgcactatcgggtccgtggcaacctgcaatatggtatggcacctaagatgaaagcgcagttcgacagtctggtctctctgctggggttggaggcgctgctgccgcgctttccgctgtcgctgtcgggcggggaaaagcagcgggtcgcgattggccgtgcgctgctgaccgcaccggatatgctgctgctggatgagccgctggcgtcactggatctgccacgcaaacgtgaactgatgccctatctgcaaaagctggcgaagcaggtcgatattccgatgctctacgtttcgcacagtctggaggagatcctgcagctggctgataacgtgctggtgctggatgcgggcaaggtcaaagcctttggtccgctggagcgggtctggagcagcagcgcgatgcggccctggctgccggtgagtgaactgaccagcgtgctgcgggtgcaggtgctggaacagcatcccgactatccgatgaccgcgctgtcgctgggcgatcagcacatctgggtcagccgggtgaatcagccggttaaaaccccgctgcgtattcgcattgcctcggccgatgtctcgctggcgctgcaaccgccgcaacacagctccatccgcaacattttaccggcacaggtggtggaattgctggaggtcggggaccaggttgaggtgaagctgcgcatcggcatcagcgaaactctgggcgcgcattacgccgtgggcgcgggatgagctgggcatccggccagatcagtggctttatgcccagatcaaaagcgtctcggtgacgccctgattacaacacgtactgatagagggtatcggcaataccggtttcaaggttggtgccgatcaccattttcgcccgcgctttaatcgcctcatcggcattacccatcgccacgcccagtccggccgtttccagcatgctgagatcgttatagttatcaccgaacgcgatcacatcggacatactcagccccagtgattcaacccactgcgccagtcgtttgcctttgctgttgccgcctttggcgatatccacctgatcgtgccacgaccattcgcaggccagtcccagttccgcttccaccctggtggcgaactgctgcagttccgggatgttgttgtgcgacagggcaaacttccagatcgaaccggcgtcgcgtgccgcctgggccaggtcgggcacctggcggaacagtggacgctggtgggcaggcagcgattcggcccacttcagggtgcgcatcacgtggccggtcggggtctgatagagcatcgcatcatccacgtagagcaacccgtgaatctgctgctgattcagcatctcaattacctgcaacgccagttgcgggtcgaggggatcggacgccagcacctttttcgcctggtaatcatacaaataggtgccattacagcagattgcgggtgtatccagctgtaacgcctgataaaaagggtggatagcgcagtgatggcgtccggtcacgatagcgacatgaacgcccgcctggcgtgcctgatttagcgcttcgattgactgcggcagaatcgttttggctggggtcagcagcgtgccgtcgaggtcgagggcaattacacggtagctcattaatcctctcgtttttcctggtttgcaggggctgaagtctacacctcaccacggtccggagacaaaaaacagggcacaaatgatcccagcgtagggcaataaaacaggctacagtgattcacagatcatgatcaggcagcaaaaaaggagaatgcatgaaacaagttgtctacaccgccagtcccgagagccagcagatccacgtctggcagatgaatgatgagggcgggctgacgttgcttcaggtgaccgatgtcgccggccaggttcagccgatggtggtgagtccgaaccgcgattttctctatgtcggtgtgcgtcctaatttccgcgtgctggcgtttcgcattgccgccgatggcacgctgaccgaagcgggtcaggcgcctttgcccggcagcccgactcacatttccaccgatcgccagggcaggttcctgttctgcggctcctacaatgatgcctgcgtcagcgtcagcccgattggcgatgacggcattccgcaggccccgctgcaggtgatcagcggactggatggctgtcactcggccaacatcgataatgacaacaagacgctctacgtgccggctctgaagcaggaccgtatctgtctgtttaagctgggcgaagacggtcagctgacgccgcgtaaacagacgcaggtcacgacagtagaaggcgctggcccgcgtcatatgcagttccatccgggcggccagtatgcttactgcgtgaatgagctcgacagcacggttgaggtgtgggcattaaatacgggcgaaggcgaagcagaaagcgtgcagacgctggatatgatgccgcctgacttcagcggtacgcgctgggcagccgatattcatctgacgccggatggccgtttcctctatgcctgcgatcgcaccagcagcacgctggcagtcttcagcgtcagcgacctgggcgatgagctgaccctggaagggttccagccgacggaaacgcagccgcgcggatttaatatcgatcacagcggacgctatctggtggcggcgggacagaaatctcatcacatcgaagtttatgcgattaccgaaccgaaagggctgctaaagccgctgggacgttatgcggtggggcagggcccgatgtgggttgtgattcatcagttacaggcgtaacccgctacgaaaaacgcctctcctgctcaggagaggcgtgctgaattactgataattcacggtcagcgaggcgctcgccagtgcgtggaaatgcacattaaagccgaccattgcgccactggcgccttcatctacttcaatcgtctccacatccagcgcatgcacggtgaaaatgtagcgatgggtttcgccctgtggcggcgccgcgccaccgtagcccgcctgaccaaaatcggtacgggtctggattgcgcctgctggcagtgatgctttgccggaaccggcaccctgcggcagtgacgtcgagctggccggaatattcgctaccacccagtgccaccagccggaaccggtcggggcatcaggatcgtagcaggtcaccacaaaacttttggtaccctctggtgccgcttcccaggcaaggtggggagagatgttctcgccctgataacccatgccgttgaaaacatgcttttcaggcatcttctcgccgtcattaaaatcctgactaaaaacgcgcatcacatctccttaattgtcgatgaatagcctgtcatcataaccaaaagtgccgtcagtgccagcggtcagcccgcttcaggcggcaaaatgttgagaatgctccagcgcgccgccaatcgcctgcaccagcctgctcagcgcctgcggcgtgatgatgtagggtggcatcaggtagatcagccggccaaaaggccggatccagacgccctgttcaacaaagaactgctgcagcgccgccatattaaccgcctgatgggtttccactacgccaatcgcgcccagcacgcgcacatcggccacctgcggtgaactgcgcagcggcagcagctcagcccgtaactgctgttcgatcgccgtcacctggcgctgccagtgaccttccgccagcatggtcaggctctccgccgcgaccgcgcaggccagcggattgcccataaaggtcgggccatgcataaagcagcccgccgcgctgcggctgatggtgtccgcgacctcgcggctggtcagggtcgccgccagcgtcatcatgccaccggtcagtgctttgccgacgcagagaatatccggggtaatgcccgcatgctcgcaggcaaaaagtttgccggtacggccaaatccggtggcgatctcatccgcaatcaacagcacgccatagcgatcacaggcttcccgtacctgctgcagatagcgcggatggtagaaacgcatgccgcccgcaccctgcacaatcggctccagaatgacggctgccagttgccggtgatgctgttctatcagcctggcgaaatcatcgaaatcaggcttgtgccatttatcatcaaagccgcaggccggggccgccgcaaagtgatgctcgggcagatagccgcgccacaggctgtgcatcgagttctcggggtcgcacaccgacatcgctgcaaaggtatcgccgtgatagccgcgtttcagcgtcaggaactgctgacgcgtctcgccacgccccagccagtactgcagcgccatcttcatcgacacttccaccgccaccgagcctgaatcggccaggaagacgcactccagcgcctcaggcgtcatcgccaccagctgacggcagagcgccaccgccgccggatgggtaatgccgccaaacatcacgtgcgacatctgggtgacctgctctgtcagcgcccggttcaggcgcggatggttgtaaccgtggatcgccgcccaccacgaggacatcccatccaccagctcacggccatcggccagttgcagctgaaaaccctgtgcggcgaccaccgggtagcagggcagcggatcctgcatggaggtatagggatgccagatatgctggcggtcaaagcgggcatcgtctgaggagaaaacggggatagtcatcggagttgtaaaccaaaataaaaaaatatagtttacaagtataaccctgcttttcgtcgggatgacaccctttttggagtaagtaatggctcaacgctggacaattgcacaggcgcaagcgctgtttgatcaaccttttcttgaactgatgtttaaagcgcagcaggtgcatcggcagcacttcgatccgcgccaggtgcaggtcagtaccctgctgtcgattaaaaccggtgcctgtccggaagattgtaaatactgcccgcagagcgcgcgctacaagaccggcctggagtcggagcggctgatggaagtggaagaggtgctgacctcagcgcgtcaggccaaagccgccggttcaacccgtttctgcatgggtgccgcgtggaaaaatccgcacgagcgcgatatgccctatctggagaagatggtggaaggcgtgaaggcgatgggaatggaaacctgcatgacgctgggcacgctcagcgagcaccaggcgcagcaactggcgggcgcggggctcgatttctacaaccataacctcgacacctcaccggaattctacggctccatcatcaccacccgcagctatcaggaacgtctggatacgctgggcaaagtgcgcgacgccggcatcaaagtctgttcgggtggcattgtcggcctgggcgaaaccgttaacgaccgcgccggtctgctggtgcagttagccaacctgccaacgccgccggagagtgtaccgatcaatatgctggtgaaggtcaaaggcacgccgttggcggataacgatgatgtggaaccgttcgattttatccgcaccatcgcggtggcgcgcatcatgatgccgacctcgcatgtgcgcctctcagcgggccgtgagcagatgagcgagcagacccaggcgatgtgctttatggccggggcgaactcgattttctacggctgcaaactgctgaccacgccgaatccggaagaggacaaagaccgcgtgctgttccgcaaactgggtcttaacccggagcatactcacactcagcacggcgatcagcagcaggagcagcaactcagcgagcagctattccatgccgacactgaacagttctacaacgcggcgctgtaatgggctggcagcaacgtatccgtcaggcgctgacgcagcgccgggcggccgatggctggcggcagcgacgggtgatcgatcagcaatcgacccgcacgctgcacagcggcggccgcagctatctccacttttccagcaatgattatctcggcttaacccagcatccggcggtgattgcgggctggcaacagggcgcggcgcaggcgggcgcaggtgccggtgcttcagggcatgtcacgggttatcaccgtcagcacgccgatcttgaggcgcagctggccgactggctcggctacgaccgtgcgctgctgtttatctctggctttgcggccaatcaggcggtcattcatctgctgggcgagaaaaacgatcgcatcctggccgataaactcagccacgcctcgctgctcgacgccgccagccatagtccggcacagctacgacgtttccatcacaacgcgccggagagtctggcagcccggctcgcctctccctgcgagggcgaaacgctggtggtgacggaaggtattttcagcatggatggcgacagtgcgccgctggccgccctggcgcaacagacgcgccaggcagagggctggctgctggtggatgatgcgcacggcatcggcgtggtgggtgagcaggggcgcggcagctgctggcagcagggcgttaaaccggaactgctggtggtcacctttggcaaagcctttggcgtcagcggtgccgcgctgctgtgcgacgcagccaccgccgactattttctgcagttcagccgacatctgatctactccaccgcgatgcccgcggcgcaggcgagcgcgctgcaggcggcgctgcgtgaagttcagcaaggcgatgccctgcgccagcaactgcaacagaacattggccatttccggcgcggtgcggcctcgctgccgtggcaactgatggactccggcagcgcgattcagccgctgctggtgggcgaaaatggcgatgcgatggcgctctcccagcggctggctgaggcgggctgctgggtcagcgcgatccggccaccgaccgtgccgccggggacggcccggctgcgcatcactctgaccgcggctcatcgccccgaggatattgaccggttactggaggcgctgcatgacgctgcgggttgacaagcaggcggtggctcgcgcctttggccgggcggccagccattacgatgcccatgcggcgctgcaacgcctcagcggcgatgccctgctggcactggcgcccgcacagagcggtctgcagctgctggatgccggttgcggcaccggctggtacagcaggctgtggcgcgaacgtggcaaacaggtaacggctctggatctctctccgcagatgctgcaacaggcgcgggacaatgacgcggcgcagcactatctggccggtgatatcgacgcgctgccgctggcggataacacgattgatctggtgtggagcaacctggcggtgcagtggagcgaggatctgcccggcgcgctgagccagtttccggcgggtgctgcggcccgatggcacgctgctgttttccactctgggcgacggttcgctgcaggaggttcatgaagcctggtcccatctggatgcgctgcctcacgccaaccgctttctcagcgagccgcagattgcggcggcctgccacgcagagcagctgcgctgtacctcagaggtggtgaccctgcattttcccgatgcgctcagcgccatgcgctccctgaaggggattggcgcgacccatctgcatcaggggcgtgacgggcaggtattaacccgacaacggctcaaccagttagaggcgcactggccgcgcgatcggcacggctatcgcctgagttaccatttaatctatggagtaagtgcatcatgaaacgcctgtttatcactggcaccgacaccgaggtcggtaaaaccgtggccagcggcgggctgctgcaggcggccgccgccgcgggctatcgctgtgcgggctataagccggttgcctcaggctgtgagatgacgccagagggcatccgtaacagcgatgcgcttgcgctgcagcgttacagcagcgtgccgttaagctatcagcaggtcaatccgctggcgtttctcgagccgacttcgccgcacatcgtcagcgccgaagagggcaggccgatcacccatctggcgctgtcggcgggtctggcggcgctgcaaccgctggcagactggattctggtagagggcgcgggcggctggtacaccccattgtcggagacgcacacttatgcggactgggtggtcagcgaaaagctgcccgtgattctggtggtagggattaagctcggctgcatcaatcacgccatgctcaccgctgacgcggtgcgggcaagcggcctgccgctggtgggctggatcgccaacaccgtcgaaccgccgggtaaacgctatcaggagtatctcaccagcctgaaaaacaggttacctgcgccctgtctgggcaccatcccgtttatcaccgatgcggcgcagcaggcgtcctgtggtcactacctgacgctgccggagtaaccgcctggcctggctattttatttgtcatgctgaatccgggcagtgctcaccatcctcacgcgctgtgcacacgctccggtggttccgcgcgctccgtctccagcctgcctgcaacacttacgcccggtggggcaggcgctgagtgtcaggccaccgtcagccatttatcgacggtgtggtcatcaagctgttccatgctgccctgcgccacattgcggccgcggtgcagcagcaggaaatagtccgccacgcgacggatcagcgacaggcgctgctccagcagcaggatggtcagcccgtagtcgaggttaagccgacggatcagattgcccatctcctcttccagccacggcgacatcccgtcggtcggctcatccagaatcagcagtttgggctgcagcaccagcgcgcgcgccagggccagctgttgctgctgatcgatcggcagatcgccgctgcgctgctggcgcagagagtagagcgccgggaagaggtcgaacaccatttcgggaatggcgcgatggcggtcgcgctggctggcacccgccagcagggcaatcagcagattatcttccacgctcatctgggtaaaaatatggcggccctgcggcacatagccaatccccatctgcgcccgctgttcagccggttgcagcagcagatcttccggcggcgagccatcctctttccaggagatagagccgctgttaattggcaatctgcccatgatgcagtttaccagggtggttttacccatgccaggtcggcccagaatgccggtgcaggtaccaggcgacagatccaggtccacatcccacagaatatggttttgaccgtaaaattgatttaccgaacgtaaactcagcatctgacactctccttcccgatcgttagcctgattgcttccgcgctctgtcgtctggcaaacaagtcatcagcaacggcagcctcgccattgcagcacagtgcgcgtttcgcgcggtgacgccactgaactcctgcaattcccaggccagatctaaaaaaggccctgtttcctgccggagcgccacgtgtcagggaagaaaggtgagaaaaacttatcaattccccacggtgaccacgcacctgcacttttgcagtgccctggagcgctgtttctggtgcagaggtactgtaacgtggcaggaagtccgattaagaatcttagtatgaggcgtgcaaatttgcgtacggcacccggtgacagattaaaattgcagaataatcagtcagcaggcgacgcgaaatttaacgcaaaaaaaattattttcacggtagtgagaaggcagggaaaaattatacacagctgatggcgtcggggctgccatcacttatccaccattcctgtggataaccttgtgcattaggtaatgaaaaccagttggaagcgaggaaatacgcggcctggtaacataatgacgagaatctggcctcatagccttatgtcagtaaaatcagttgcttatcaaaaaacaagcctgagaattacctgtcaggtaaccgtactgtaattttgtgacactctattgacaaatgttaaatcagatccctgcctggggataacattgcgcatcatgctgagcgataacgctgccagcctgcagggacatcaggtgccatcctgctggcgttaacattgcaccaatactgtttttatatccagtattattttctggcaaaatcaccatagcagagtaaaataagtgcctgcccgccgacttctccagcaggaactgcattcatgagcaaagcctttaaattgaactccgcctttaaaccttcgggcgaccagcctgaggcgatacgtcgcctggaagaggggctggaggatggactggcccatcagaccttattaggcgtaaccggctccggtaaaacgtttaccgtcgccaacgtgattgccgacctcaaccggccgaccatggtactggcgccgaacaagacgctggccgcccagctctatggcgagatgaaagagtttttcccggataacgccgtcgagtttttcgtctcttactacgactactaccagcctgaagcctatgtgccgagctccgacacctttatcgaaaaggatgcgtcggtgaacgaacatatcgaacagatgcgtctgtcggccaccaaggcgctgctggaacggcgcgatgtcattgtggtggcgtcggtttcggctatctacggtctgggcgatcccgatctctatctgaaaatgatgctccaccttacccgcggcatgattatcgatcagcgcagtattctgcgccgtctgtcagagctgcaatacacccgcaacgaccaggcgttccagcgcggcaccttccgggtgcgcggcgaagtgatcgatatcttcccggcggagtcagacgatattgcgctgcgcgtcgagctgtttgacgaagaggttgagcgtctgtcgctgtttgacccgctgaccggccagatcgattcggtcgtgccgcgctttaccatctaccccaagacgcactacgtcacgccgcgtgagcgtattctgcaggcgatggaagatatcaaagtcgagctggcggaccgccgccgggtgctgctggagaacaataagctgctggaagagcagcgcattacccagcgtacccagtttgacctggagatgatgagtgagctgggttactgctctggcattgagaactactcacgctacctctccgcacgcggaccgggcgaagcgccgccgacgctgtttgactatctgcccgccgatggcctgctggtggtggatgagtcgcacgtgaccattccgcagattggcggcatgtacaaaggcgaccgggcgcgtaaagagacgctggtggagtacggcttccgcctgccgtcggcgctggataaccgtccgatgaagtttgaagagtttgaggcgctggccccgcagaccatctatgtttcggcgacgccgggcaaatatgagctggaaaagtcgggcgacgaagtgatcgatcaggtggtgcgtcctaccggtctgctggatccgatcatcgaagtgcgtccggtcggtacccaggtcgacgatctgctgtcagaaatccgtcagcgcgtggcgatcaacgaacgtgtactggtgacggtgctgaccaaacgcatggcggaagatctcaccgaatatctgtctgagcatggtgagaaggtgcgttatctgcactccgatatcgacacggtagagcgtatggagattatccgcgacttacgtctgggcgagtttgatgtgctggtgggcattaacttactgcgtgaggggctggatatgccggaagtgtcgctggtggcgattctcgatgcggataaagagggcttcctgcgctccgaacgctcgctgattcagaccattggccgtgcggcgcgtaacatcaacggtaaggcgattctctacggggataaaatcacgccgtcgatggcgcgcgccattgaagagaccgagcgccgccgtgagaaacagcagctgcacaacgaagagaatggcatcgtgccgcagggcctgaataagaagatcaccgatattctggaactgggcaaaaacgtggtgaaaacccgcggcaaagcgaaaccagcccgtcctggcgaagcccaggcgctggccgatttccagctgttaacgccgcaggctctgcagaagaagatccacgagctggaagggcagatgcagcagcatgctcagaacctggagttcgaacaggcggccaacgtgcgcgatcagctgcatgaactgcgaacgctgtttattgcggcctcgtagcgccgttaaagccctgaatggcgtgttccagcgccacccgtaacagctggcggtcgtgacgatattggatatcggcggcctccagcggttcacggacaatcagccggttttcaatgccacgggtgtccaccgccgggctgacgaccagcgcatcaatcacccgcttgccgatataacgctccatcatctgcagcttatcagccactgagaggctggcggcggcaggactcagctcgcggcccagattgccgataaacaccatggtggcaggcgtgcgacgcaaggcctgtgccatctcttccatcagcagaatcggcatcagactggtgtaaaagctgccgggtccaatcaggatcagatccgcttcaccaaccgcctgcagcgcttcccgcgttggctggacgttgggatgcagcatcagctcctgcggcggctgcttcatctcgtcaattgcggtttcgccataaaccatgttgccttcaacatccatcgccaccagatccaccggctgctccgacatcgggattaaaaaggcgtcgaccttcagcaggttacggatgatgttgatcgcttccagcggacgaacgctgagatgatccagcgcccgcagcatcagattacccaggttgtgtccggccagttcgccattaccggcaaaacggtactcaaacatcgccgaagcgacgctgggttctgcaatcagctggttaaggcagttacgcatatcgccccaggcgataccaccttctgagcgacgaatacggccggttgatccgccgttgtcggtggtggtgacgatgccggtgagacgcgagcccagcggggaaagggcagacatgacgcggcctaaaccgtgtccgcctcccagtgccacaacgcgatcaagatcggccagtgtgcgattcatacttctccttaatatccgttcgcgtggcgtggctctaatcgctaagcccgcgcggatgacttacgtcaaaatctggatcgcattttaacgtatcctgtcgcgaaaatgcggtgaaaattcgatatgtataagaatatatagcgaaaacagcaaatggaagagtgacgaaaatcacgctaccatcatgcttaccgcgctgatcaacgggtcagcgtacactcaagcctgaatgcctacgtctgcggatagggggttcaggccgtagccatcgagctgccagggtgcaggaagaaatgactgcatctcccaatctggaaaggtgttctggtgtcacaatttactgatgcatacgcgcgtaagttctattacctgcgcctgtcggtcacggatgtctgtaatttccgctgtacctactgtcttcctgacggctacaaaccgcagggaattcgtaacaaaagctttctctcgctggatgaaatccgccgcgtcacgcgggcctttgccgctgccggaacggaaaaagtgcggctgactggcggtgagccgtcgctgcgccgcgatttcaccgacatcattgcggcggtgcgcgaaaacgcctccattcgccagatcgcggtaaccaccaatggctaccggctggcgcgtgacgtgaaacagtggcgtgacgcggggttaaccgcactcaacgtcagcgtcgacagcctggatgcccgtcagtttcacgccattaccggccaggataaattccatcaggtgatgagtggtattgatgctgccctcgacgccggctttcgccaggtcaaagtcaacagcgtgctgatgcgcgatctcaacagccgtaatctggctacgttcctcgactggatccgcacccgtccgattcagctgcgctttatcgaactgatggagaccggcgacggcggcacgctattccgcgaccagcacgtttccggcatggtcatccgcgatcagctgattgcccaaggctggcagcgtcgggagagcggacgcagcgacggcccggcgcaggtcttttaccatcccgattatgtcggcgagattggtctgatcatgccttatgccaaagatttctgtgccagctgtaaccgtctgcgcgtttcggcgcacggtaatctgcatctatgcctgtttggtgacggcggtgtgccgctgcgcgatctgctggcgtcagacgaccagcaggccgaaactgcaggcgcgcatcgccagcagcctggggcagaaaaagcagacgcactttctgcatcagggcaacaccggcatcacacagaatctctcttacattggcggctaatttcaggaggcagtatgggtaaaccagccagcgaatttcaggcagtgcagattgcggtgatgaccgtgtcagatcgtcgcgatgccagtgacgatacctccggcgactatctgcgcgaagccgcagccgaagcggggcatgaggtggtcgatcacgctatcgtgccggataatctctatcgtattcgcgccaccgtgtcgcgctggatcgccagtgaagatgttcaggtcgtgattattaatggcggaaccggctttaacctgaaaaacagcacgccggaagcgctgctgccgctgttcgaccgcgagattgatggatttggcgaactgttccggatgatctcctatgaagagattggcggttcgacattgcagtcgcgcgcgattgccggtctggctaatcagacgctgatcctggccgtgccgggttccaccagcgcctgccgcaccgcctgggaacgcattatcgctgatcagcttgatgcgcgcaccgtgccctgtaattttgtctcacatctcaagaaacggtaagtatgtctcaactcacacacattaacgccgcgggcgaagcgcacatggtggatgtctccgccaaggcggaaaccgtgcgcgaagcgcgggcagaagtgctggtgctgatgcagccggaaacgctgcagatgattatcgaaggcagccaccataaaggggatgtctttgccaccgcgcgcatcgccggtattcaggcggcgaaacgcacctgggaactgattccgctctgtcatccgctgatgctgagcaaagtggaagtgaacctggaggctgaaccggaccacagccgggtccgcatcaccacgctctgtcgcctgaccggcaaaaccggcgtggagatggaagctctgacggccgcgtctgttgccgcgctcaccatctacgacatgtgcaaagcggtgcagaaagatatcgttatcgatcagctgcggttaatcagcaagagcggtggtaaaagcggcgatttccaggcggtcgcgcatgattaaggtgctgtttttcgcccaggtccgtgagctgaccggcacctcatcgcttgaggtcggtgctgattatccggatgtggccgcgctgcgcagtgcgctggcagaacgcgatgaccgctgggcgctggcgctcgagtcgggcaagctgctggcggcggtgaatcagacgctggtgccgatgagtcatccgctgcacgccggtgatgaagtggccttcttcccgcccgtgaccggaggctaagatggaaacgcagattcgcgtcggccccgcgccctttgatatggcggaagcgtatcgctggctggcggcctgtgatgaagatggtgctgtagtgacctttaccggcaaagtccgtaaccacaatctgggcaacgacgtcgcggcactgacgctggagcactatcccggcatgaccgaaaaagcgctgcaggagattgttgatgcggcgcgcgaacgctggccgctgcagcgcgtcacggtgatccatcgcgtgggcgaactgtttcccggcgatgaaatcgtgctggtgggcgtgaccagcgcccatcgcggcagcgccttttccgctgccgagttcattatggattacctgaaaacccgcgcgccgttctggaagcgagaagcgacagagcagggcgatcgctgggtggatgcccgcgacagcgaccaccaggcggctcagcgctgggactaagctgcattaacggcttagcgggcagaagtgtctgcgcccgctgagccgttaaccgcagacacgccgctgcccgcatcaccaggcatcacgacgcttagcgcggaattaaggctgctttagctgctcagccggaccaaaaccggtctgaccatggctgtgttcgccgccgccggcggtgcgcttcagctgaatgacctggccctgttgccaggcattggcacctgccgcggcaggatgcgccacgatatccgcacgctgggcgcggatctttttgctgtcgacgtcaaaacgacgatcgcggtccgccagcagtcgcgagtccatctgtccatcctccgtaaagcccatcatcagcgccggaatgccgatcggcagcgttttgtcgcgatcggtgtgccaggtgtgccaggttttcccgtaggtgttcacaatgcgcttcatcagggcgtggtcggcggcttccggtaagcctggggcaatcagcgtgcccgatttcacctcatactgatggctgtgccagagcttcttctcttcgggcggcagggtgttaaacagccgtttcgctgataatgtactccacgcccatcagccgtgcgtcgcgcgtgttgccgtcgtaaatcaccgcctgcatcacatcgtcgttcagcacggtgacatagtggtgcgcctccatctgaccgttcttatcgccgttataaaaatggaatccgtcgagataggtgttgatggcgtcgatgggcggacgtgactgcatcacgctggcgccggtctccagcaccttaagcgaggaggaggtgggggcgcccggagattttacctgggcaggcgtattattagcgccgcagccggttaataacaggctgaacgccgcaacaggccagagtttaaacatcgtaagttcctttaacggtaaaaaagataaccttagttcagttctcgcctgcctgtgaaactctggcgatggtagagtagagctttggttcattctgaggacaggcatgtcatccaccccgattctgcaacgtctgacactggtcgccgcactggtgctggcaggttgtagcagcaagaaaacccctgaggcgccggtgcggcagcctgaagatgtcaaagcgcagatccagcggctgttgccgtcgcacgtcagcaataaagcggcatggagcgacgatatctacaccaccttccgcactcagcagatcgatcccagcgccagcaacctctgcgcggtgatcgccgtggcggatcaggagagcaacttcagcgccgaggccgccgtgccgggtctgccaaaaatcgcctggggcgagatcaaccgccgtgcggcgcaggtgcatgtcccggcattcctggtgcgtaccgcgctgcagatcaaatcgcccaccggtgaaagctacgccgcccggctggacaaagtgcgcagtgagaaagagctgagcgctattttcgatgacctgatcgatatggtgccgatgggccagacgctgttcggcaatctcaatccaatccacaccggcgggccgatgcaggtcagcattgcgtttgccgaagcgcatgccaaaggctacccgtggccgattgatggcaccatccggcgtgaagtctttacccgccacggcgggatctacttcgggacgatgcacctgctcggctatccggctgactacagccagccgctctaccgctttgccgactacaatgcgggctggtatgccagccgcaatgcggccttccaggcggcggtgtcgcgcgccaccggcatgaagctggcgctggatggcgatctgattctttatggatcggatgcggcgggcggcaccgaactggcggtgcgcacgctgtcgaagcagatcgatatgagcaacagcgacattcgccgcgatctggagaaaggggagaaagcgtcgttcagcgacagcgaactctggaaacaggtctttaccctggcggataaaatggcgggtcgaaagttaccgcgtgaaatgctgccgggcatcaagctggaaagcccgaaaattacccgtaatctcaccacggcgtggtttgcgcagcgtgtcgacagccgttatcagcagtgcctgtcgcgacgttaagcggcatgttgtggcgcagttgagctgagctgtgccacacttagagccagttccgggcgacttttattgttattctggccctgaactgtgcgcatcctcataaggccgtatgggcccgtggcggttgtgtcgcgctgtcgctggcccaacgggctgaaacagaaacaacgtatgcctgccagaccaggttattcatccggttccctgtgtggagccggtcctaatccgtttaacaagaggtgcatcatggaccgatatccacgaaatgattccatcgttcaatccgcatctcgcggtttacaagcctatatggcgcaggtttatggctggatgacctgcggtctgttactgacggcgtttgtctcctggtacgctgcgcgcacgccagcgatcatggagctggtatttgctaaccgcatcaccttcttcgggctgattatcgtgcagctggggctggtcttcttcctgtcaggcatggtgcatcgcctgagcggggccgtggcaaccgggctgtttatgctctattcggcgctgaccggcctgaccatggcgagtatctttctggtttacaccaactcctcgatcgccagcaccttctttatcacggcggggatgtttggcgcgatgagcttctacggctataccaccaaacgcgatctcagccgttttggcagtctgctgtttatggcgctgattggcatcgtgctggcgtcgctggtgaacttctggctgaaaagcccggcgctgatgtgggcgattacctacatcggggtggtggtatttgtggggttaacggcctatgacacgcagaagctgaaaaatatcggtgagcagatcgatgcccgcgatacggaaaacctgcgtcgctactcgattatgggcgcactgacgctgtatctcgactttatcaacctgttcctgatgctgctgcggattttcggcaaccgccgttaagcctgagggagtagcgggggaggcgcactgtctgcgcctccccttttttattacgacttctgcaacttctgctcgttcttctgacgcagatgcttcgcccgactctccagccccagatagagcaccagcgctaacagcagcggcaggataaagtagagcacgcgataagccagcagcgccgcaatgatagtgccatgcgaggcgtgctgaccgctgagtaacgccaggaagaccgcttccagtacgccaatgcccgcaggaatatgaatgattaccccggcaatactgctgatcagcagcacgcccagcaccatcggataaccgacgtctcgtcccagcagcagccagataatcgcccccatcaccatccagttggcacaggaaaccgcaaactgcagcagcgccatgcgcagcgagggcagctgcagcgtctggccttttaccgtccagcgacgctgctttgagaaggcacaggcccagaggtagaccgccaccagcaccagcagagcgccaccaatcagccgcagggtggtttcaccaataaaccagccgctgggaatcgacaccatgcccgcactgaataccacgcccgccagcagaatatagcccagccagttagtggcgatgctcagagagaagatgcgggtaatggtgccgctatccagccctaaccgtgaatagagccggtagcgcatcgcgacgccacccacccaggtgctcagcgtcaggttgaaggcgtaacagataaacgacaccagcatcacctgccgcttcgccagcttatggccgcagtaggcgcgtccaatcaggtcatagcagccatacaccaggtaactcagcaccaccagtccggcggcggtcagtaccacaaagcggttgtagttaacgatgacgtcataaacatcttcccagttcactttgcgggcatagaccaccagcagaaccaccaccgcgatgaaaaagagcacggtgaggatttttttcgccagttgccagcgtggatgtttttttgccatcaggattttgctcccgggttatcagtttcaacgcgatcctgcgtctccatttcaggctgtaccggctcgcccacctgggccagcagcggcgtatgcgccggcagccagccagcgatggccgggaaatggcgcaggaagtggaataccaccacgcttttactcagttgccaccagttgcgcggcggtaagcgatcttcctgcacgcgctggcaatcgttggccagcagcgcttccaggttatcacgcagcgtctggttaaacggtctgtcgtggatgatcagattggcttcaaggttaagtgacaggctgagcggatcgagattgctggagccgacggtggcccagtagtcgtcttttaccgcgatcttgccgtgcagcgggcgacggatatattcgtagacttcaacgccgccatcgaccagatagttgtagagcagctccgcgcccactttcacaatcggcatatctggttcgccctgcacaatcagtcgtacccggacgccacgctgcgcggcgttgcgcatctcacgcagcagccggtaacccgggaagaagtaggcattggcgataatcacatcccgcttcgcctcacgcagcatctcaaggtagtggacttcgatgtcgtcacgatgctcgtcgttatcgcgataaatatagagcacctgagcatcgccgggcgtggcgttgaccgccggacgatgagagcgcgatccccaccagcggcgggtattctgttcgctgccaatcgcctgttgcagatagcgggcgatgtcacccaccaccgggcctttgacctgcaccgcataatcctgtttcgcttccgggccataatccgtgttgtgctcggccgagaagttaatgccgcccacaaaggctaccacgtcatccaccaccacggttttgcggtgcaggcggcggaaaacgttggtgcgcatccccatcaccagcggacgcggatcgtaatagatgaaacgcacgccagcgctggtcaggctgttaacaaatttgtcggagagttcggcagagccataaccatcgaccatcacttcgacccgcacgccgcgctgggctgccgccagcagttcgcggtgcagggcgttgcccacgtcatcctcaaacagaataaaggtttcgattaataccgtacgttccgcccgctggatcgcgccaaagacccgcgggaaaaacgcttcgccattttccagcaacagcagccggttgccttcctgccagctaaaattcataggtgaatctccaccgccagcggcgcatggtcggaaagatgggaccagggcttgcgcggcagcgcccacggatgactgacggtggcgttgcggacatagatgcggtcaagccgcaggatcgggaagcgcgccgggaaggtgcgcgccgggcgtccggttttcatgctgaatacctctttcaggcctgcgccatgtttcagaatggaattggcgcgtcgctgccagtcgttgaaatcgcccgccaccaccaccggcgcgtcgggcggcagtgagttaaccatttcacatattttcttcatctgcgcgtgacgatgggccactttcagacccagatgaacgcagatgacatgcagcgtgccgtgcggctcgggcagggcgatctggcagtgcagcataccgcggttttcactgcccgccaccgagatatcccggttctcatagtcggcgatcgggaagcgagacagcaccgcattgccgtgatgcccctccggatagaccgcattacgcccataggcgaaatcgttccatatggtgtcggccagaaactcataatgaggagaatcgggccactcttcatggttaagggagtggatggcatgcgtgcccatcacctcctgcagaaagaccacatccgcctccgttgcgcgaacggcgtcgcgtaattcgggcaggatgaagcggcgattgaaaggggcgaaacccttatgtgtattgatcgtcaggacttttattgaaaatccttgcttgttttgtggcatactcgcgacgcactccttttcatcatcaatagaatcaaagtgtagtctttgtcacaaatgggtggtgaaagagggcgaaaattagggcgttatccgaaaattgttttacattgaggaaatcgtttccggcttgtgccggtagcacttgggcgacctgttgggtctgccaggagaactgaatgaaatggtctaatcgtattcaaattatcacgggtcaaacgttgttgcatattgctatgcatctgctggtgatcgctgcactgatctggggctggaagcacaaagcgctggttgatgtctgcagtacgctggtggcgatgtacgcactggtttttgttgccatgctggtgacacagcgcattgcccgtttacgtactctcggcgattatcttgaagaagcgaccaccacttactactttggcgccgccatgatgacactgttcctggtgtcgcggatttaccacaacaacctgctgctggcgtgtctcggcgtagtgatgttgctgggtccggcgctggtctcgctgctggcgaaagagccaccgcgacgaatcgaaaacaaacgtagttaagttgaaggccaccggaaggtggccttcctgttttcaggcggttaagttgtgtcaggaaatgtgagctatctcgcacacttctcttaaagctgttacactcgcccgcttacgcatcgtagtttgcgcccttttcacgcgtcagccctggctggcgtcactatccctctgaaaactacaccgtgaatcacggtcagagcggaccggagtaaatcacttaatgtcttttgactctctcggcctgagtgccgatattttgcgcgcggtcgccgaacaaggctacagcgaacccacacctatccagcgccaggcgattcctgttgtgctggcaggccgcgatctgctggcgagcgcccagaccggcaccggcaaaacagccggctttaccttaccgatgttacaaaaactctctgccactgccacgcccatccgcggtcgtcgcccggtgcgcgccctgatcctgaccccaacccgtgagctcgcggcgcaggtcggcgaaaacgtcagcgactacagcaaatatctctcgctgcgttccatggtggtgtttggtggcgtcagcatcaatccacagatggtcaaactgcgtggcggcgtcgatattttggtggcaacgcctggacgcctgctggatctggcacaacagaatgcggttgacctgtcacaggtcgaaattctggtgctggatgaagcggaccgtatgctggatatgggctttatccacgacatccgtcgcgtactggcgcgtctgccggctaaacgtcagaacctgctgttctctgccaccttctctgatgagatcaaaggcctggctgaaaaactgctgaccaacccggaaatgattgaagtggctcgccgcaacaccgcctccgagcaggtcgcgcagcaggtggctttcgttgataagaagcgtaagcgtgaattgttgtcgcagctgattggcgaaggcaactggcagcaggtgctggtcttcacccggaccaaacacggcgcgaaaccaccttgccgagcagctgggcaaagatggcatctccgccgccgcgatccacggcaacaagagccagggtgcacgtacccgcgcgctggccgactttaagtcaggcggaattcgcgtcctggttgccaccgatatcgcggcccgtggcctggatatcgaagagctgccacacgtcgtgaactatgagctgcctaacgtcgccgaagattacgttcaccgtattggccgtaccggccgtgcggcggcgaccggtgtcgcactgtcactggtctgcgtcgatgagcataaactgctgcgtgatatcgaacgtctgctgaagcgtgaaatcccgcgtctggccgttgaaggttatgaacccgatccgagcatcaaagcggagccgatcatcaacggtcgtcagcagcagtctcgcggcggtgcaggtggcggtggcggcggccgtggtcgcagccagggcggacagggtgcaggcgcatcgcgctcatcttcatccggcgaaaagcgtcctcaggcgcgtcgtcagagccaggccgctcctcagggcgataggcccgcagcccgtccgcgtcgtccggcagcagcgaagcgtaccggaaacgtctgagtatgagggttttactggcaccgatggagggcgtgctggattcactggtgcgccagctgttatcggaagtgaacgactacgatctctgcatcactgagtttttgcgcgtggtcgatcaactgctgccggtaaaatctttctaccgtctctgccccgaactgcataacgccagccgcacgccttccggcacgcgggtgcgtatgcagctgctggggcagcatcccgaatggttagccgagaacgccgcacgtgcggtggagctgggctcatggggtgtggatctcaactgtggttgtccttctaaactggtcaacggcagcggaggcggcgcaactcttcttaaagatcccgatctgatctatcgcggcgcgaaagcgatgcgtgaagcggtgcctgcagatttgccggtaacggtgaaagtgcggctcggctgggactccagcgcccgcagtctggagattgccgatgcggtgcaacaggccggtgccagcgagctggcggtgcatgggcggactaaagaagagggctatcgcgcagaggcgatcaactggcaggcgattggcgacattcgtcagcggctgcgcattccggtgattgctaatggcgaaatctgggactggcaaagcgcgcaacactgtatggcggtaaccggctgcgatgcggtgatgattggccgtggcgcactgaacatccccaacctgagccgggtagtgaaatataacgaaccaccgatggcctggcctgatgtggtgcggttattacagaaatacagccggctggaaaagcagggcgataccggcctctaccacgtggcgcgtatcaaacagtggctcggttatctgcgcaaagcctatggcgaagccgatggcttattcagcgaaatccgtgcgttaaaatcgtcgggcgacattgcacaggcgattgatcgtcacgcacatgttcatggtttgtgataaaaaatcaggcgaccccttagcggcctgacggtatagtgggaaaaatttcctggaccccttgcctgctatgtctgactccgctgtgttgagcaacagccagctcaacaaacgaatcctctccgttattatcttcaccttcttctgctatctctctgtcggactgccgctggccgtgctgccaggcttcgtcaaaaatcatcttggcttcagctcctttatcgccggactgattatcagcattcaatattttgcgacgctgctcagccgtccgcagtcgggccgtctggccgatcgccttgggccaaagcgggtggtgatgctgggactgctctgctgcggcatgagcggggtgctgactatcgtggccgcactgctgagcggctggccatggctgagtctggcgctgctggccatcgggcggctgtttctcggcgtaggtgaaagcttcagcagcaccggctctaccctgtggggtatgaacatcgtcgggccaatgcagaccgcgcgcgtgatctcctggaacggtgttgcgacctatctggcaatggccgtcggtgcaccgctgggtgtgctgctgaacagtgaatttggtatgagtggatttgccgggctgattgcgctgatgggcgtggcgggctatctgatggccagtcgcaaaccggcggtgacggtcagcgtgggcgagcgcattccgtttcaccgcgtcttctcccgcgtctggctctatggcctggcgctgggcttcggcaccatcggttttggcgttatcgccacctttatcaccctctattttgccagccgtgactggcagggcgcggcctatgcgctgacgctgttcagcctggggtttgtgctggtgcgactgggttttggtcgctttattacccgtttcggcgggctgcgcgtgtcgctcttctcattcctgctggaatgtctgggactgctgattatctggcaggcggacagcgcctggctggtaggggcgggcgcattcctcaccggtagcggattttcgctggtctttccggcgctgggcgttgaggcggttaaacgggttgagcgccaggatcagggctcggcgctgggcacctattccgcttttctcgatctgggcctgggtttaaccggcccggtggcgggattgcttatcggacactgggggatgcagtcagtctatctggcggcggcgttgatggtgctgggggcgctgctgattaccctgcggctttactggcagcagcggcttatcgcctgaatgacgataagccgcagaccgttaaaaatggctgaacgcccagtagagcagggcagagagcagaatagataccggcagcgttaaaatccaggcgacggccaggttacgcagcgtcgagagctgcaagccggaacggttcgccgccatagtgcccgccacgccggatgagagcacgtgagtggtggaaaccggtaaaccgaaaccgtctgccgcgccaatggtcatcatcgccaccagttcggcgctggcgccctgagcatagctcagatgggttttaccgattcgttctcccactgtgaccacaatccggcgccagccgaccatggtgcccagtcccagcgcaatcgccaccaccactttcacccacatcggaataaaacgggtggcgctgtcgagttccgttttcactgccttgagattgcgttccgtctcctgcggcagtctgacctcggcgctctgcagatgcttgatcgattctgacgccagatacatctggttgcgggtattggtcaccgcctgagctggaatgttttccattgaaccgtaacgacgaatctcatcgccgacttcgcgcagcgtcatcgccagcgcgggcagcacgtcgggattcatgctgttgctgccaacaaagccggtcagtacctcacgggccggtggaggattggctgacgcgggctgcagttgcagcagctgatgggcggtcacttcgttcagcgccgcgacgcgcgggatctgatcgggtggcagcgatcggttcagggcgtaggcgatcggcatggtgcccaccaggatcagcataatcagccccatccctttctgaccatcgttggagccgtgcgcaaacgacacgccggtacaggtcaggatcagcaggccgcggatccagaccggtggcggctgattgctttccggcgcctgataaagctggcgattgcggataaacagtttcatcacccacagcagcagcccggcgcagacaaagccgaccaccggtgatagcagcagtgcatagccgaccttcaaggcctgatcccagtcaactccgctcagaccgctgcgtccgtgcagcatcgcattggcaacgccgacgccgatgatcgagccgatcagcgtatgggacgacgacgacggcagccctaaataccaggtgcccaggttccagataatcgctgagaagagcagcgcatagaccatggcaaacccgctgccgctgctggcctgcaggatcaactccaccggcagcagtgagataatgccaaacgccaccacgccgctggagagcagcacacccagaaagttacagaaaccggaccagaccaccgcgacgccgggcgtcagcgaatgggtgtagatcacggtcgccacggcattggcggtatcgtgaaagccattcacgaactcaaagccgagcgcaatcagcagtgccagccccagcagaaagaacggcagatagctggtgaccggcatattggtctcttcaacatcgctgaccagattgaggccagcgaaacgccagtccggcaaccagcagaataaagaacagcggtttactgaaacggctatttttgccgttgaaatcggggcgacctcgggctgatgaggaggagagactgttttcgctcatggtgtacctctggtggctgatgccggatgctgatttgcaccgggtcaacgcagtgtgatacgcgctttatatgacagattaatgatcgtcggacggggcattctgagcggagtgcggggaaaaacgcagaaacgcaggcaataaaaaagccagcgacaggcgctggcttctgaaagcagggcggcaattacgagctggtattggccgcggctgcaggggctgctggtgttaccggagcggccggtgcggctggctcagtggccggctgctgtggctgcgcggcatcactgtttgcaccctgagaggtgactggcgtcattggctcttcctgtggcacagcctgcgggttttccggcatcggaactggcgcagtctggatgttgttctccacgccgttcacttttactggcataccggtacggccctgaatcgcgccattaacctgatcctgattgacgctggcatcaaccagaactttgctcaccgcctgattcagcgtaatcggcaccagctcacgcgagttgaactgctcttcggtggtcgacagcgggttatgcacttctacataccgtgaaccgtctggctccacggtcgcttttaccggctgatcaacaaactgtacgcgcgtgccgaccggcacgttctgatacagccatttgatatcgtcagcgcgcagacgcacacaaccatggctcacgcgcaggccgataccgaagttggcgttggtgccgtgaatcgcatagaggcgaccgatatagagcgcatacaggcccatcgggttatccgggcctggcgggaagaccgctggcagggtttcaccgcgcgccgcgtaatccgcatgcatgcctttggttggcgtccaggtcgggccatcttttttacgttctaccgctgtggtccagttaatcggggtatctttacccagctcaccgataccaataggcaacaccaccacggttttgctgcctttcggatagtagtaaagacgcatctcagcgctgttaatcacaatgccttcacgcggtgcgtccggcaggatcagctgctgtgggatgatcattttgctgccagctttaggcagataaacgtcaacgcccggattggcttccagcatattgctgaggcccatctggtactgtgccgcaaaagcttccagcggcagtttgctgtcttcagggacagtaatttcgatattttcgccgatcagacgactgttggccggcggtaacgggtaaaccacagcaaaggctgactggctgaaggccgccagagccagtgcgattgaagcgaaagcgcgaatgattttcatattttacaattctttatcgccatatttcaggctgttcagtgtgtcgaattcatgctggccaatgtgacctgctgcgcattatatgttcattaatctgacgttgtgaatcgggattttaacctgcctgcaatactttacgtaaattcaccgcggatgttagcgcatttaccgaaagcagggcgctaaaaatggggctttccgggcttatcgctgactaaggttgccactgtgtttgttcgccgctgagtttgcggttcaggaaaaaggcggcactgattaacgccagatgggtcagcgcctgcggcgtgttgcccagcgcatggccgtggctgtcaaactcctccgcgtagaggcccagtggattggcgtagctcagcaacttttcaaattcaaaatgcgcttcctgaatccggcccgcgcgcgccagacactcgacataccagaaggagcaggctccgaacgacccttctgagcctttcaggccatcggcgggcgtttcatgcgtattgtaacggcgcaccataccgtcgctgaccagattggttttgatcgcatccagcgtggcaatccagtccgggtcggtggctcccacaaaacgcaccagcggcatcagcagcattgaggcgtcgagatgttcgccatgacgggtcgaagagaagtgaccccgctcactgttccagaagttagcccagatatcctcgcggatctcccggcgcgcccgatcccagcgttcataaggcatcggcagcgatcgcttcatgcccagacgcagcgcgcgatccatcgccacccagcacatcagacgcgagtgcaggaaatgttccggttcaccgcgcatctcccagataccggcatcgggctgatcccagttctcacacagccagtcgatcattttgacgacatgttcccagccgcgctgggagatcgcctcaccatatttattggccagatagaccgcatccatcagctcgccatagatatcgagctgtgtctgctgccaggcgtcattgccgatgcgcaccggacgggagtcggcatagccggagagattcagcagctccatctcgtgcagttcggtgccgctgtccagccggtacatgacctgcaggcgcatctcatcgtgatggctgttttcaacgcagcgaccaacccagtgggtaaagtgtttggcttcatcgatatagcccagacgcattagggcatacatgctgaacgaggcgtcacggatccaggaggcgcgatagtcccagttgcgttcaccgcccagctcttcgggcaggccaaaggtcgctgccgccgcaatagagccgtgctgatgtgaggtcagcagtttgaggaccagcgccgaacgctgcaccatttcgcgccagcgtccctgatagttactgtgggcgctccagcgtcgccagtagttcagcgtctcttcaaagcagtgttcggtggtcagggcttcgatatgcgcatcatccacgctgccaaattcaaactgcgcatgttcaccgggttgtaacgtgaagagggcagtcgcgctctcatcctccagcgtcatcgccacgctggcggcgaggcgcagcgacggctggccttcggcatgaaaatcgatacagccgttgtgcgcctctgcgcgggtctgcgcccgggcgtagtcgtggcgcggtgaacagcgcaggctaaaggtcgcgctgccgcgtaccattttgacccgccggatcagacgcggcagcttgtccttgtcatcacaaatcggcatgtagtcggtgatttccgctacgccttcatcatccagccagcgggtctgcaggatgttggtatcgggcaggtagagctgctgacgtcgcgcattgggccagtcaggggccagggagaaaagcccggcatcatcgctgtcgagcagggcggcaaagaccgacgggctgtcgagttccggccagcagagataatcaatggtgccatcattcgcgaccagtgcgcaggtgcgcaaatctccgatcacgccatggtcttcaatcttacgttttaccttactcatcctcatctccctgtcagtgtccatcctaactatagctgagccatctgatgcggcttcgtttgggcacagatggttaacgtacggttgaatgaggcagggaaggggggagggcgggtgagacatgggaaatcgccagcagggtcgcctggcgctgctcagcgtcggcgacccttaccaccggtcagctcactctcatagacgatggcgtctgctggcgaatccgtggttcatttattcctgatcggcacgacgattgtgccagcggcggatcacccagcgcagcgcaaaggcgaataccactgcgccgaccagccacagcagatgcttcagatgctggtcgagtttatgcagccatggcgcgatgatgccgcccgcgaaatagcccagggtgacgaagatcagcgcccagatgaccgccccgatgacgttaagaataaaaaatttcatcggattgaggcggctggccccgatgatgattgggccaatcagtcgaaagccatacataaagcgcacgccaatcacaaacaggctgggacggcgtttaatcaggcggttcgccttgaccactttatcctgatgctttttaaagcggcgcaggatctgtgtgccccagcggcgaccgacccagtagagcagttgatcgccgacaataccgccacccattgcggccagcaccactcccacgtaatgcagcagcccctcatgcgcggcgacgccgcccagcaacgtaaatgtttccccctcggcgatacagccaataaaaagtgccagataaccgtactgcgtaattaatgcgttgatatccagatgcaaaatgaccctccctgttcagtgactgtttcttccagtctatacgcgatttggcttcgcttccgcccgtgcctcatgggtccgtttatttatgctgtttttttgtccgatcaccacgaaagtttcgctgccatttatacttgagaggacgctgcccccaaagacggatgcatcatcgggcggcccactgcatcagaggagtgaatctatgaatcatgtctggggtctgctggcgcatccgaatcaggaaatgcgtcatatcaagcaagagaatgagagcgtatcgcaccattacacccaccatgttctgctgatggcggcgattccggtgatctgcgcctttatcggcacaactcagctgggctggaatctgggcgaggggcaatatgtgcaactcaacctgttgaccgggattgggcttggcattctgttctatctgattattctgggtggcgtcgcggtaatgggacgcgtgattcactggatggcacgtgattatccgcagcgccccggcgtacagcgctgtacggtgtttgcgggctatgtggccacgccgctgtttctcagcgggctggtggcactctatccgctggtctggctctgcgtgctggcgggcgccctggcgctgctctacaccggctatctgctctatatcggtattccactgtttcttaatatcgaccgcgaagagagtttgcgcttttccggttcaacgctggccatcggcgtgctggtatttgaagtattactggcattaaccgtggtgctgtggggatatggaccgcatctgttctgacagctcgctgccgccgctctggcggcagttctctttttacgcccggaaacactctcaccaggaaatttcttaaccttacgggtatgatatcgccgccagcccgcgctccgacctcactgaagcgggcggcctgtgtcggtctgacacagtacatattcataaccgggttttttctacgatgcctgcaaaaattcgttctaccctgctttcgctggcgctgctcgtttcagggcagattgtttcacttccggcgcaggcgacgacgtcgctgtcgcaactggcgccgattgctcagccgcagatcgcctctggcagtgcgatgattgtcgatctcacgactaataaagtgctgttttccagccaccctgatcgggtcaggcccattgcctccatcaccaagctgatgaccgcaatggtggtgctggatgcgcatctgccgatgaacgagatgataaccgtcgatgtcagccagacgccggaaatgcggggtgtcttttcacgcgttaagctcaacagccagatcagccgccggaatatgctgctgctggcgctgatgtcctcggaaaaccgcgccgccgccagcctggctcatgcttatccgggcggctataacgcctttatccgggcgatgaacgcgaaagcgcggtcactgggcatgaaacagacccgctatgtggagccaaccggcctgtcgaggcaaaacgtctccagcgcgcaggatctggttaaactactcaaagcgacgcgggaatatccgctgcttggcgcgctcagcaccactaaagaggagacggcagtgttcgcccatccgagctatgcgctgccgttccgcaacaccaaccatctggtctataaagatgactggcatattcagctaaccaaaaccggttacaccgatgaggcgggacactgcctggtgatgcgcaccatgattaataatcgtccggtggcgctggtggtgctggatgcctttggcaaatatacccacttcgccgacgctaaccgtctgcgcagctggattgagaccggtaaagcggcgccggtgccggctgccgcactggcctataaaaaacagaagtcgggccaggttgccagtaatggggccagcagcgccgacgttgagtagaatatagccggtgttgcgcgctgcggacactggcattacctgcaggctgagcgggtatccgggatgatgctggcagaggcgtacagcgattttcacgcttatgtctgcaccgaattagcccgaaaaatgcccgttattcctatattgccatcccttgtaaagccctacactacgcgcgactggcgagggaagatcgcctgatttaagctgccggaatcttactcatatgtttaagctacgatccttttttgcattgttaatgctggcgctggtggcgtttgccccggcgctgacgctggccgcggatgataaggccactgctgctcaggaacaggatgctccgccgaagctgaatgctgcggttgaactgccgaaaatgcagaagatcctcgataaaatcaaaagtcaggtctccgttgatgctggcgaaaacaagctgactcagctgaatgaaatggcgcttgagctctcaggcagtgccgacacgctgggccaggcgctgctccccgatcgccagcaactggaagcccagttgcaggttctggggccggcacctaaagccgacagcggcgtaaaagagacgtcggaagtgacgcgcaagcgtaacgcgctggagagtcagaaaagcaaactcgacgatcagattaaacaggccgaaggcattaaaaatggcgcgctgatgctctcctcgcagattgttaacctgcgccgcgatcagctgaaaagccagctggcgctgaactccggcaccattctggggccgcgcttctggtcaccactgctcaatagtcaggatctggatggcgagaaaattggtgaattcctgcaggagttgcaggacaccgcggcactctcatgggagccgggctggcgcgtgggcagtgttttctggctgctggctgccatgctggtgatgacggctggccgtcgttacagcgaagagtttctggcctggatcagcattcacaaactgccggaagggaagctgcgccgcagtttcctggcggcagcgatagccctgaccaccctggtggctgtcgtcctcacctttaactttatcgccctggcctttacccgccgtgatgaggtttctgaaaacgttcaggactttgtggatcaactggttcggctcagtgtcttttgtggcctgattgccggactgggacgcgctttcctctctacccgtcgacccagctggcgtttaccgaccatctccaatgaagtggcgatggcgttaaaaccgtttccaccgattaccgccgtgctggtctttatcttccagacggtcgaagcgtttaactacagcgtcggcaccagcctgaataccaccatttttgccaacgggctgacggcactgctgattggtactaccgcgctggcgatcagcatgcgcaccaaccgcgttcgtcgccgtatgacccaggcgggtacaccaccggaggcccgttctacgctggtcggactgatccagatgggtctgacgctgaccggcatcgctattctggtgtcgctgctcatcggttacgtcacgctggcgcgcttcctgagttatgaagtgatctggtgcggcctgctgtttggttcgttctacttcctcagtcatctgctcaacgatggctgtgagagcctgttctcgaccagtaacgcaaccggtcgccgtattcagagttcgcttaacatcaatgagcgccatctgcagcaaacggctacgttgctgacggccatcggtaaaaccttcctggtgctggttgtggcgctggcgctggtcaacgggacctttgcctcttcaacgccgattgagctgctgcaaaaagtgattgagttctggggcggtaaagggcttgaatccctgaatatcgtcccggcgcatatggtgaatgcgataatctgcctgatcgtcggcatctatgtgctgcgaacggtgcgccgctggctcgacaccgattttctgccgaaaaccaccatggatgtgggcatgcgggtgtcgctggtgacgctgttcagcaacatcggttatgtactggtcatcctgctgacgttgtctatcatgggtctgcagtggaataagctggcctggatcgtcagtgccttgtcggtaggtatcggttttggcttacaggagattgtgaagaactttatctcggggctgattctgttgaccgagcggccagtgaaggttggcgatctggtgagcatcagcggtatcgaaggggatatccgccggattaacgtgcgcgctaccgagatccagctgggcgataaatccacggtgattgtgccgaactcgcagtttatctcgcagaacgtgcgaaatgccaccatgggtaatgcgcagggggtggtcacgattacgctgacgttcccgctcgacatcgatccggcgaaagtgcgcgatatcctgctggaagtctacaacgaaaatgaacgcattctggagacgccagagccatccgtttcgtttaaagatctgactcagcagggaattatactgagcgtcaccggtaacgtggcgggtcagcgccagatcgcaggggcgaagagcgatctgctgttcgatattctgacgcgtctgcgtaaagagggcattctgctttccacaccgcaaaccatgattatcgagcgccgtcagcagatggcgggtgcggagccggtccccgaagagaagctggtttaggtgtgaaagggccgacttctgtctaatgctgatcagttaagatcagatttgtaaaggctgccacggtcaaacgtggcagccttttttctgggcgagcgagcagcagcggcgctcaggccttcactatcgtgccctttttaacaatacacactgaagtttcagagcaggccggggccgggcaggggcaggtaatccgcagcgctgaacagaatgagtctgccaggagagcccgcaggacgcgggcgaaaggcggggcggcacaggatgtgccatccccggcggtccgtcaggcaggcgaatgaagtgaaggaaaccgcgcagcggcgcgaggaccgccagcccctgcccggcaccagactgcgttatcccctgtcgcttaactgactgccattagacttctgtcggcctttttcatattcaaacgctggcttctcagcccgttcacacttcgctttctacagggattcaacgcggctggtgtgctgcccgtctcggctcaccgagcgaattgccaccgcaccgctgacctgcggcggtctggtggcatcgtagcgctgccagtttgtgcccttgtccaggctgtactccagcgtaacgcccggtaaggccacgttcatcgacaggatgccatcaacgattctggctcccggcaccggcaggcgataatcgatacccgccttatccagcttcgccagttcccgctgtcccagcagattggcaaatcgctgccagtcattcaggcgtgcctgcagatcgacgagatgggttttaccccccgcatactcctgacccgccttgtaatcctgctcccagctggcgcggtgccagcttcgttccgctaccgcaaacaggcgaggatagatcatgtgctccatttgagcatcagtgcgtaccgtttcgctccacagctgggccgaaatgccgtaagcaccgctccagggcttctctgatttggcgctgaaaaagttgccgtcgcgatccaccgaggtttcagcattctgcggcaggttgtccggcgcgaagccaaagattttgcgctcgtcgttgaagcgcgtgccccagtaatagccgcgctccagtgggttaacttcatacggaaaatccagatagagatagtcggggctggagatcaccacgtcgtagcctttctgtgaccagtcactggcactgtcaaaaccgccccagtagagggtgtcccagaagttgaccgcgacgcgcggtgtggcaaaggctgctgaatctttggcattttttaaaccatcctgccaggcctgcattttgccaataccgtgccggttaacgatgtcactaacggtcagggcaaaatagctcggcaggtgcgccagatcgtctactttgccgctcttcaccagcgcctgacaaacctgcgatttcgcccacggcaggtcttctttactccagtcgcgcagaccggtgcccggtttagggtcgcgtttatccgagtagccagcacccagccggatattcttcgcttcgtcaccgccaaaatgccagacgccgagcggctgtcccgcttcccggtgcatcgcctgaacttcaccgatcactttatcgacaaaccgctgtgaacccgcaatgcagggattgagatagctggtgcgatcatagagctgcaccgaggtggtattggagtcgtcggtgggatcgatcaggcgatacgcactggcctgttcagcttctccctccttcatcagccgctgatagcgtgcttccatggcgatgacggcggcacgggcatgggcgggcatatcaatttccgggatcacctggatgtgacgggcctgcgcatacttcacaatctcgatgtagtcggcacgactgaaatagccgctgccgttgttatcgctgaacggaccggaaccaagctgcggcagcaggcagcgctgtttcgctcaggtcatggcagcgtttagcccccacgtcagtcaattccggtaagccgggaatctcaatccgccagccctcatcgtcactaaggtgaaagtggaagcggttcatcttccaggccgccatctgatcaagcagccgcatcactgcctgtttactgtgaaagttacgggcaacgtcaagaaacgcgccgcgataggcaaagcgtggcgcatcatgggcttccagcgtggcaatacgcggcgtgccttctgtagggatcagcgagagaatcgacatcagaccgtagaacgcaccggcagcatcgtagcccaccacaatggcacggcgaggggtgatatccagatcgtatgcgcccggtttagcctgtttgccgctgaagtgacccggtttgatctgtgtcctgatggcaaatccatcaggatcttctttcaggccgagcagggccagacgctgctttaccgcctcaccggtttcacgggtcagcccggtcagagacagactgacgccacggctgagatcggcatcctgcggacgaagtttcacctcaagcggcgtgggtgtgatttgaccgcgcagcgcggaagcgggcagggtggcaacatcgctgtttttatcaaaccggctggcgggttgcatcaggatattccggtcatcggcactgcgtcgccagttatcccccaacggcaacacaaactggctgggatcttcatgatcggtgctggcaataattttgggggtggcctgcccggacgtcacataccagcgcggcatcacatccgtggcaaacagctgccagtattcgttaacgatcggaatctgcaccgattcgcccgcgccaatgccggtgaacttctcagtcggctccagccgggtcaggtcgccgaccagatgggtcattttaaactgttcgttatcgacccgcagcgtctggtggacgttgctcatgtagattgcccagtgtttatcggtcagggctgggccgttattggtcagggtaatggtggcgcgattgcaggcggcatagtcggcacccagcgcggcgcagtcggtgccatgaagggcggcctgattatcgttcacctgataagtgacgccaaactggctgatctgattcaccacctgctgcgctgacgagctggcgtgacctgtggctgcaacgcccagcagagtgagcgcgataaggcttaacttaaacatattgattcatccttgctgctgaagagatatccgggaatctgcagggcctcagaacagtgtaaacggcacgataaccataaatttgatgtccttctcgtcctgaaaaatgttgccgtaaccgccgctgtaactgggcagattgctgtgattgtcgtagcgggtgtaatgcagtttaaacagggtatctttggcgcggccctgctggatttgatagctcagatcaaggttccaggcggactctttcagccgctggctctggtcaacggtgggcagcgtggcgggtctggcatcccagccccagacgtacgatgcgcccactttccatcccgccagttgccacggcgttaagtcgagcatcgccccggcaaagatcgctttttcgccattggcgttccagtcggaacgggcatcccaccagatatccagtcgtccattggagctggcgtagcctggcgtcatgcgctgcaggaagaagccctgattcccctctgctttgacccagctgccttccaggcgcagatcaaccgggccgacggtatagccgaccgtgattgcctgtaaccaggccaggccgtcatagacatcacggggattagcggcaccgcccgctactttgtcgtgcgccccataaaactgatagctggtgtaaagtgcattgccaccgggcgtggctgaccacgaggctttggcaaaatattgatccatataatccgccgcctggccaaatgcgccctcaagcaccagattatttttgaactcatatttcataccgaacgaatgcaggtagctgacaggggttttgccatcagcctgacgaaaatcatataagtcacgataccagggcgctttatatttgtcgctccacatccaggagagcgataatgtaccagcctgctggaaatcatacagcgcaccgacttcgacgccgcgataggttccaggtaaaaaactccagtgtggcgcaataattgtctggccggttggctgaatataaccggcacgcaaccagtaatcgttatattttaatttcagtgcggctttataaacagaagcaccgccgctgtcgccattccacttttcatcccagcgggtacgcgccttactgaagccaatttcattgggtgcggcggggccgctgttggaaagctcagcagcaccgaaaatggcgaggtccagaccaatccactctccggcatagcctgactgatagtcgagattactgttgagcgaggcatgatgtaaattagcccgatactgcccctgatattcactggcgggatcggtgtctctgcgatctcgctgacgctgccagtaaaaaacattacctttaagcgatgagtcctcaataaatccgctggcgtaagccggtgatgaacttattgcagttaacgctattaatacggtggctatttcaactaacgctaacgcgtaattaatttttcgcatgatcattcctccctgaatgcaatccggataattaagcagaatataattattgtggcggtaatctatttttcgcgacgcgaattatcaattagcagcgtggtgatttgtgaactattgcgcagaacccgatgagataaaataaagcaggtgcaatatgggaggggagattaattttctgatgaaaatgttagctattggcaggactgttgcaatgggaagctggtggtgcgaacgggcctcccggttgtatgacaatcagcctgctcagataagcaggctaatccataaggcgattaaaactgcttcaccgcccatcccttttgcttactggttttgccaatcccaggattgaagctgttggtgggatcgagctggcgatagaacgccgccagctgcggtttggcctgatagagatgtccgacgttatgttcagcgggatattccgcgccccgcgcctgaagaatctccagcatctgcgctttgagcgcatgcacatcgacgccttttctgacgatgtaatcctgatgaaacacatgacagaagaagtgaccatagtagagacgatggctcagcgaggcgcggatctcatcgggcagggtttcgaaccagtccgcatcattacgacgcagggcgatatccagcgccagaatgtcctcgacctcatcagaatgcaccgcgtggtagcgcaccgccgcacccgccgctgcgaagcgatgcagaaaggcgtgcgcaccttctttgccttcacactcgaagaattcgccaccgccttcgcggaagtagtcgcgcagatagttacgcgcttccgccacgccgtcgccagacatctttagcatcagatggtgttcatatttgtcgcgatactgcttcatgcgtttcggcagatgcgccggaaacagtttactcaggcgctgcaacaggcgatcgctgaagtgcggtttaacgaaggagagtttgctcagccaggcatcaacccgccccttcagcgtgaaaaacagcggcatcttgtcggtgcccagcttgtcgatcatcaggaaggtatctttgccgtagacttccgcaatgtcatagatgtcgcggtgcatatattcgcccgccaccggcagatgggtgaaatgcgccagcatgtgacggcgaatatcgctgagaacaccgggctcgttggtgccgatgtaaaacacctgctgctgcggttcgctggcaaaggtatcgagtcgtaccgcgaagaccgccagcttcccggcacaaccggaggcttcaaacaggcgacgcgcatcggcgttataacgagcgggcgtatccgcatctacttcacgaaacccggtcggcatattcatgatcggaggcgtgacggccatcgtgctgcacatctttgggctgccagcggtcatcatccagccgccccagaatctcttccggtgacgtcccaagatcgataccgagatggttcaccagcttcagttttccctgcgcatcaatctgggcaaacagcgccatttcactgtaggccggtccgcgtttgatcagcgatccgccggagttattacagatgccgcccagcaccgaggcaccaatacaggaggagccaatcaccgagtggggttcacgccccagcggcttcagcgctttttccagctgatagagtgtgctgccggggaacgccagcacctgctggccttcgtcgatcagctgaagcttgtccagtcgcagggtgctgacaatcaccagcggacgatcgtaatcgtccccatgcggcgttgagccttcggtcaggccggtattcgccgcctgcatcaggataatgacatcggcattcaccagcgtttgcagtacccgccagagctccagcagcgtaccgggaaacgccaccgccagcgcctcgccttcgccggagcgaaagcctttgcgatagcgcgcggtctgttcaggttcagtcagcagatgggtggggccgaccaggcggcgcaggtcagaaagcagggcagaggtttgtaacatgagcaattcccttgtcttatcagtgcgtcctaactgtagcacgtcaactcacctcaacgcagtgtgacagcggcagctacctgctattctcatcttgtggcacactgccgcctgtttattcgatattgcgcagttacttaagagaacccaacctgatgaaatggatttactctgttagtctcgctgtctccctcgcgatgcaaccggcattggctgagacagtgccaggtaaccacccgatgaccgaacaggcgcgggatgccttcgtcaaccaactgcttaaaaaaatgacgctggacgagaagatcggccagctgcgtttaatcagcgtcggacctgataatccgaaagaagtgattcgcgacatgattcagaagagtcaggttggcgcgatttttaataccgtaacccgtcaggatatccgcgcgatgcaggatcaggcgatgcagctcagccgcctgaagatcccgctgttttttgcctacgacgttattcatggtcagcgcaccattttcccgattcctttggccctagcgtcgagctgggatctggatgcggtgaaagaggtggggcgcgtctctgcctatgaagcggccgacgatggcctgaacatgacctgggcgccgatggttgatgtcagccgtgaaccgcgatggggccgtggctctgaaggtttcggtgaggatacgtatctcaccagcgaaatgggtcgcagcatggtgcagtcgatgcagggcaaaagtgctgccgatcgctacagcgtgatgaccagcgtgaagcatttcgcgctctacggcgcagttgaaggcggacgcgattacaacaccgtggatatgagcccgcagcgcatgttccaggactatctgccgccctataaagcctcactggatgccggcagcggcggcgtgatggtggcgctgaactcgatcaatggcgtacccgccacggcggacagctggttgctgaaagatctgctgcgcgataagtggaagttcaaaggcatcaccatcagcgaccacggcgcaatcaaagagctgatcaaacatggcgtcgccagcgatccgcaggaagcggtacgcatcgccctgaagtcgggtgtcgatatgagcatgagcgacgaatattacagcaagtatctgcccgctctggtgaagagcggcgacgtcaccatggcggagattgacgatgcggcgcgccatgtgctcaacgtcaaatatgacatgggcctgtttaacgatccctacagccatttaggtccgaaagagagcgatccgcaggacaccaatgcggaaagccgtctgcaccgggctgaagcgcgcgacgtcgcgcgtaagagcatcgtgttgctgaaaaaccgcctggaaacgctgccgctgaaaaaatcgggcaccattgccctgattggtccgctggcagacagtcagcgcgacattatgggcagctggtccgccgctggcgtggcgaagcaatctgtttcgctgctgcagggcatgcgcaatgccaccgaaggcaaggctacgctgctctatgagaagggcgccaacgtgaccgacaacaaaggggttcaggacttcctgaacctctatgagcaggcggtttccgtggatacgcgttcaccgcagcagttgattgatgacgcggtcgccagagcgaaacaggccgatgtggtagttgccgccgtgggcgaagcgcagggtatggcgcacgaagcctccagccgcagcgacctggtgatcccgccgagccagcagaagctgttagcagcactgaaagccaccggtaagccgctggtgattgtgctaatgaacggacgcccgctgtcagtggtgaatgaagatcggatggccgatgcgatgctggaaacctggttcagcggcaccgaaggcggcaacgccatcgccgatgtgctgttcggcgactacaacccgtcgggcaaactgccagtttccttcccgcgttcagtgggtcagattccgatctattacaaccatctgccaaccggtcgtccttacaactttgctaagccgaacaaatacacgtcgcactactacgacgcggctaacggtccactctatccgtttggttacggcctgagctacaccactttcaccgtgtcgccggtaaaaatgtcctcaccgaccatgccgcgtaacggcagcattgaagccagcgtaacggtgaccaacagcggtaaacgcgatggcgcgacggtggtgcagatgtacctcaacgatccggtcgcttccatcagccgtccggtgcaggagctgcgtggctttaagcgcatcatgctgaaagcgggcgagtcgcaaaccgtgacctttaaaatcgacgtggatgcgctgaagttctggaaccagcagatgcagcatgttgcagagcccggcaaattcaacgtgatgattggactcgattccgttcgtaccgaggatgggcagttcaactatttataaccgtcagcctttcccctgacgtcaggggaaggtgatgcggcgcgtcgttagcgtcctgctacggcgcgccgcgtcatatccactatcagagccatcatgattaatctgcgtgaccgcattcagcagcaggtatttcgccttaacggcctgtcgatgaatgaatttgacctctctcaaccgcctggcgatcccggcctgtttggcccggacagcgtgatctggcgcgtccacggtgacttcacctccatgatgtgcggcgggatcagcgcgctgctgttgcagatgctgcatccggcggcactggcgggcgtctgggatcactccaatttccgcgaagatatgatgggccgcctgcggcgcaccagtcagtttatcgccgtgaccacctacggtaattcgcaggatgcacagacgctgattgaccgggtgaaacgcattcacctgaaagtcagcggcgttgacagcgaaggcaaaccctatgccgccagcgatccgcatctgctgacctgggtgcatgtggcggagaccagccgttttctggccgcccatctgcgctacaaaaatccccagctcactcgcgccgatcaggatcagtactatcaggaagcggcacagatagccgaagcgctgggggcggagaaggtaccgaaaagcgttgtcgacgtcgcggattacctgcaacagatgcgttcagagctgcgctttgatcatcgcactgccgaagtgacgcgattgctgatgaatgcccctgcacccagctggcaggcaaaaccggtgatgaaaatcatgctgaagtcagggtttcgggctgatgccagcctgggcgcaggcaatgtccggtacggagatcggccgctttcagcaggcgatcattgaccggaagattaatgcgatagcggtggggttaaggtggtcgattcagcgcggtgcctggtatcgggcgatggtgcggatgggcagggtggggtgaggggtttgcttgtaaaaatgtgagtggcaagtggtcataaagagattaggcagcactagtgattgatgctgctaattggatagacgcttttgttcacccaataaatttatttgggttattcaaaataggctgatcggtgcagatatcaacgtccgctttgtgccagaagcagacctttttagaccgtcatttaatctttcagagagctcgattcttcagagagccattgtcttagaatgcttaatataaatatctgaacggtagactaaatcgtatcctcgctcagccttaagtttgtactgttgaaacgcaacaacaagccttcctgcagccacatcatccgcaatccgagatcaaaagcgcttatgacaacgccaaacgagcattgtcgggtggactggtgaaaaccaagagcagacgaacaaagaggcccgaagagcttcaggtggaggtagatcgcctcaaggccgagtcagaggcctacaagcgaaaggaagaacaatagctacgccgctggcagcaaatcgcctttcatgtgcggcagaaaggcatacagatggctagtgtggataaaacctctgctgaaagggctgagctgccctataataatgaaaccgcgcatatactccggccttttgataaagaaattccaccttcagggagaacataaaatgagtctagaaataaaaaaacaaagtaacccgttttctactggtggtggtggagttaatttcgaaacaagagttcaagcagctttcgcactatccttaatgactaaatcttgtgttccttgtttaagtaattacatgagggctaaagagttaaaactccagaacaaatatgatggtgtaaatactgatgattttgtattgactgccacagataactcaaataatgaaagtaagatctttgctcagattaagcatgaaataactattagtggctcatcaaactcagtatttgcagaagttataaatagtgcttgggcggactttaaaagtgtgggctttaagtcagaaagagattcaatcgcgttaataacaggtattttacccaaagctgacataaataatactttgccgttacttgaatgggctaagttttcatcaagctcagaggattttataaagaaatctcaaacccaaggatttaccagtaaagcaaagctcgacaggttaggaatatttagagatcaacttactcatgcgaataacggggtggctatctcagaagaagaattgtggtctttcttaaaatcgtttcagatattaccttttgacttagacgcagaacattcaatcgtagcaaacttactttgttcattgattcagtgttactcagacgtattaccttctctagtcttagctagacttgtttcctgcgttcaaagtttcaatcagaatgcgggagttttaactcaaaataatatcccagaagacattaaaggattatttaataaatcaaactacttatatttcgagaatgacttaataaagctttatgagcgcagtcagcatatttttgaaggtatttctacaactataaatggactccatgttgataggacagaacaactagcagcactatctaactgctatagagatagtgagtttgtatttgttaccggtgcaagaggggctggaaagtcaggcgttgttaaagattttatcacaacaaaaaatatagatattccagtcttctacttaagagctgaagatttagataaaagtcacttaaatgaagttttcacttccatgggaattacatcttctttgggagaaattgaaagtcatttctcattgcttcacgaaaaagtactcgtaatagagtccctagaaaaagttttagaattaaattatccaaatacttttgttgagttattgcaatacatcagaaaacagtctggttggactatcattgcaactggccgggactatgcttatcaacaattgtcatttaatttcctacaaccttgctctataaattttagcagcatgaatattcaagggcttgaagatagtcaagtcgagcaagtttgccagcatattccagagctaaaagctctagtgtctaatagcttattagtagaactactaagaataccattttttattgagattgctgtaagagctataaaaaatggcgctcaatttgggattggagatactgaagaagactttagggatatagtgtggcgaaactgtcgttgcaaaagaagctgatagaaagtcagggatgccagatagaagaagagtaacctttattaaaatagcaacagagagagctaaaaagatgctttttggtgtcagagcaagcggttttgacccagaagtaatcgcaaagttggaagaagaccatttgatctacagagatcaaaaatcatcttgtgtaagtcctatgcatgatgttttggaagattgggctttagatgagttcatcgatagagagcattttgataattctcataatgttgcaagctttttgttaaatataggaaatgaacctgcgataagtagggcattcaggttatggctgtataggaagctaaaatttgatgatacaactaatgaattcgtagaagttttattatcttcgaacgagatagagagttattggaaagacgaggcaatttctgcaatcatgcagcatgactctcctggaatatttcttaattcactcaagcgccagcttcttaaggatgattgtgctcttttgacacggttttgttttattctcagaataacgtgtcaaagaccaatatctctatacaacggactactgataaaggatcaaaaatcgggattgctaaaatcccttttcctaaaaccatatggagaaggttgggaagcactattccattttatttatgaggaaaaagataatttgagtagctctgtgcgtactcaagttattgagttgatagatgaatggactggtctcattaatatacatgatgagttgccaaaagcgtctgaaaaggttggttttttaagtttatggcttcttgaaaaggttaaagattcatatcgaggtgaggggcaaaggaaaaaaatattaaatgctttattaaaagtctcaacggctattaaagatgattttgatgaattgatgaaacaggacgttttcacctcaaagataaagcctagtcgattaagttatgttgatgaactgagtagtttggcacttataggcttcaatgttcctatgttgtgtaagttttatcctgacttcgtagttaaactttcaatgcatgagtggctgttggaaaaagccgaagagaacggttatggctacgggtcatatcgagtagacgtagaggaatcatttgggctagatacagaacgagatttttttcctgcgagcggtgccaaaggccctttcaaatatcttctccaattcaagccaaggctaggcttagatttcattattagattgtgcaatttgacagcacaaaaatattcagaatcggatttttccaaacctcaagacaatgaagaagacactatttacgccttcgaaacagtagctaaacaagtcgatataaccctgaatgatggcacagtagttaaacagtatgcatctccccacctctggaagggatatagaggacagtctacgttgccctacttattacagagtgctcttatggcgttggagaaaactggttagttgagtacgttgaaaattgtggtaagaataatgaaatagattggatttttgattatgttcttcgctctagtaattcagtaatgcctacatctgttttatcttctgtggccacaggcttccccaataaagtaggtaaagccgcctttcctttacttaaaactgctgacttataccatttagatttgattcgaatgacacaagaaatgggtggaaatgagatgcatttctttggtcttaatagggatgcattgtcggatatatacctgaaagagagaagagaagcagcacttcgaccatggagaaatgagtcattagaaaccttattaacaaggcttcagttcgtaaatgagctaagggatgatattttaaaaattgttgatgaactgaaaaatgaagctactgcaagtaatgaaaaaagtcttcgatatatggtgcacagagtcgatacaaggacttgggaattagttgaagacaaagaaaatgacagagtattgtttcaaagctcatcagagcttccgggagatttgaagctggatcaacaagagtttaatgaaaagcatgcaatggataacctcgtaactagtttaaacttatggggtagaaaattattcgatgagcaattactagaagaaaaatacttctcttcatatcaggacgcgttaatagctactaagggattgctcagcgccctccaaaaaggtgaagttcacaactttgctgatatggcggttggcacaatcacaactgttgcagcgatttgtgttcgtgattttcttttagaattgagctatgaagataaaaattggtgcttagaaatcatcctagaatcaatattcatgcacgcagacaatatgaatgggacagctgcacatgataagactgattattatggctctggagcatgcgcatttgtcttacctaagttatttgatttagatctagattcagaacaaatagaatatttgaagttttctttagctacagcattaacgcatgagaaacctgaacgttagtgcttgtgctgctaagggagtaagagagtttctttggtctagagacgctgaattagcatcccgttgtgtaggtggaatagttgagtatgccagattacgaagggaagatagtgaggtacgtaggttttatcatttacaaggtgctgaattgcaagccgcactcgaaaaatggaatgatattttaacaatttttcgtaacgacttgattgagggaaagtttaagatttctgttaacgatatatctttggaaagccactgttcgtggttcattcatttaccaatgctaatggttccttactgtactaaggatgagatacaaattcagttggtcaacaggataatgagttttgtatttgatacagagtatcaaaaccatcgttcgagtgatgataaaaaaataaatcatgaaattaaaaagcagattcaagattgcctctctgaacatgttttttcttcaagaaacaataagttcatgccctttaaagatctattggtattagggtgtacaaaagctcccggcttcatttattcgttaacactctcctatcatgtcgcagtagaaaaagaaggtgattatgatgctatatgggcactttggtgcctgttagcaccagaagcacacacgatagctttgaatgatgttaatgatcgttatatcggtttacagaatgacctaaatcagctactgcgtggaatgatgtatgcggatagcccttggcaaggacatgagaatgaagagaaagatatgaagcgaggtgctaaatatttactcggttttgctaggcaatctgcacataatagccatgtgtttgaagccttgtcttcattgatttataacttctacaacgtattcttcgaagaaggcattctgattttagctaagcattatagtgccaatcgacatattatcgggaagcaagtgtatacagcattctatatagaaatggtggttggaagatttttgcagatagaaaatcgcggaactctcagtagaagaatgtacgatatatgcctgcttctcttaacaggaattgtagaaactggctctgctagagcttattacttacgtgaagaattgattcgttctcgaaagatttcagcctagagggtaactgtgacaatttttttacaaaatgatgatggctcagctgagtataaagaagcgattcttcgatcttttattagtctatgactagatcaaaagttcaggatgctcagactgataggttcattgagctttgattgatttgcactggaaaagaggctagtccatcacatcaatgtccaatggtatctcaataactaccaaaatgtatcgagattaaggtgatgagcgaaattctgaccttcggtttgatggtaggccaaccggcattgcgtaacctgtgcctcgtggttcacctagaaacactgttagcaatgtccgcttctcgctcatagcggaccttggcctgtcttcagtccactatgtgccagaagcagaagttgaaatgccagagactatataaaaactgatggttcgttttgcaggaatacttacataatcaactactattcaatgggaaaaggggtgggtattttacagaatggtagggataccctgatgacattctttagcatcaattgtagctcagcgctggagaatttatggatctctaacttttgtgccagaacaataaacttatcctgactgtcttgcgtgcgagtgtgcaattctgtttccattgcgactttattgctttcgctctgactacaccaggtttcataccaaaaagagagaaatatatgcatcgctatctcagcatcattttgcataatacttggatctaatcctttaataaacgttattgtgttatgtaatcggatgagtgtcctaggatttccgatgcgaaagacctgtgcgcattcaacaaatatttcatattcatcatgattttcttctaaatattcatctggctcggcctctttttcctcattctcctcaaaaaactttaattcatctgggcaggttggtatgatatcttgaacaataacgtcagtgatatcattgaactcaatttcttgctctttttcatctgtcgtactgactgttactgatttttttacacccttatacaaacttttatggatgaagttatttatattatttcttgatggggtatcaatagcaacagatgcttggaatatcttgccaagatatattctgcttttaatagttgcttgctcgtctgtcagtgtattatcttgctccttccatttcaaagtgaatgcttttgcaattgaattatagtcaattgcgaggatgatattaacattctgaattgtagaaattagttgtagcgcactaactgtatcaataattttaccatcggaacagcgatcaagatcatcaatagttataatatatttggtcttaacccccgactctgaaaatttcgatgaaagacaacgggtaaatgatgtggcatcgctgataaacaaataagaaaggtgatgccgaatcgtctgtcccaatccaatatgatcactgaatttttttcgtttgataatatcccgaattttctttgcaatggggttttcgaaataggtcttaattaaagaaatagcagaagtgagagcggttccaaatagtgcagcggtcattaaggtagatgccgtagtgagtttaaaattatttacagtcaaataagccacaatgaacgatatagggagtagaatgagaagttctatttttaaattatcttttgctgatagtaatcttgactttaaattcaataacagttgctgaaatatgttttttgattcgtataactcatcaatgatttgattagcaatggacgctagaaccgcattgctatgttcttcatgccaagcattataattgatgaattttagctctcttttttcaagggtgtttttttgtagcattgtcagaaacagagctttttcctattccccagttgccgagtaatgctaaattaagatttcctctctcacccttggtcagtatgttttcaatcaagtcaacaatctcaatgcgcccaagcatatctattgttgcggggcgatcatcaagtggattgataagcttacgcctgtttttgctatctgaaatacgtagattcagattttcggtacgaaatgcacccatttcttcaaaaaaatactttctattatatgaaaaatcccatattttaggtgcagcggcctttgggagcgtgcagttaatgagtgctttactgaatgcatcttcggatggaagttttcgcaacaatacaacatcactgatttttatattgctgagaaaatgatacatattaatagttactgcaatatctaacttgtctgaacgttggaatttattaattttatcagtaaccatcgcatcatgtgagctaattgttactgctacttcttcttttgcactagaatttagtgccattgttaagctaactgcgatagagtgactcttgcatattattacaacttttgaagtgcttttgttataaatgtttttaataatccagcgagcaatgttatcttgtatctcttgttcattaagcaggtttgggtcaaccccgttaatagatattacttcagttttgtttaataccccgtctgtaaatgcatcaggcatagaatataaaaaagtgatttcacctgcaatctgttgggcctctggataggcaacactactgataatacatttttttactgcattaaaagatggagtggttagttcttttagcaatttctttttggtagaataaccatctaatataataaccaaattcaaatttagtgatagattttgaatactattgagattggatgcgattatgataataacacggtcagctgaatctattttaacaggctttttagagtctaataccctggattcaatgttaagcatgcctaattgatattgtaattgagctgcaataaccctgaggtcaacaacaattaaaacttggccattttgcatatacaactgagcgatttcgctggcgacgagtgattttcctgagcctggagccatgagcagtaaggctttaccagactgtgacagactttgattcgctagctggattgctttctgttggaacccgcgcattttattatactcttccttaacattttaattggctgcgatagaagaaaaatggcgtatagtgatgtgaaaatggattcaaaaaaattccatcgctaacgccttcaggtctgtgcgcagcataaatactcatatagttgtgctatgataacgtgttcaagttacattgcaaattcaacattttcaaaaatttattttttataaggaccggccatgtccgaaaatttgcaatacacttcatcgctacataaaaaatccctttgtaccaacaatgatataccacccaaaaagacatcttagccatgtattccatcattgtatgataatctgagtagattttgtccttcatcaatatcatgtaagctaaatgttcttttcccattattggcctcaaagctgattaaatagaattttttttaaaaaaccctcgacttcatcagtgtcatcaagatcaagttttagatactcttcactagccagcattgtatacttgaaaccaacgtacctctggtccgataacttccacttcccatacaccaaacttttcgtgattcttttagagaaaacagtgatattgcaaagaagtatgctgaggtaaaacaatcggcggcatctctcaactgaaacgatgctcatcgctatagaccgctcaaagcgaacttgatagagtatcatttacaactggcactgactgcttaggcacgatcttccgcattatttgttggttgagcactcatgcagcttcctcctctcgctcagagcagacttgatggtcatccagcctttctgctttgtgcccgccacataagttcggtccgacaaatataatcagcacaatgcctttgaaaaacagagtgcctcttctctgccaatgtatgggccataattatcaatacgaaaatatccatttttctcgtaaaaattgacgccttggcggttgctatgtgtggtttccagcttaaactcacgatatcctatttgctttgcagaagtttccagaaaagtaagtaatgcactacccacgcctggcatgcttcgttctgaaaaaattcttttgagctcggcgagattttgcgttaacggccgggttgcctcgcatcttatcgcatcgcttttgctggccaccacgctgcttaccggttgcgatgctggcgcgaagagtattgattggtataaagcgcatgacgcggagcgcaaagctaaatatgaggaatgcacgaaagcctctgatcaacgcggtaccgaagactgccgtaatgccattgatgccactgtccacggcggctcttttacaaagagtcccaataaaagttggtaaattcagacgagccgccgcctggcggtttttatgcccttctgcgggcacaggtaacgtcccttcagtcagccactcaaaggcagacgccgggcacaattgacattgttctcccaaaaagcaatagttaatttttagaatcaagtggatctactatattcgcacataaggaatggaattctcatgtcatatagctgctatttacttctcaatcggcgtgaaatgaccagcctgagctgccctggtattgttacatttcctgctttttctggtcaaaaagaaggccgcaataatccagaaaaaacaaacgtacccgatataggcccaatagttcgtggccgttactttattgtagaacgaccttcaggcggaagattgggaccgtttagagaacgcttgttgaaagacatatacggtacggatcgctcaacatggtttggactatttcgtgacgatggaaaaattgatgactacacgtttgtacaaggcatcaggcggggtaatttccgtctgcaccctattgggccattagggctgagtgaaggctgcataacacttcaacatcctcttcagttcaattacatgcgcgacatgttccttaaatctggcccaacgcttaacatcccgggcagccagctcaaagcctatggaacggtaaaggtatactaacgatgcgcttaatttttactattttgctgtttgttttttgtgcgattgctatttcaaaagctattgctgtcatagtgccggtaacattcttttatgccatcgcaggttttctcaatattaatggcgatgaggcaaccctcgactttgtactctcagccaatatccttatttctatcattatgtctgttgcgcttttatgggtgctgaaaggttttttcaaaaagcattaaacaggacgatatgagtaccattgattagaaaagtcagtctgctaaccatagtgaacgctacaatcaacaccgtatccggttgactttatggggcagtgcatcgcgctccttcgctgcatccacccgttactgtaagagcattatcagaccgtgatggtatgattatgctgccagatgggcctctactcccgccaattgcgcctgctgtactcttcactgcactccaaccccccacactttgagactattacccttgtctcagatagccgcagccaggatcctgctctattctcggggaaaatggattcctccaggctttgtcgaggcactatgacgtacaaatccctgattgctgaagtccacaatcagcagcgcaccctgaccgccattgtcgaacaggatgagcgcactgcctatttttacatctggccaaccgacctgttccgcagccagtatgcggtacgcggctgctggctacgaaacctgctgccggcaccggcgcaggaagatcgcgaggcgatggagcagggcatagcgccgctgctcagcgccgagtattgccgtaatctggaatcggaacccgcgctggatccagctggtctgcaggtgctatgggagccgagcgatgatggcgcggcgctgtggtactacggccagctgctggcggtgatccccggctggagtctctatcaggagaagcaggtgagcttctccgcgggctgcatcaaaaagaaccggctgacggcaccgctgggatcggcatcaaccaatgactactacgcccgtgcagagcatcagcgtcagtttctggcgcgaatggcacgacggcagcgagtgggataaggtgcagaacgatctgatggcctgctatcaggcgcgctttggcgagtcagtgaagtattacgctatcgatcagggcagctggccgccgatggcaatctcccagcactggcatcagggcgtctggtatttcctgaccatcggcatgagcatccggccgatgccgcaggtcgattatctgtttgatgaactggcaccgcagtatcgccgcattgaactcggcatggcggttgacggtgaagtcatgaccgaaggcaacgcggtgcagatggccagcgcgctggcggagttcgtgcatctgccgtgggcgcggctgacctggctgggcgagggccatacgctggcgtcggaagtggcccccgtcggctttgaaagcttcctgctggccaatgagctggcaaccgatcaggcgcagttctcgctgccaaaacgcgacggcgatcgcccgactctgctctggactacgccgattacggaagcggaacggcagttcgcgcaggcggatgaacatggcggtcagaagttacgggaattgttaacggcggatggcaataatcacatcttccgcccgcgccagcaggtcgtcagttcagaagagtaggccagcaataatgcgcctgttcgcccattccccggctcccgccggggatgtgatagtttctcactgaaattaaatttttacataaatcaaacatttctcaaatatgtgatcctgctcatctcaagttcccgcttgccgcgccgttaaacccgatcaggcaatcgcgccgcaccaggttcaggggaacgaagatgtttaaaacaacacaatcccgcttcaccgcaacaatgatcgcgttctttgttgcgcttttactcgttacagtctgggttattaatcagtttgtcgcgccacagctggtcgatagcgaaagccgtctggttcgctatcaggtggattcgctggcttccggtatcgttgaacagatgaaccgcgttcaggcccagcagcgcgccattaccgaagccgcatctgtcatggagagcgccactatcgacacccttttaccgacgctggttaaccagtatcaggacagcaatgtgtttggtggcgggatctggccactgccaaaccgtcgtgatccggccaaagagaaggacagcagcttctttgcccgtaatgccagcaatgaactgcaggtgaacacttactggaactccgacgcggctgacaaatactgggagcaaccctggtacaaagatggcatggccgctccgaaaggccagtgtgcctgggcaaaagcctatcaggatgccgccagtccgcagccgcgcaccaactgcgctatggccatctacaagaacggcacggcctggggtgtcgccaccatcgacgtgacgctggggttctttaaccagctggcgaagcagatgggtgaaaccattcagggcaacgtcctgatcgttgaagccgacggtaaaatcgtgggcaatggggcactggtgaatgccgcaccgaagctggagaacctggctgacgtgcagatgccgatggcagcaccgctgaaaacgctgcttaacggtgttggcaatcagccgctggaaaccacctatgacagcagtgaaggcgagcagacgctgttcgtgcaggccattcctggcagcccgtggtatctcgccagcagcctgccaaccagcctgctgaaagcgcagtcgcacaacatgctgacccgtctgggtctggtgcagatccccctggcggtgatcctgctgctggtgtcgctgggctttgtccgcgccatgatgaaacgcctcaacgtgctgaacagcaacatcgaagcgctgtcgaccggtggtgcggatctgactcagcgtctgccagccagcaacagcccggagttcaacgccgtcgcgcagagctttaaccagttcatcagctatctgcaggggctgctccagcaggtgggcgacagcgcgctggcgatcaccgccgcgtcgcgggaaattgccagcggcaacgctaatctctcttcccgtaccgaagatcaggccagctcgattgtagaaacggccgcgtcgatggagcagctgaccggcaccgtgcgtcagaaacgccgacaacgcaacccacgctaaccagctggcgggtgatgcctcgcaggtggccgcacgtggcaccgaagtggtccgtcaggtggtgaccaccatgggcgagattcatcactcatcccgtaaagtggtcgatatcatcagcgtgatcgacagcatcgcattccagaccaatatcctggcgctgaacgccgcagtagaagccgcacgggccggtgaacagggtcgcggttttgcggtggtggcatcggaagtgcgtaacctggcacagcgttcagccaactcggcgcgtgagattaaaaagttaatcgaagagtcggtggcgaacatcgataccggcagcgcgctggtcgagcaggcgggtcagaccatggatgagctgatgaagggcgtgagcagcgtgacaacgctgatgagtgaaatcatgtcagccagccgcgaacagagcctgggcatcgaacaggttaacgttgcgattactcagctggatggcactacgcagcagaacgccgtgctggtggagcaggtttctgctgccgcgcaggcgatggaatcgcagagcacccagcttgagcgggtggttcagagcttccgactataatccctctccaggccagccttgctggcctgattttctctctgcttcatccgcttatctccgcctgacccgggtaaaaaatcctcgatgatccgcccaaaccgataattctgtgccagaatagttgggaataatctcaaggaaacgccatgtctgctattgaagttatcctcgttgaccacctcgatcgtcccaccggcaagatggaaaagctggaagtgcatgaaaaaggattactgcaccgcgcggtgacggtctacgtcttcaattcccggcaggagctgttgctacaacggcgtgccagcgataaatatcattgtggtggcttgtggagtaatacctgctgtggtcatccttatccccatgaatcaacccgcgacgccgccgagcgccgcttgcgtgaagagatggggatggtggtgacgctgacgccggtgtttgagctgagctacaacctgaaactgagcaatggcctgactgaacatgagtatggtcacgtcttctttgccgtctgcgacagcctgccgcagctgaatccgcaggaagcggatgcctgggattatcgccctatggcgctgattgagcagcagatgcagcagcagccacagcagttcacaccgtggtttttgcacaccttcccgcgcatcccggactatctggagcagtttcctttcccgcaagttaccgcataaaaataccgcactaaggtgcggtttcaatgctggccggagaagtcgggccggggtaaacaatgcgccagggttataagcccgtttgctccctgagcctgcgcgctatccacgccctgaccattgattatcgctgcagctcgaaatcctccgcatccacatcataacccgacggttcccagcggatcgccagcagcgccagcaggcccgccagtggtgccaggaagatcacccagaacacgccggtgcccagcgccgcgaccagcaccggaaacagaaacagcgaaacggtagagctgccgcgcatcagcgtctggttaaagccgacacccacgccacgcagcgacgtcgggtagctcagcgacgcaaaagtcatggtatgggagccaggcccgaatccctgtccaaacaggaacagcgccagcataccgatcgccagcgcggcttcctggccgccttccggacgaccaatcagcgccagcccgagcagcgccacgcactgacaggcatatcccgccaccgacatcttccacgccccgaggcgcggcaccagccgcaccgccagtatcccgccgacaaaggcgaacagcagattcaacgccagcgacaccagaatggtggtaagcattgactgggcaaagaagctggagatgatcaccggcaagccaaacgccaccgcgttataagcaaaagatgaggcaatggaagtgatggtcgccagcagggtacggcggcgataaacgccctgtaacagcgcgccatagttacgccagctcgccttgcgcaccggcgtggcaggcgtcagcgcggcgtcaggcgccacctgagcattaatactccacgcactgcgtaaaatcgccgcggcacctttcaggtcgccctgattcgccgcccaaaccggggattcgctcatgtaacggctacggatggcgatgatgataatcgccggaaacggcaccaaaaccaaggattagacgccagagccagtcggtgtggctttcgggtaacacggcatagagcagcagcaccagcagataagagatgctgatcgccgcataccaggttgggcaccacatcgccacgctagccgctttatttcccttgccacgcagtctggaaaactccgccagaaacgccatcgccaccggcagatcgattccgactcccaggcccatcacaaaacgcgcgccggccagcacatactcattgggggcaaacgcacaggcgatagccgccaccacgaaaaagaacatatcagccataaacacccgataacggccaattttatccgtgagatagccgccgatcagcgcgccgataatggccccgaaggtgattgccgaggcgaccatgccggtgccggtcggggtgagattaaattcgcgcgtgatgtctttgatgccaaaggccagcgcacccaggtcgtaggcgtcaaggaagacgccccccagcgcaatcgctaccacaatgcgggcattattacgggcgctgtcgccactgttcactaatcgggagacgtcagctgcgctgcggatccactgtgtttcgccaccgggcgaactccctgttgttgccacgtgggcggaagaggtcaggtcggacatgatgttgtgcgtcttttattataaaaacagatttccgagaatagccgtttagacgcccagacgtaaattcatttcggttatatgagatgaatttataatctcaaatcgttatcaatttgcgataaagtcagctacatcgccgctgcgccaggctacgcttttaaggcagataatttccgctgcacgccttgccagcctcccgcagagtggcaggagggcagcctgaaacgcgcaggcgcacaacgccttgtgaatcatcacgcaagaacaaaacgtaaaaacaacacactgcgataaggaaaaagccatggtcagaattcggggttggatgggcgtcagcgctttgctgctcagcatggggatagcacaggcggcagacccggtgcgggtcggctcgaaaattgataccgaaggttcactgctgggcaatgtgattcttcaggtgctggaaaagcacggggtaaaaaccgtcaataaaattcagctcggcaccacgcaggtggtgcgcggtgccatcacggcgggcgaacttgatatctatccggaatataccggcaacggtgcatttttcttcaatgatgagaaagacagcgcctggaaaaatgccaccgaaggctacgagaaagtgaagaagctggatgcggagaaaaaccatctggtctggctgacgcccgctccggctaataacacctggaccatcgctgtgcgaaaagatctggctgaaaaaaatcagctcaactctctggcggacctcagcgcctggctgaaaaaaggcggcactttcaaactggcggcctcagcagaatttattgaacgcagcgatgccttacccgcctttgaaaaagcctatggctttgacctcaagcaggaccagctgctgtcgctggctggcggcgataccgctgtcaccatcagcgcagcggcacagcagacttccggcgtaaacgcggcgatggcgtacggcaccgacggtccggtagcggcattaggtctgcagacgctcagcgatcctaaaggggttcagccgatttatgcgccgacgccggtgatccgtgaatcggtactcaaagcctatccagagattgcagagtggctgaagccggtgttcagcgcacttgacgagaagacgctgcaacagctcaacgccagaatcgcggtcgacggtcaggatgccagcagcgtagcgaccgaatggctgcagcagaaaaagctgctgtaaccgatgcagatatcgcgggaagcgatacgccgtccggttgagcagccggtggcactgctgctgctgacgctgctgactctggcgctggtggcattgccgtttctgaacttcgccccgaaccgcctggtggcgggtgaaccgctgatgggctggcagattagccgcttcgggctgttgctgctgccgctgttgacgctgtggctgctgctgtggcggcatccgacccgcatcacgctgatgctggcgctgctggcggcagaactgatgctggcggcgatcatctggctcagcggtcatcaggccactttactcagccagcagggcagccgtctggcgcgcaccagctttgccagcggattgtggtgcagcggcgcgctgatcctgctgctgatcaccgatcaggtgcggcaactgacccgccatcggctggcacagctgctgctcaatctgcaggtctggctgttgccgctgctgctgctgttcagtggccagctcagcgatctctccctgctgaaagagtatgccaaccgccacgcggtgtttgatgccgcgctgagccgtcatctcaccctgctggcgggcacggtggtgcctgcgctgatgattgcgctgccgctgggcgtcacgttgttccggcggcctggctggcagggcggggtgttcggtgtgctgaatgtgattcagactgtgccctcggtggcgctgtttggtctgctgattgcgccgctggccggactggctcagcagtttccgtggctcggcgactggggcatcagcggcattgggatggctccggcgctgatcgcgctggtgctttacgccctgttgccgctggtgcgcagcgtggtggtggggctgcaacaggtgccgcacgaggtgcgtgagagtgcacgtggcgtcggcatgagtggctggcagcagtttattgcggtggatgtgccgctggcgctgccggtctggctggcgggcctgcgggtagtggtggtgcagacgctgggcatggcggtggttgcggcgctgattggcgcgggcggctttggcgcgattattttccagggactgctaagcagtgcgcttgatttggtgttgctgggggtgatcccggtgattgcgctggcggtggtcatcgatgcgctgttccgcctgctgatctcactgctggagagaaaagatgattgagtttgacggcgtttcccgcgcgtttaacggtaaagcggcggtgaaagatctgtcgttacaggtggcgaaaggggaattttgcgtgctgcttggcacctccggttcgggcaaatcgaccaccctgaagatgatcaaccggctggtggagtttgacagtggtgaaatccgctttgccggagagttgattcgccagctcgatgcccgcacgctgcggcggcgcatgggctacgccatccagtcgattggcctgtttccgcactggacggtgcggaagaatatcgccacggtgccagtgctgctgggctggccccgggcacaggtcaatgaacgtatcacggcgctgctggcgctgcttaatctcgatgcgcagctgctggaccgctatccgcatcagctctcgggtgggcagcagcagcgcatcggcgtggcgcgggcgctggcggcggatccggaagtgttactgatggatgagccgtttggtgcactcgacccggtgacgcgcggggtgctgcaacaggagatgttgcgcattcatcaactgtcgggccgcaccatcgtgctggtgacgcatgacatcgacgaagcgctgacgctggcggaccgcattgtgctgatggataacggcgagattgttcagcagggcaggccggtggagctgctcacccagccgaaaaatgattttgtgcgcgacttctttggccgcagcgaaatgggagtacggctgctgtcgctggagcaggtcggtaatgccgtgcggcgcggcgagtggctgccgggcgaaccgatcgctgcggcactgacgctgcgctatgccctgtcgcagtttatcgcccggcgtaccgataaactgccggtcattgacgatcagcagcggccgctgggcgtgctccactttggcgatctgctgcaactgcgcgaggatttaacatgcgcaggctaagggatccgctgctgtggctggtgctgtttctacggcgcgctgctgaccctgatgccttgcagtgggccgctgtttcaccgctggtttcccgaactggcgcggccactctatcagcaggagagcttctggcagctgacgctggcgcatctgtttctggtgatcaccgccagcctgctggcgattgtgattggcatcggcagtggtgtgctggtgacacggcgggcggggcgggccttccggccgctgatggaaaccattgtggcggcagggcagacgattccgccggtggcggtgctggcaattgcggtgccggtgatgggatttggcgcctggcccgcagtcgtggcgctgctgctctatggattgctgccgattttacaggggacgctggcgggtattgatagcgtaccggccagcagtcgggagatcgccatcggggtcggcatgagtagctggcaacggctgtggcagattgagctggcgctggctgcgccggtcatcatcgccgggatacgcacctcggtgatcatcaacatcggcaccgctgccatcgcctcgacggtcggcgcgaaaagtctgggatcgccggtgattatcggcttaagcggctttaatacagcctatgtcattcagggggcattactggtggcgctgctggcgatagtcagcgatcgcctgtttgaacgcctgcagcgctggcttagcgtgagtgaacgatgagagagtatcccaccagcatcagaccgccggtgccacctgccgccataataaaaaacagcgtggcgaagaaagcttttttacagttcatgggtaaaacctgagctcgttaacagtgaggcggggataatagcgcgcgcaaggcagcaggcaaagtgcccggcgtgcgtttttgttatcaggcgggatcgtgcaaccgcacggcatagccctgttcctgccagtgtgacagctgttcctgctggcggcgggtcagttttttaccggtaaagacaaacatattcatgccgggaaagagttcaggacgcggtaaatccagcggttctgccagcacatcaatccgccagccatgctgcgacagacgccagccttccagccagattcgggtacgatcgtcgataccccagccaataatcagcgcatctttacccgattttttgcggctgccggtcaggcagaacgcgacataatcgatcagcaaaccatccagcagactgcacatggtgcgggcggtgttctggtccagactcagcttctggcgcaccggcataaaaacatggtcgatcagcgcatcaatcggatgttcgcgaccaatcgcggcaattttattacgaagtttagcgggtctgacatgacgcaggacgctgatcagctcatcctggagtgtggtccagccgtcatgggcatctacatcgccaccttccagcagtgccttaactttaccgaccggcacgccgctttcaatccagcgcataatttcttcgatgcgatgaacatcttcttcgtcaaactgacgatgtccgccttcggtacgttgcggcttcagtaagccataacgacgctgccaggcgcgcagggtgactgggtttatgccacagcgctcggcgacgtcaccgatactgtataaggtcataaattcctctttcgattggtctgagtgcaattaccataacgaagccgactaagttgtacaatacatttctcgatgtacaacttgactgatacgccgtttctccgttatatctcatataagagaattattcccaaatatgagaaatcaccatgtcagagctgaatacggagcaacgactggcggtgaggctggcagaattacgcctgcaacgcggctggtcgctggatgaacttgctgtcgcaacgggcatcagtcgtgcgtcattatcgcgcattgagcgaagcgagaccagccctactgctgcgctgcttaaccgtctgtgtgttgcctacggattaacgatgtcgcgcctgctcagtgaagtggaggaggagtccagtttgctgatcagagatgaccagcagcccgtgtggcaggatgaatccagcggatttattcgccggaatgtttcacctcctgcgcttcatttccgatgcgaactggttgagggcaaattacggcccggtgcacgtatagattacgatgcgccacccattcaggggctggagcagcatatctggctacgcgaaggcggcctcaccgtcacgatggggccgcagcagtgggcgctgaagcccggtgattgcttacgttttcatctggtcgggaaatcggcttttgaggcgcacctgactgacggcgcgcgctatttactggtggtggcgaaaccatgatcgattacagaatacttcgcgccgacgaagcgcaaccgcaattggatgaactcacagcggtgctgcagggctgtgtggcagacggcgccagcgtcggctttattgatgctgaagacgaagaggtgatgacgcgattctggcagcagcggatcgccggtctggcagagggcgacagcgaaactattcgttgcgcggcagcacggtcgcatcgtgggcacggtcattctcagtggcagcgcgatgcctaatggccgccaccgggcggagatcagcaaattgctggtgcatccgcaggcgcgccgtcagggcatcgcgcgtgagctgatgcagcgcgctgagcagcaggcccgtgcgcagggcaaaacgctgctggtgctggatacgcgcagcggcgatgtcgccagcgatctctatcgctcgctgggctggcaggtggcggggtcgatcccgttttatgccgaatccaccgcgggcgtgctggatgccaccacctatatgtacaaagtgctggcgtagccagccgctagctcatgcggctggcctttcttcgtgccggaccggcccgggttgacgggctgcccgcacgaccctgaaacgggcaactgctgaaatttacgacgtcgcacgaaaaattcggcgcgaaagctgacgccaacaggatactgtgtaaaaatacaggccatattttcggtgtggtaacgcaaatcatggccctgacagccgcagtaaaaagccagatagcgcagtggtataaagcgcttcaggagcaggtgcctgacttcatcccacgtgcgccgcagcgccagatgatcgccgaagtggcgaaatgcctggcgggcgacgattcgcgccatctggcggttgaagcgccaaccggcgtgggcaaaaccctctcttatctgatcccgggcatcgccgccagccgcgcccaggagaagcggctggtgatcagcaccgccaacgtggcgctgcaggatcaaatcttcaccaaagatctgccgctgctgaaaaaaatcattcccgatctcacctttaccgccgcctttggtcgcgggcgctatgtctgtccgcgtaatctggcggcgatggcggctgatgacgatgagcagggcgatctgctgctttatctggacgatgacgccgtcagcagcactaaagaggagcagacgcagtgtggccggttgcagaaatcgctggatcgctatcagtgggacggcctgcgcgatcacagcgacgagaaacgtcagcgacagcctgtggcagcggctctccaccgacaaagcgagctgccttggcgcacactgtcgctggtatcgtgaatgcccgttctttgtggcgcggcgcgaaatcgagcaggtggatgtagtggtggcgaaccatgcgctggtcatggcagcaatggagaatgagtcggtgctgccaccggcaaaaaacctgatgctggtgctggatgaagggcatcacttgccggaagtggcccgcgatgcgctggagatgagcgccgacatcacgccgggctggagcagcctgcagctcgacctctttatcaagctggtggagagcatcatgacgcagatgcggccaaaatcgccgccgccgctggctaacccggagcggctgaaagcgcactgcgatgagctgcgcgaactgctgacgattaccgctcaggcgctgaatccgctgctgccaccgcataaccagccgggcgaattccgctttgtgctgggcgcgttgccgcaggagctgctggatctctgcgcccggctctttaagctcagcgatgcgctgcgcggcctgagtgaaggtttgattaatgcgctgagcgagcagaccggcaaggtggatgtggtgcgactgcatcgcaatctgctgcagctcaatcgccagtttggctggttcgaatcggtcagcaaactgtggcggctggcggcgatggaaaaagcctctggcgcgccggtatcgaagtggatcacccgtgagctgcgcgaaggtcaggcgcacctgctgtttcactgcgctggcatccgcgtcagcgaccagctggagaagatgctgtggcgtaaaattccgcacgtggtcgtgacctccgccaccctgcgatcgcttaacagtttcaaccgcctgcaggagatgtcgggactcagcgagaaggcgggcgaccgatttgtggcgctggactccccgtttaaccacgtggagcagggcaagctggtgatcccgcagatgcgctatgagccgctgatgacgcatgaagcggagcatatcgcggagatggccggtttcttccggcagcagatggcggagaaaaagcacaaaggcgtgctggtgctgtttgccagcaaccgggcgatgcagcagtttgtcgcctgtctgcccgacctgcgcctctcaatgctggttcagggcgatcagccgcgcagccgcctggtcgatctgcatcgtcagcgcgtcgccaaaggggaaaccagcatcctgattggcctgcagtcgtttgccgaagggctggatcttaaaggcgatctgctgagtcaggtgcatatccataaaatcgcttttcccccggtagacagtccggtaattttgaccgaaggcgagtggctgaaaagccttaaacgctatccgtttgaggtgcagagcttacccagcgcctcttttaccctgattcaacaggtcggacgcctgattcgcagccatcaatgttatggcgaaatcgtcatttacgaccgccgtctgctgagcaaatcctacggcagccggctattagcggcgctgccgatcttcccgattgagcagccggaaacaccagagccggcagcgataccggccaccgtggtgccaaaaaatacggtgcgtaaacgacgtcccacgcggcgctgagccgcgcacttaaccggaagcgagtgatggaactgaataaaatcattaaagagattggtcgcggtaaaaatcatgcccgcgatatcgactttgatactgccgtggcgctctatggcgcgatgctggcgggcgaggtgccggacctggagctgggcggcattctgattgcgctgcgtattaaaggcgaaggcgaagcggaaatgcgcggcttttatcaggcgatgcaggcgcagatgatgcaactgcaggcgccggaaaaccgcccgatgccgattgtgatccccagctacaacggtgcgcgtcggcagggcaatctcacgccgttgctggcgctgctgctggtgaaactcggcttcccggtgctggtgcatggcgtcagcgacgacgcgacgcgcatcaccagtgaagcggtgtttgccgcgctgggtattacccccgtcaccaccgcagaggcggcgcaggcaaaactcgatcagggcgaactcgcctttatcaccatcgatcatctctgcccgccaatggcgaaacagctgtcgctgcgctggcgaatgggcgtgcgtaacagcgcgcatacgctggcaaaactggcgaccccgtttgccgaacgtgcggcgctgcgtctgtcgagcgtgtcgcatccggagtatgtgccgcgtgtggcgaaattcttcagtgacatcgatgcgcctgcgatactgctcaatggcaccgaaggggaggtctatgccaatccacagcgctgcccggcgatcagcatgattcagggcgcaggcgcggaagcggaagtgtgggttgagcgtcagcccgaagtggccgttgaactgccggccgataagacggcagaggtaaccgcgcgctggattgagcaggtgctgaatcagcagcggccggtgcccgcatcactgcgactgcagctcgcctgctgcctgcgcgccagcggccagtgcgactcgctggcggcggcagagcagcagatcctcgccgccggttactgactcaggctgctggcagcgcctgttcaaccaggttctgccagaaagtaatgccaattggcagcagcgcgtcgttgaagtcatagcgggcgttgtgcagcggggcggaaggcgtgtcgccatccgcgcccagccagaagtaggcacccggacaggcctccatcatgcaggcaaaatcttcagacgccattgacggattgacctgccactgaacctgttcggcccccagcgtcgccagcgccacctcgcgcacctgctcagccggggccgcatggttggcggtcaccggatagcccggtaaccactcaatctcaccgctgacgccaaacggacgtggcagggtagcgacaaactcatcaatcagcccgcgtactttttcgcgcacgctggtctgcaggcagcgcaccgtgccgcgcagcacaatctgttccgggatcacattgatcgcttcgccaccgtggatctgcgtcacgctaaccaccgccgaggcgagcggcgagagccgacgtgacggaatcgtctgcagcgccagaatcagctcagccgctaccaccattggatcggcaccgctttccggcatcgccgcgtggcagcttttgccgtgcagggtaatctcaaacgaatccagcgacgccatcatggcgccagggttaaccgccagtgaccccagcggcaggcccggccagttgtgcatcgcatagatcgcatccatcgggaagcgctggaacagtccctcttccaccattttgcgcgcaccgcccaggttctcttcggcaggctgaaaaatgaaatgtaccgtgccgctgaactggcgtgtggcggccagctgtcgggcggcggccagcagaatggcgctgtgaccgtcgtgcccgcaggcgtgcatcacgccgggagtggcggagcgccattcagtgtcgcctttttccgtaatcggcagcgcatccatatccgcacgcagcccgataaccgggccgggaccgttttccagcgtgccgattacgccggtgcccgccagaccgcgaaacacctgcaatcccgcccgctctaactcatcagcgataaactggctggtttgctgttcctggtaacctaattcggggtggcgatgaaactcacggcgccagcgcagggcatcttcaagcagggcaggggaaagggtcatgcagagtcgcgctccatacagaatgagaagatttcactttagaggtcgggtggcgctgcgtctatcgccggcaggacgaaatctggctataggctaaatcaaaatggaataagtaataaggaagtgatgtccgggcagggcttcagaagggaaaaatgcgaagaaaacggggcaagccactgcccgccccgttcagcgtattacttctgcatcggcagattcaggtcatgctctgccgcgcaactttgtgccagctcataacccgcgtcggcatgacgcatcacgccggtggccgggtcattccacaacacccgacccagacgcgcatccgcctctttgctgccgtcacagacaatcaccataccggcgtgctgcgagaagcccataccgacaccgccgccgtgatgcaggctgacccaggtcgcaccgcctgcggtgttcagcagcgcgttgagcagcggccagtctgagatcgcatccgagccatccttcatcgcttcggtttcacggttaggtgaggcaaccgagccgcagtcgagatggtcgcggccaatcaccaccggcgctttcagctcgccgttgcgcaccatttcattgaacgccagaccggcaagatgccgtttcgcccagtcccagccagcagatacgtgctggcagtccctggaaggcgatgcgctcctgcgccatatcgagccagcgatgcagcgttttgtggtgcggaaacagttctttgagtttcgcgtcggtcttgtagatatcttccggatcgccggacagcgccacccagcggaacgggccttttccttcgcagaacagcggacggatgtaggccggtacaaagccagggaagtcgaaggcgttgctgacaccctcatccagcgcgacctgacggatattgttgccgtaatccacggtcgggatgcccatatgacagaagtcgagcatcgcctgcacgtggaccgccattgaggcacgcgccgctttctccactgccttcggctgtgagacgcgttcctgctgccagcgcgccagatcccagccagccggcagatagccattaatcggatcgtgtgccgaggtctgatcggtgacgatgtccggttttggcccgcccgcccgggcgcgtttcaccagctccggcaggatctcggcggcattgcccagcagcccgaccgaaatcgcttttttcgccgcggtcgcttcgctgattaacgccagcgcttcatccagcgtggtggctttgtaatctacatagcgggtacgcaggcggaaatcgatgcgcgactcctgacactcaatcgccagcacacaggccccggccagaacgcccgccagcggttgcgcgccgcccatgccgcccagtccggcggtgaggatccagcgtccgctgaggtcgttgttgtagtgctgacgtcccgcttccacgaaggtttcataggtgccctgcacgatgccctgcgcgccgatatagatccaggaaccggcggtcatctggccgtacatcatcagacccgctttatccagctcatgaaagtgatcccaggttgcccagtgcggcaccagattggagtttgccagcagtacgcggggtgcatccgcatgggtgcggaagatgccgaccggcttgccactctggatcagcagtgtttcatccggctgcagtgcccgcagcgaacgcaggatctgctcgaagcactcccagttacgcgccgccttaccgatgccgccataaaccaccagatcttccggccgctcggcaacatcgggatcgaggttgttctgaatcatgcggtaagcggcttcaatcagccagttggcgcagtgcagcgtggtaccgtgaggcgcgcgaatttcacgtgccacagcctgagaaagagtttcgctcatgaaagattccttaattcaagaagttgggcgcatgctcggcagcagcgcggtcaatgcctgaggccagtcagtgcgacttgcccactgacgcattgcctcgatatcgggagccagcaggcgatcctcctcaaggaaggcgacctgctcgcgaatggtgtcgatggcctgctcaatcagcgcagagcttttcagcggccggttgaattcaatgccctgtgcggcggccatcgcctcaatgccgactaccgcggcgctgttaaagcacatgctgccgagacggcgggcggcgtaggttgccatcgagacgtgatcttcctgatttgcggaggtcggcagactgtcgacgctgcccggatgggccagcgatttattctcagaggccagcgcggcggcggtcacctgggcgatcataaagccggagtttacgccgccgtcgcgcaccaggaagggcggcaggcccgacaagccgctgtccagcagcagcgccagccgccgctcggagatggctccgacttcggcaatcgccagcgccaggatgtccgcggcaaaggccaccggttcggcgtggaagttgccgccggagatcacatcgccgctgtcactgaacaccagcgggttgtcagaggccgcgttcgcttcgatttccagaatccgcgcggcgtggctgaagttgtccaggcaggcacccatcacctgtggcacgcagcggatggagtagggatcctgaaacgcggccgcaatgcgtatgcgacagcactatttcactgccctcaatcagggtgctgacggcagcggcgaccgcaatctgaccatgctgaccgcgcgcctgatggatacgggcgtcgaacggttttagcgagcctttaatcgcctccagcgacagcgcaccggccatcagaccagcggcaaacaggttttcaccctcaaacaggccgcgcagcgccagcgcagttgagacctgggtgccgttaagcagcgccagtccctctttcgggccgagtacaaatggcgacagacctacgcttgccaggccttcggttgccgggatcaactcacccctgagccggacctgaccttcgcccagcagcatcagggacatgtgcgccagcggtgccagatcgccggaggcaccgaccgagcctttttccgggatgcagggcatgacacccgcattaaacagcgccagcagcgcctcaaccagttcgattcgcacgccagagtgaccgcgtgccaggctgatgattttggtggcgaccaccaggcgggtaacattgtcgggcagcagatcgcccagcccgacgctgtgtgacagcaccagattacgctgcagatccgccagccggctggccgggatttgcgtctgcgccagcttgccgaagccggtattaatgccatacaccacgttgccggaggcgacaatcgcatccacggtctgctgcgccgccgcaatcgcctgacgcgcgggctcatcaagcgtcagtgtgacgttgccctgatagatagcgcgtaatgtggcgaggtccacctcgcctggcaccaggcgcaaaacctgaaacgaacctgacatagtctactcctgtctatacaagtgtgctggtgtggctaaactgctctccttgccctgatccagcggaataatacgagtgaaacataagcgttaattcttgtctatgcttgtctatacaatcaaagagagcaagcaagtgccgtgccaggccgatcacaaaaatcgattgcccgtccgctgcgggttgactatttagcgctactcagaggctgcaccatcaggatgcgcaggctgcaccattggggcaccgcgcagcgtactggatgtatatacattcacacggtgagacagtaaacttaggggactttcagcataaggaacagcaaatggttgagcatacggcactggcacaactggcggcggcaatgagcgatgagcctgccccgatttatcagcgggtgaagcaggccatcgtcagccagatccgtgaagggttgtggaaagcgaatcagcgtgtgccatcagaaagtgaactggtgaatgaactgggcgtcagccgcatgaccattaaccgggcgctgcgtgaactcaccagcgaaggctttctggtgcggatgcagggcgtcggaaccttcgtggcggagatgaaaggctacaccgccatgctggaggtgcataacatcgccgatgagatcgctcagcgcggccatcagcacagctgcaaaatcctcgccatcggtcaggacaaagccgatcctgagcaggcggcggtgctgggactgaccaccgggcagacgctctatcattcgctgattgtgcattacgaaaatgatctgccggtgcaactggaggaccgtctggtcaatccgctggtcgcgcccgattacctgacgcaggattatcagcagatgacgccttacacctatctgatgcgcgtcgcgccgctgacggcgggcgagcacattgttgaagcggtgttgcccgatgcgcgtcagcgtaaacatctgtcggtggatgagcacgaaaccctgcctgctgattcgccgtcagacctggagcgacactaaaatcgtgacctatgcgcggctgctctatcccggctcacgttacaaactactgggccgcttcaggggacacggttaagacgggtaaacagcagccgggcatcggtatcgcacgggctgagtgctgtttcttcatcgacccaccacgcgccctgctgcgcggtcagccgttccccgtcagccgtctgccatgcgccagccagcacccaggcgacgccatgcagagtgctgactggcgtggtcaccacctccaccgctgcctgccattccccgcgccgcgtcataatattaaaatcttcgctgacgctgccctgcagctttgccgttaaggcgagttcgccggcaaacgcccagggctgctgaggcgtcagtaagtgctgcccgcccggcgcggtcagcaacaccggatcgccatgcagcagggtaatcacccgatcaatgtcaggaaaggcagagaagggaccatcctgcgccagcgtcgcaatgctggcgcgccagccgaagcgctccgcgccgggtggaaagctgatgatttcgcgggtttcgccgccgccgttgcgccagcggctgaccgccagctccgcgtacgtgaaccgggcgatcatcgcagcgcctccatcgcctgagcaaagcgggcggcacacgccgtctggtgcggatgcaccccatcttcaaccacggctttacccgccacataaacgtcccgaatctgatcgcgctgcccggcaaagagccagcggttgaggacggcgtgcgacccgacgctgccgagccacgcctcatcccgcagcaccagccagtcggcacgttgtcccaccgccagcgtgccctgctgaatgccacacgcctgcgcaccgcccgcagctgcctgttgccacagcagatcgcctaccgacggctggccgggcagggtaatccggttgcgacgctggtcgcgcagtcgctgagcatactccagccagcgcagctcctcctgggcgctcagcgagacgtgactgtcagagccgatgccccagcgtccgccctgcgcgatgtactccactgccggaaagatgccgtcaccgaggttggcttcggtggtcgggcagagacccgccactgcgccactgcgggcgagacgcgccagctcactctcatccagatgggtggcgtggatcaggcaccagcgcgcatccacctcaaagcggttcagcagccaggccaccggacgctcgccgctccacgccagcgagtcattcacctctttctgctgttcagccacatggatatgtaccggcagtgtcagatcactggccgccagcacgtcctgcatctggctttcactcaccgcccgcagtgaatggaaacagaggccacggttcagcagtggcctttgctgctgccacgcatcaagccgcgcctgctgttgcagatagcggtcggtctgctggataaaacgcttctgacccgccgacgctggctggctgccgaagccgctgtagctgtagagcaccggcagcagcgtctggccgataccggcgatctccgccgcttcaatcagctgttgcagcatcgcatcatcactgtagggcgcaccctgtgtgtcgtggtgcaggtagtgaaactctgccacctgggtgtagccgcctttcagcatctcgatgtagagcagggcggcaatatcgcccacctgttgcggcgtcaggcgctgcaccatgcggtacatcagatcccgccacgtccagaaactgtcctgaggatcgcccgccacttcagccagacccgccatggcacgctggaaggcgtgcgagtgcaggttggcgattgccgggatcacctcgccgttgagccggatagcctgatcagcgtggctatccggggtaatggagtcgataaaaccggcctgattgaccgtgatacgcacctgctgctgccagccctccgccagcagggcacgcgaggcaaaaaaagtcgccatggttgatcctcatcggatgtggttgtatatacatatacatactttgaggcacagtgtaaacggcggaggcatgaggcagcgatggcagaagagatgcgcgtagagacggtgtggaccggggctgacctggtcaccatgcgtgacggaaagtaccatcttatcccgcagggcgcgctggcggtgcgggcgggcaggctggtgtgggtcgggccgcaggcggagatgcccgcgttcgtcgccgatcagcatcatcatctgccgggcggcatcgtgaccccggggctggtggattgtcatacccatctggtgtttggcggcgaccgcagccaggagtttgaacagcgcctgaatggcgtcagctatgcagagattgccgcgcagggcggtggcatcctctcaaccgtgcgcgctacccgcgccgccactgaacaggaactggtggcatcggctcgctggcggcttaaccgcctgctggccgagggcgtcaccaccgtggagatcaagtccggctatggtctggatgaagagagcgaactgcggatgctgcgggcgattcgcgggctgggagagagcgtagccgctgacgtgcgcgccacctgtctggcggcacatgcttttccgccggagtttaagcacgacccggatggctgggtcgatatcatctgcgaacggctgctgccgcaggtgcaggcactgggactggcggatgcggtggatgcgttctgcgagcatctcgccttttcaccgcagcaggtggcgcgggtgtttgatcgggcggtggcgcttggcatgccggtgaaactgcatgctgagcagctctcggcgtcaggtggcgcagcactggcggcgcgctatggggcgctctctgccgaccaccttgaatatgccaccgaggaggatgccagagcgatggcacagcatggcaccgtggcggtgctgctgcctggtgcattttatctgctgcgggagacgcagcgtccgccggtagatctcttccggcgctatggcgtgccgatggcgctggccagcgatgccaatcccggcacctcgcctgcgctgtcgctgcgtctgatgcttaatatgggctgtaccctgtttggcatgacgccggaagaggcgctggcgggcgtcacgctgtggggggcaaaagcgctggggctggctgacagtcacggctcgctggaggcgggaaaagtggcgaacttcgttcactggccgctggcccgtccggcagaactggtttactggctgggtggtgaactgccctgtaccgttatctatcgtggagaaccgcaatgaaccctttccattttacccagggcagtctgccgctgctggtcagcattccccacgccggtaccgagctgacgcccgacgtggaagccggactgagtgaggccgcgcgcggcttacccgacaccgactggcatattcccctgctgtatgattttgtgcgtgatctcggagccagcgtgttaatcggccgctactcccgctttgtggtcgatctcaatcgcccgcccgataaccagccgctctacaccagcgccaccaccggcctgttcccggaaaccctgttcgacggtacaccgacctttgcaccaggcaaaacacccgacgacacggcgcgtcagggctacatcgatcagatctggcagccctatcatcagcagattcaacaggagctggcgcggctcaaagcgcagcatggctatgcgctgctgtttgacgcccactctatcgccagtgaaattccccgcctgtttgacggccgtctgcccgatatcaacatcggcaccaacgacggcgcaagctgcacgcctgcaatgagtgcggcgctggaggccgtgtgcgcggcgcagaacgactacagctgggtgattaacgggcgctttaaaggcggttacatcacccgcgcctacggtcagccgcagcagcagattgagtcggtccagctggagctggcgcagctcaactatatggatgaaaccccgccttacgcctggcagcaggcgcgtgccgcccggttgcagaacgtgctgaaggcattgatccacgccatgctggcgcaggctaaatcgcaataaaactcaccagagcgatgcgccactccggtgcatcgctgccctgattaagtgcagcggcgggcaggtcgcctgcccgctcccaggctaccgccgcttttttccacctctgcagagctggcataacctttgcttggttgtatgtacaagtgcagcagcaccgccatctgcgtaataaattctgtctggctcacaaaacgataaagccggcaatgaactgcgctgcgttaacttgtatatacatgacatatcatcctgtgaaatttatgttaaatctcgtcagggcgatcaccaggccgctactttcaggagaaccgtatgacgcaccctctgactcttcgtcgtttatgtctcactacgctggtttccagcctgctgctctgtggcgtcagcgcccaggccaaagagtggaagtcgatcaccattgccaccgaaggcagttatgaaccctggaacctcaccctgccaggcggcaagctgggcggttttgaaccggagctgatggccgatctctgccagcgtatggcaatacagtgcaagctggtggtgcagaaactgggatggaatgatcgccggtctgaatgccggaaaatatgacgtgatcatggatgcaattgtgatcacccccgagcgcaagaaagtgatcaatttcaccgtgccctacgcctctacgcccgccaccttcatcacggtgaaagggtcgttgctgcctgccgacagtaagatcatcaaactcaccgacgatgagaaaaccgtggagccagccatcgcacccctgaaagcggcgctgaagggcaaaaccatcggaatcgcctctggcaccgtctacacgccgtttatcgacaagtacttcaaagaggtggcggatgtccgggaatacaccagctcagccgatgcgatcctcgatttgcaggcggggcgtattgacgcggtgtttgacgatgtgacctttgcgcagtcgatgctggcgcgaccggataaccgtaacctcagctttagcggtccgcagctgggtggcccaatctggggtgagggcgaggcgatgggcgtgcgcatggcagacaacgatctgaaagcccggctggatcaggcgatcaaagccgcgctggccgatggcacagtgaaaaagctgagcgagaagtggttcaaaactgacgtcacaccctgagtgaggtaactgatgataagcctgctgagttttggcccggagggctggggacggttgattctgagtgccacgctgacgacgttgctgctctcatttgccgcgctgctggtcggtgcggtagtgggatcgggcgttgccgctgcaaagttatccccgcaccgcgcggtgcgctgggcaggggaaggctactcggtgatctttcgtggcatccctgagctgctggtgatctacctgttctacttcggcggatcgggattgatcacgcagatcggacaactgtttggcgcggacgggtttatcgaagcgccaccgtttctgatcggggcgctggccatcgggcttatttccggctcttaccaggcggaagtctatcgtgccgcacggctggccctggcgaaaggggagatcgaagccgctgtcgctattggtatgccgcgctggcgcatccggcaacgcatcctgctgccgcaggtagcgcgctatgcgctgcccggcctgtcaaacgtctggcagatgagcctgaaagactcggcgctggtgtcagtgaccggcattgtcgagctgatgcgggccagccagattgcggccggctccacccgtgattacttctccttttatctggtgggcggtgcctgttatctgctgctgacgctgctgtcgaaccgcgcctttctgcgggctgaatcccgtcttggtcgcgcctggcaaagccgcaccgctgcacagcattaaggagatttatgatcgatttcgcgttcctcactgacaccttcctgaaactcagcgccgcgttgccggttacgctgggcctgtttatcagcgccttcctgtgcggcggcgtgctggcggtgggtattctggcgctacgcatgagccgctggcgtctgctgagtgcttttgcccgtggctacattctggtgtttcgcggctcgccgctgatgatccagctgtttctgatctactacggtctggggcagtttggtgtgatccggcacagtctcttctggccgtttctgcgtgagccctttacctgtgcggtgctggcactgtcgctctgcaccgccgcctacaccgcggagatcctgcgcggtgcgctgctggctgtgccgcccggtcaggtggaggcggggatggcgtgcggcatgtcgcgcgggctgctgctgcggcgcattatcgcgccggtgatgctgcgttatgcgctgcccgcttactccaccgaggcgattctgctggtgaagtcgaccgcgctggccagtctggtcacggtctgggatgtcaccggggtggcgcagcagattatccagcgtacttaccgcaccatggaggtgtttctctgtgcggcggcaatctacctgatcctcaacttcatcattgtgcaactctatgccctgctggagcggcgtctgacgccggttcataaaccggaaaaaaagccgttaccggccgctaagccgattcctggaggaaaataaacatgtctgaactgccacccgtcacgctgtcggccagcgatatccataaatcctttggcgccatggaggtgctgaaaggcatctcgctgcaggcgcaccagggcgatgttatctcaatactcggtgccagcggctcgggcaaaagtacgctgctgcgctgcattaatctgcttgagacgcctgacgcgggcgtggtcagcgtgggcggtgaaaccattgagatgaagcgccatgcccggggacaccagctggcggctaacccgcgtcagattgagcggctgcgctcccggctcggtatggtgtttcagagctttaacctctggtcgcacctgacggtgctgcagaatgtcattgaagggccgcactacgtcctcaggcgcgataaaaaagcctgtattgcccaggcggaacagctgctggatcgggtcggtctgctgaatcgcaaagatttctatcccgcccagctttcaggcggtcagcagcagcgggtggcgatcgcccgggcgctggcaatggacccggaggtgatgctgtttgatgagccaacttcggcactcgatccggaactggtaggcgaggtgctgaaggtcatgcgcagcctggcggaagagggccgcactatgctggtggtgacccatgagatgggttttgcccgcaacgtctctaaccgggtggtgtttatgcatcagggcactattgattgtcagggcacgccagaggcgatgttcggcgaggcgggatcggcgcgctttaagcagtttatctccagtcatcatcaggtggagccggtggtatgagcgacgtaatacgtcagacgctggtctggggcgatggcccgctgaaatggcaggcgctggtgcaggtcgcccggcacggcgccaccctgatgctgagcgacagtgcctggcagcgcattgcgcagagccgtgaaatcgtcggtaatatcgtggcggcggggcaggtggcttacggcatcaataccgggctgggggcgttgtgcaacattaccctgtctgaagatgagctgagccagctgtcgcgcaataccctgctgagtcatgcctgtggtgtcgggccggtgctggcaaaacccgaggtccgcgccattctgtgcgctgcgattgcgaactacagtcacggcaaatcgggtgtttcagtggcgctggtgcaacatctcctggcgttgctaaacctgcagattacgccacaggtaccgtcgcagggatcggtgggatatctgacccacatggcgcatatcggcctggcgctgattggcatcggcgaggtggagtggaagggcgaaatcgttccggcgcagcaggcgctggcccaggcgggattagccccttaccggcctggtgccaaagaggggctgagcctggtcaacggcacaccctgcatgaccggcttagcctgtctggcactggacgatgccgaacggctgctggactgggcagacgtcaccggtgcgatgagctttgaggcgctgcgcggtcagctggtggcgtttgaccctgaggtgctggcgctgaaggccagcccggggattcagcgcagtggcgaacgcctgcgccagttgctgagtgacagcccgctgctgaaagccagcgttggcatccggactcaggatgcactcagtctgcgctcgatgccgcaggtgcacggcgcctgtcacgatcagtttagtcacgctgtccgtcaggtggagaccgaactcaacgcctgtaccgacaatccgctggtgctggggacgccgcaggcctggcgcgtggtgtcacagtccaatccgcatggcgagtcggtggcaatggcctgcgacctgctggcgattgcgatggcggagctgggcagcatcgccgagcgacggcttgatcggctggtgaatccgctggtcagcggcctgccgccgtttctggtggccgagccgggcgtcaattccggcatgatgattgcgcagtacgtggcggcatcactctgcgcggagaaccgtcagctggcgcagcctgcggtgcttgataactatgtcacttcaggattacaggaggatcatctgagcctcggcaccggctcggcgctgaagctgctgaaactggtcagcaatgttgatcacattatcgcgattgagtatctgctggcggcgcaggcgctggagtttcacggtgaatcacagctggcagcaggcacgcggcgcgcctggcagcatttgcggcaggttgttgagcgctggcagcaggatcgctggctggcacccgacatcgcctgcgcggtagctcagattaaagcgcaccgggccgatgcgcttgtggggtgaggattacctgcggcgcgcgtccggacggactaaatcaaaacgttgcgcttcgctgatgccgtaataggcgctggggccgcccgcgcgcagaatcggctcggctttagcggtctgataaatgccctcttccagcagcgattcatcgatgtgaatcgccaccgcttcccccagcaccagccagctgtcgatcagattgccgctggcatcctgcagctgaatcagttgcgtcagtcggcactcgaagttgaccgggctctctgccaccagactggcgctgacctgtgaagccgccagcggcgttaaaccggcaaaggcgaactcatcctgatcggcaggcagcgaggcggaactttcgttcatcgcttccgccagaggacgcgtcgccaggttccagacaaactctttggtctcagcaatatttctcacgctgtctttccagccactactggcgaaaccgataatcggcggatgatagttgaagcagttaaagaagctgtaaggtgccagattgcgctggccgctgctgctcactgagctaatccagccgatcgggcgcggcccgataatggcgttcagcggatcgtgcggcagaccgtgaccagcacggggttgataggaatagcgtttccgggtcataacttctccagcagggaattttatttatcttagcccgacagcatcgcccgacggaatcggaaagaggtaagcggatggtgcgggtttattttccgccgcctacagcgtattgtacgcgcgcctgaataattgagagaacgtatgaaaaagtcagccagcacgtcgcccttccacgcccgcaatcgccatcagggcgaatacgattttgccgcgttaaccgctgcccatccgccgctgaaagccaaagtccggcccaatgggtatggcgtgcagtccgtggatttcgcggacccggaggcggtgatgctgctgaaccaggcgctgatcaaactattttacgacatcgactggcagctggctcccggctcactctgcccgcccgtgccgggacgcgccgattatctgcactaccttgccgatctgctggcgctggataacaacggcgtgatcccgacggcggacgttctggatgtcggctgcggtgcaaactgcatctatccgctgattggcgcggcagaatatggctggcgctttaccggcaccgaagtcgatgaagccgccatcaaagctgctaaccgtattgttgcggccaatccgcgcctgacgcgccagatccgtctgcgtcgtcagaaaaacagcgatgcagtgctggctggtgtagtcagtaaaactgaatttttcagtgcagtaatgtgtaatccgccgttccacgcgtcggcggaagaagcggtatcgggatcgcagcgtaaggtccgcaatctcggactggataagagtgcgccgctcaactttggcggccagcacaatgagctgtggtatcccggtggcgaaaagggctttatcggcaagatgatcgccgagagcgtggcgtttagtcgtcagatcggctggtttacctcgctggtgtcgcgcaaagagaacttaccggcgctggaaaaacagctgcaggcgctcgacgtggcggagatgcgggtggttaatatggcgcagggtcagaagcagagtcgcttcctggcgtggagttttatgcctgccgcccagcgcactaaactactgagtcgcctggggaactgaggtgtcgctttacatggtaacaggtgtatctgtgggcgaagagtaaaatagaacgggccgcgatgcggcccattttgatcaggagacgtgctgcaggaattcgcgcagacgctcgctcggtgggttgctgatcaggctgtcgggatcgccatcttccgcaatccggcctttatcgataaagatcagccgtgaggccaccttctgtgcgaagcctacttcgtgcgtcacaatcaccatcgtcatgccttcttccgccagatcctgcatcaccttcagcacttcgtgacgcagttccgggtcgagcgctgaggttggctcatcaaacagcatcattttcggcttaactgccagtgcacgggcaatcgccacgcgctgctgctgaccgccggaaagctcagacggaaagtggtgcgcgcgctcggcgaggcccactttgcccagcaactcacgcgccagctggcgtgccgcctctttgctggcaccgcgcacccggataggaccaaaggcgacgttatccagcgcactcatctgtgggaacagatgaaactgctgaaacaccatgcccgcttcctgacgaatcaggcggtcatcgactttcggatcattgacgcgcaggccatcgacaatcagttcgccactggtgatctcttccagcttgttaatgcagcgcagcagagttgatttaccggaaccggatgggccgataatcaccaccacttcgccctggttaatcttcaggtcgatattgtgcagcacctgggtctggccaaaatgcttggagacatctttaaattcaatcacaggattttcacccttttctcaatgcggcgcagcacaaagctcaacaccagcgtaataaccagatagataatcgcgacggcgctccagatttccagcgcgcggaagttaccggcaataatctcctgaccctgacgagtcagttcagccacaccaataacgataaacagcgaagtatctttgatgctgacaatccactggttgcccagcggtggcagcatacggcgcagcgccagcggcataatcacgtagcgcagcgtctcgcggctcgacaggccaagcgccagtccggcttcgcggaagcccttgttgatcgacagcacggcaccacgagtaatctcggcaatgtaagcgccggagttaatcatgatggtcaccaccgccgcgctgaagggatcaatgcgcaggtcggggaacgccatcggcaaagcaaaatagataaacatcacctgcaccacgataggggtgccgcgaatgatttcgataaacaccagtgcgatgttattggtgatccagccaccgtaagcgcgggcaaagcccgctaccaggccgatgaagagaccgccaaccagtccaataattgaaataattaaggtcagtttagcgccttcaagcagcgctggcatggcgggccagatgacgctccagtcaaactccatggtgtcactccagatatgttgcgatggaaaaaagcagggaaaaagtttccctgctgaaatcagataacgggcaaattattatttaggttcggtgccgaaccattttttatagagcgtgttgtaggtgccgttctctttcagggttttgagtgcgccgttgactttttcacgtaaatcgtcgctgcctttcgggaaggcgataccatactgctgcgcttcaattgaatcgcctaccgctttaaagcggcctttaccggcggtatggatgaagtaaaggatgtttggcgtgtcatgcagcacggcgtccgcacggttagtgcccagctccatataggcgctgtcgatattcgggaaactgacgcagatctttggatttgatgttggctttcgcgtattccacggagccggtgccgcttttcactgcgaccactttaccgttcagatcgctgatgcctttgatgtcgttttcattgttacgcaccatcacctgcagaccgcttttgtaatagccgtcagagaactcaatcgcttttttacgttcttcggtaatggtgatacccgccagtgccagatcgacattgcgcgtttgcagtgcagggataatgccgctgaagtccattggcttcagggtgtaatcgagcttcagctctttcgcaatggcatcccacagatccacatcgaagccgacatatttgtcaccctgtttaaattcaaacggaacaaaggcggtatccgtggcgacgaccagcttcttgtctgctgcagtggaagagagagagaaggccagcgccagcgcggccacagaaacttttaacagtgacttcatcatttttccttttttttactaccaggcggcagggcctgcgtttgcggcttgtcatatgaaagaattatgccaactttgcaaaatccgcgaaatcagagagttaaataacatagctgacacgattttgcagttaattctgccattgcaccagtttggtgctcagttttggtgcaggtggctgttttggtgcaagcggtagtgtgcctcagatgttaaggctgtgaagcggaggagggaagaactgttaacagggtcataaaaatgcggtaacacagacgtaaaaaaggcgggtttccccgcctgacagactgcattgagtcttattcgatgttcgcttcgataaaccacaggaatttatcaaggtcacgtgatgctgcagtgaagatgtcagcggtatcttcgtctttcacttcagtgatcgctttacgggtgtcattcgcgacaacgctgtaacggtctgccagcgctttcagatgatcctgaaacgctgtgaatattcagcggatagctcttcagcggagtcgtatcgttaacgacctgcgtggtgcccagtgccacgccacccagctgaaccacacgctcggcaatagtatcctgatgatcggtaatcgcggtgcggaaaccgtccagcatctcatgcacaccgataaaattagcaccgcgcatgttccagtgcgcctgcttagtgatcaatgacaggtcaataaactcgactaccagacggtttaacaccgcgatggtggcttttttatcgtcttcggccacatcattgcgggtataaatcaggtcagaagatttagttttaaccaatttagcggtactcatcgtttcagtcctctctttgatggttgtcctaatcaagtaccggataagtatagcagcgcttttcaggtttgcagaaacgactttgtcgatggatgaaatagcgtgcgtctttactaaaagcagagctgagctaagaaggttaatgccatgttaaaatataaaaacaaataaatagctatttaaatcatgttgttattctattatgtaaataactggtaagtgtctgtttcaaaataggcaactcaggaaggagcgaagattaggaataattctcatgatgagcatgattattatttagccccgcctgcaggcggggcggatagcgtttatttttggatatcgtctgataattcaacgctgtttaactgactctttttcggccgcatggtcagcgttgaacctgccgaggcgatgatgatcgccagcagcgccagccactgaagcccggtcagggtttcccccagaaacagcatgccggaaaaggcagccatggcgggttccagactcatcagcgtgccgaagatgcgcgccggtaagcgggtgagggcgatcatctccagcgaataggggatggcgctggagagcagggcaaccagcaacgcgatcggcataacggcccatgtccagatgccactttctgcgaaacgtcagccccagcggtacaaaaatcactgaggcaatcagcgacccgatagccactgtcgccgggccatgttctgcgcctgcccgctgtcccgccaggatatagatcgcccagcaggcgcctgcactcactgccagcgcagcgcccagcggatcaatcgcagtcatgcctgtgccaaaaggcagcaggaaccacagaccaatcacggccagcagcacccagacaaaatccagtggccggcgcgatccgaatagcgccagcgccagtgggccggtaaattccagtcccaccgccacacccagcggcacggtacgaatcgccagatagaacgtgaaattcattgtgcccagcgccagtccatacatcaggagtggcagacgttgttcccggctaaagcgtaaacgccagggtttgaagataatacagagtatcagggtgccaaagcccagacgcagcgcggtgatgccggtagcgccaacggcaggaaacaggcttttcgccagcgaagcaccgccctgaagcgacagcatcgcaatcagcagcacggcaatcggcatcactatcggggcaaggtttttagaagcgggagaggcagacatcctgtgtacttttcctggtcatcaacgtaatgagtctgccagtgtaaaggaaatagcaggcaaaaaatcacggaatggagttttaaatttctctcaactgagcgatttttggccagaatcagggccatttaggtaaagaaatgtcaggtttttttaggatttaacttaaagaacgaaatgagcacaaaatgattattgcagaaagatgacggattttataagaaaaatgaatgacataggttgtcgcattaacttcctgttacaccaaacattctgttagacaacaaaatccgggcagagtttctcgctattttttgttatattttcagcgttgtcaggagagaagtattttcacatttgaggtggttatgaaaaaaattgcatgtctttcagcattagcctgtgtactggcagtatctgcaggttcagcaatggcacagagcaccgtaactggtggctatgctcagagcgactatcagggcgtagctaacaaagctaacggcttcaacctgaaataccgctacgaagacggttctaacccactgggttggatcggttcattcacctacacagaaaaagataacaccgattctggcatttataacaaaggccagtactacggtgtgaccggtggtcctgctttccgtctgaacgactgggcaagcatctacggtgttgtgggtatcggctacggtaaattccagcagaaacgatacttcatcacgcgataaaactgattcaagcgacgtaggtttctcttacggcgcaggtctgcagtttaacccagttcaggacttcgcagttgacgttggttacgagcagagccgtatccgtaacgttgacgttggcacctggattgctggcgtaggttacagcttctaagtttagcttagctgacctgcaaaaaagcggccccttgtgggccgttttttattgtgctgatttactcacccttctctcgtgcctgcacgtttcccgactttcccggatcgctgtagccgatcagcagccatgctggttgaagccgcaggtcatattaattcgatggggaaacaggaaaaaaagagagcagaaagggagagtgcgcctctcagccagcggctgaaaggcatagaatcaggattagccgcgccagatcagattctgacagcgacgatcgtcagacttatggcccagcagtttttccagcaacatcagacgcagtgtgaacggtgaacgcgtcagcaggcacagccaggatttcatctccgtggttgttttcttctcagcctggaagcatttactgcaatctaagcaacatttcagggtgctcatagaatcacctcccaatcattgtcgacgcggtagtcagcagcctgcggtgagaggcgtcatcatcaccggagcaacagaggatcaactgggatcgctcttttgctgcttacattatcgtcaaatatagcactggctatatcctttagccaaggctaatgacgaaaaatttgagcttctttgcggctggtttacaatgagcgcagctaaatccgtacagcagtgacagtacgggaaaaaataatgaggaagctgaatgagtcgtcgtgctaaaagcgtggtttctgcgccaaaaggaccactgaaagatattgaagagcatgtcgaaggttttcggcaggtgcgtgaagcgcatcgtcgggaattaattgatgactacgttgagttaatctctgatttgattggtgaatttggcgaagcgcgtcaggttgatatggcggcccgcctgggcgtttcacaacctaccgtagcgaaaatgctgaagcggcttggcagtgccgggctggttgaacaggtgccttaccgcggtgtctttctgaccggtgaaggggagaaactggcagaggagagtcgcgcccgtcatcacattgttgaaagttttctgctggcgttaggcatcagtcccgaaactgcccgacgtgattcagaagggattgagcatcacgtcagtgatgaaacgctggccgtatttaagaaattctccgaaacccgctaacgctaaggcgtaccttcatcatgcctcaactgcttcgatcttttttgcatgactctgttttgcatttattaatcgtgattggtgtagttctggcatttctggcggattttcgctgggccgatctgcccggtgccgtagactggcataccattattacgctcaccgggttgttgatcctgaccaaagggctggaaaccagtggctactttgacgtgctggggggacgactgattgcgcgtttccggcacgaacgtgcgctggcgctgtttatggtgctggctgccgcgttgctctctacgtttctgaccaatgatgtggcgctgtttattctggtgccgctgacgctgacgctgcgaaagttctctcacttacccatctcgcgactgatcatcttcgaagcgctggcggtcaacgccggatccctgctgacgccggtcggcaacccgcaaaacattctgctgtggagccacggcaaactaagtgttgtcgcgtttattgtgcagatgctgccgctggccgcctggctgctgcttagcctgatggtattaacctggttcagcttttcaaagcggtcgattgataagcatgacaacccggaacagccgcagtggcagaagccgctgtttattgtcagcgtggtgctatacctgctgtttatcgccggcctggagctggaaatcaccggttgggtcctgctgctgattcttgccacgttcctggtgatggcgcgtccagtgctgctgcgcatcgactggagcctgctggcggtgtttatcgccatgtttattgacgtcttcctgatgacgcgtctgccggtgatgcaggctcactttgatgcggtttctcatttcggtcaggggcagctctacctgctggcgattggtctgtcacaggtgatcagcaacgttccggcgacgattctgctgctgcaaaaagtcccgcctggcgatgtgctggcctgggcggtcaatattggcggtttcggcctgctgccgggttcgctcgctaacctgattgccctgcgtatggcgaaagatcgggccgtctggtggcatttccatctcttttctctccctctgcttgcctggtcgatggccagcggctggctgctgttgcggctgctcaattaggcccgacgcatcctgctacccgccacaggtggcaggatgtgcgccatttctcaagtttcgtaaagttgcgctggattttgtcagtttccgatataaggttaacaggacctttatgcccgggaattagggccttagccagtgatgggaactatgagcgagaataaccaacgcgatccacaccagcaggacgcagaaaatgcgacggataaaaaccgtcagtcagaggaaaatcaggacaacgaccagcagcctgagcgtaaacgccccggtaaaaagccgctgattattctggcggtagtggtggtgattatgctgattgtcggcttctggttctggttcactacccgcaatattgaaactaccgacgacgcctttaccgaaggcgatgccgttaccattgcgcctaaagcctccggctatgtcgtgaagctgctggtgaaagataaccagcgggtgaagaagggcgatctgctggtggagatcgatcccagcgacaatcgtgcccagcgtgaacaggctaatgcgcagctcggtttagctgtcgcacagctgcatcaggcgcaggctcaactggcgctgtcaaaggtacagtatccggcacagcgcgatcaggcgctggcggatcaggcgaaagccgaagcgaatctgcttaatgcgcaggcggattatcgtcgccagcgcggcgtcgatccgcgtgcgaccagtcagcgtaatatcgacagcgcgtccgcgcagttacgttcagcgcaggcgcagttacaaagcgcgaaagcacaggttgaagtggcgtcacaggttgctctgcagattcgccagcaggagaccaatgttgaagcgcgtcagcaacaggttgagcaggcgaaggcgcagttaagcacggccgatcttaatctctcctatacccaggttcgcgcgccctatgacgggtttgtcaccaagcgtaacgttcagctgggcacactggtgcaggcgggatcgtcgctgttttcgctggtctcgcctgagatctgggtcaccgctaacttcaaagagtctcagctgcaacacatgaatcctggcgacaaagttgaaatcagcgtcgatgcctggccggatatgaagctggaagggcatgtcgacagtatccagatgggctctggttcacgcttctcgactttcccgtcagaaaacgccaccggtaactatgtgaaaatcgttcagcgcgtgccggtgaaaatcgtcatcgacaagggccttgatccgaaccatcctctgccgctgggtctctctgttgaaccgaaggtaacggtggaatgagtacggcgcagagctggaaacccgccagtaatccgtggttagtggcgatcacggtcacgctggcggtgtttatggagatcctcgacaccaccattgttaacgtggcgctgccgcatatcgccggttcgctctcctccagttacgatgagtcaacctgggtgctgacctcctatctggtggcgaacggcattgtgctgcctatctctgcgttcttcagccgactgtttggccgtaaacagtttttcctgatctgcatcgtgatgtttaccatctgctccttcctgtgcggcatcgctaccgaactgtggcaaatcattctgttccgcgtgctgcagggcttttttggtggcggattgcagccggttcagcagtctgtgctgctggactacttcaaggcggaagatcgcggcaaggcatttgggctctcctctatcgccattattgtcgcgccggtgattggcccgacattaggtggctggattaccgacaactacagctggcgctgggtgttctttatcaacattccggtcggcgtacttaccgtgctggcgatctatcagctgctggaagatccaccgtgggagcgtaaatgggccaaaggtaagctgaagatcgactatatcggcatcagcctgattaccttaggactgggttgtctgcaggtgatgctggatcgcggagaggatgaggactggtttgcctcgcactttatcgtgctgttcgccattctggcgctgattggcatcgtcggtgccatctactggctgatgtatgcccgtaagccagtggttgatattctggtgatgaaagaccgcaacttctgggtcgccgggctgttgatggcggggatggcgatgattctgtatggcagtttccgtagtgctgccacagctggcgcagcaggatctggggtacaccgccacctggtcaggtctggtgttgtcgcctggcgcggtgctgattgtgctgaccataccgctggtgctgaaactgatgccaatcgttcagacgcgctacatcattgcctttggctttagctgtctggccgtggcatttctctactccgccaccttaacgcccaacgtcgatttcaccactttggtgttgatgcgcagcgcacagtcaatcgggctgggtttcctgtttgtcccgctgacgactatcgcctttgtcaccattccgcagcggcttaatgctgacgcctcggcgctgtttaccatgttccgtaacgtggccggatcgattgggatttcactctcgaccgctgccattaccgagcgcgaacaggtgcggtcagcgcacatggtgcataacatgacgccgctgaatgagccgttcaacattacgcttcagcactgggcgcaggcgatacgcgactttacctcggcggtgggcgatcccgtcacgctggcaaccggtcagctctatcaggagatgattgcgcagtcgcgtatcctcgcttacatcgatgtcttctcaggcctgagtattgtcgccctgattttgattccattttgttggctgctgtcgccgattaagagcgaaggcagtgcaggagcacactaacatgaaggttttttactctcatcgcctgaaacccctgagtttactgctggccctcgggctggcgggctgcgccgtcggacctgactatcaggcgccgaaacctgccgtgccgggtggctacaacaccctggattcgcaggaggcgtcaaagccacaaaacgccgcgattaattcacgctggtggcgcagcttcaatgatccgcagctcgacagtctgattgagcgcgcgattgcgggcaatctgagcctgcagcagacggtgctgcgcattgccggggcacgtgaacagctgacgcaggcgcagggcagtctgttccccaccctgggcggttcagccaaagtgacgcgtcagcagctcgggctggaaggcttgcttaaatccaatggcgcaaccgatcagctcgacagcaacgtggccagccagctcaatggattgacccagccggttaacctctatcagggcagcttcgatgccagctgggagctggacctgtggggcaaagtgcgccgtcaggttgaggcagctaatgcccagcagcaggcagcgatagaacagcgcaacgatgcgctggtctcactggaggccgaagtggcgcgtgcctggctgcaactgcgtggcgcgcagagcacgattcagacgctgcaacagcagattgaggtggcgcagcagacgaccgagctgacccaaagccagcagcgtaatggcctggccccgctgaccgatgtggaaaatgcgcgtgcccagctcagcacgctgcaggcgcagctgccgcagtatcagtcgcaggcacggcaggcgatgaatgggttagcggtgctgctcggcaagacgccgggggcgctggatgctgaactcagtacgccaaaagcgttacccccgctgccacagtttgtcccggtaggcattccttctacgctggcacgtcgtcgtcctgatattcgtcaggctgaagcgacgctgcatgcacaaaccgctgagattggggtttctgtcgcgcagcttttcccgagcctgtcactgaccggccagctgggcgtgcgcaacaccgatgtcagctatctggataactggagcagccatttctacagttatggcccgtcgttatcgattccgatttttcagggcggacagctggtgtcgagcgtgaagttagcgcgggcacagcaggccagtgccgcgctggattatcgccagacggtgctgacggcgttgcaggatgtggagaatgcgctggtcagctatcgcgccgatcagcagcgggtcaccgcgctggatgagacaaccggtgcgcttcagcgcgcctttgatctcgccagcgacagttatcgccaggggctctcgaccttcctggaggtgctggatgcgcagcgtcagctggctcaggcagaggagcaggcgacacaggcgcggatgcagagtgcactcgatttagtggcgctctataaagcgctgggcggcggctgggagacttaccagaacgtggatatgccgcaatatccggtatttggcccggccacgcaggcgaattagttatccggcggtagctgcctctgcgcagttaccgctttatctctcctccggcagcgttaaaccgatgctgcctttctctccatgttgttcatcatgatctaactcgttgataaagagagcttctcagcatcactggaacgggtgcagccagcagaaaataaaacagtggtaatcgcagggttattatcagcgtctccggcgagcgattaattttatgttgcaggcactttccggattcaggtttttgagctctgtcacctttctcagtttatttctttgacgtttttttaaggcaacttacgactgaacgagtgggggcgcgtgaggctattcagtcagcctgagccgggcggaactgttattgcgcagctaagcgatctgcgaataatccgactctgctataaatcgcagcggcaaaaatggttaacaggtggcaaagggcataattaaaaaagccaccagagcgttaattcttttgcgctatttaacggtgccgggggtggctttttaagcataatctgtaagctggtgtgactggggtcacgggcaggcacatttttaatctgttatctccggcccgtaagcgtaaataatgaggctgcatggcccgcatttagttgatagcgttaactgccttctgccaggataatctgcctgaaatcgttttcaactcctgagtaaaagtgccatttgttgttaattcagcgttaataaaaggtcaggcacgaccgattttaatagctctgtttcggccgaattaatacttaggaattatctgtagcgtaaaaataatttatttttttatttgaattaggtagtcttggcgctacagttttattaaccccccttaatcaaggacattgtgatgagtgacgcatttaaggtactgaacaatattcgcacattacgtgcccaggctcgtgaactgccactgaccgatcttgaagagatcctggaaaaattaacggttgttgttactgagcgccgtgaagaagcagaagcggaagagacgcagaatcgcgaaaaagaagaaaagctttctaaatatcgcgaaatgctgctggctgacggcatcgatcctaatgaattattaggtgcactggaaagcggaaaaaaacgtaccaagcgtgcgccgcgtccggctaaatattcttacaccgacgaaaatggtgagcagaaatcctggactggccagggccgtaccccggcagcgattaaaaaagcgctggattccggtaaaagcctggacagtttcctgatcgattgatcgacacaatccttgtaagtgggagccggggggccatcatggccttccggcttttttatttctgccgggatatcaatcaccccgcaaggaatccacggctgacgctggcgtgcgctgcgtcacatctggcataatagcggccgttttttcatccattctcttcacaaaggtcaatgccgtgttagttagcagcaatatcaccatgcagtttggcagcaagccactgttcgaaaatatctccgttaaatttggcggcggtaatcgttacggtttaatcggtgcgaaacggcagcggaaaatccaccttcatgaagattttgggtggcgatctggtgccttcaggcggcaatgtttcttacgatcccaacgagcgcatcggtaagttgcgtcaggatcagttcgcctttgaacaatttagcgtactggacaccgttatcatgggtcaccatgagttatgggaagtgaagcaggagcgcgaccgtatttattctttgccagaaatgagcgaagaagaggggtataaagtcggcgatcttgaggcactttacggtgagatggacggctatagcgcggagtctcgtgccggtgagttattactcggcgtcggcattccggttgagcagcattatggcccgatgagcgaaattgcgccgggctttaaattacgtgtgctgctggcgcaggcgctgttttctaatcctgatattctgttactcgacgaaccgacgaacaacctggacatcgatactattcgctggctggagcaggtgctgaacgagcgtgacagcaccatgattatcatttcgcatgaccgtcacttccttaatatggtctgtacgcacatggctgatttggattatggcgagctgcgggtttattccggtaattatgacgaatatatgaccgtggcgacccaggcgcgtgaacgtctgttatccgataacgccaagaaaaaagcgcagattgctgacttacaatcgttcgtcagtcgttttagcgccaacgcctctaaatcgcgtcaggcgacatcacgcgctaagcagatggataaaattaaactggatgaagtgaaagcctccagccgtcagaacccgtttatccgttttgagcaggacaagaagttgttccgtaatgcgttggaagtggaaggtttgaccaaaggatttgataacggtccgctgtttaagaatttaaatctgctgctggaagtgggtgagaagctggcggtgatcggtgccaacggtatcggtaaatcaacactgttaaaatcgctggtgggtcagctgacgccagataacggcagcgttaaatggtcagagaatgcacgtattggttattacgctcaggatcacgccgatgattttgccaatgacctgacggtatttgactggatgagtcagtggaaacagcctggcgatgatgagcagaccattcgcggtattctgggtcgcctgctgttttcgcaggatgatattaagaagccggccaaagtgctttccggtggagagaagggtcgtatgctgttcggtaagctgatgatggaaaaaccgaacattctgattatggatgagccgaccaaccacctcgatatggagtcgattgaatcgctcaatatggcgctggagatgtatgaaggcacgctggtgtttgtttcacacgaccgtgaatttgtcagctcgctggcaacccgcgtgatagagctgaaagcagaccgcgtggtggacttcaccggtaattacgaagattacctgcggagtcagggtatcgtctgattgaaacggggtggcgcaggccaccccgttttttttggtggtttgttggttcagcacgggcttcagggagcacaggcgttcctgccgacgctacgcgctaccaccacacacttcacagtgcgcatcctgcgccaccttcatgctgcggaactccgcgctcatcgcatcgtacatcagcaaccggctggtggcgggcgtgccaaatgccgtcagcactttaatcgcttccatcgcctgcatcgcaccaatcacgccaaccagcggagccatgacgcccgcttccacgcaactcagggtttgttccccaaacaggcggctgatgcaacgatagcagggtgtgccgggctgccagttgaatacgctgatctggccttccatccgaatcgcggcgccggagaccagtggcacccgctgctgacgacagagccggttaagctgctcacgcaccgcaacgttgtcggtgcagtcaagcaccacctgctgccgggcgatcagcgccagcagcgctgcatcgtccagctgtccattgaccggatgcagctgacagtgcggattgatggcggccaggctttgtgcggcggagtccactttggcacgaccaatatcagcatcgtgatgcaggatctgccgttgcaggttagagtgcgatacggtatcgaagtcgagcagcgtcaggctaccgacaccggcagccgccagatagggcgcagccgcgcagccgagtccgcccagccccacgaccagcgcgtgactcgctttcagccgctcctgaccgtcgaaatcaaagccgcgcaatacaatctgccggttatagcgcagcatctcctcatcgcttaattcaggcagcatttacgcctccagcagggcgttgaacggttccacctcgacccattcgcccggttcaacattgccgcgatcccgttccagcacaataaaacagtttgcctgggcgaaggagctgaagacgtgcgaaccctgcatcccggtggtttccacctccagttcgccctgtgcgttctgtcgcaggatgccgcgctggaaatcgagccggccaggtgactttttcagccgcgaggcgcagcgcactttctgacgtggtggcaatgctgatttttgctggccggtgagggtggcaagcagcggctgaacgagctgataaaaggtcacggcggcggagaccggattacctggcaggccgcagaaccagctgctgttgaggcggccaaaggcaaatggcttgccaggcttgatcgccagcttccagaagctgatggcaccaagctcttccagcatcgttttggtgaagtccgcttcgcccaccgagacgccgccggtagtaatcacgacatccgcctgccgatcggcctcggtgaaagcagcacgcagtgcggccgggtcatctttgatgatgccaaggtcgatgacttcgcaacccagcttatgcagcatcagtgataccgcaaagcggttggtgtcgtagatctggccttcggccagcggctcgcctaccggctggagttcatcaccggtggagaagatagcgacccgcagttttcgcagcacgctgacctgcgcgatacccagtgaggcgagcagtggcagctctgccgcgcccagccgcgttcccgcttccagcaccacggtgcctggctgaatatcatcgccgatgagacgaatgttctgtccgggacggaccggcgcggtgatcacaatcgcatcaccctgtgtttcggtctgctcctgcatcactactgcttcacagcctgcaggcaccggcgcaccggtcatgatgcgaatcacgctgccctgtggccactcaccgctaaacggtgcgccggcaaaggctttacccgccactggcagcggctgaccgctgctggcgtctgccagcctgacggcgtagccatccatcgcagagttatcaaatggcgggacggcaatcggtgaggtcaccgctttggcggtgatacgcccgaccgcttcggccagcggcacgctaagagagtcggtgacgggcgtcagctgtgacagcattttttgttgtgcctcctcaagggagatcaagcctgcagtaaaactttccatggatattccagcctggttatctcagatgctgcctattatggtgggaattagccgcttagtcacatcggtgtcggcctgacttgcctgttgttgtggccaaagtgaaatatggcggtaagaaaaggttataaccacaggaacagtttccgctttacaacacttagcaggctttctatagtcaaaaatcaccaaaaatgggtgaaaaccattttaaatcagtgtttttcgtcctgatgcaaccacagggtagatcgttatggtcaatgcagtgatcgccattcatggaggcgccggtgccattacgcgctcagcaatgagcgccgaaaaagagcaactctatcgtcaggcgctacacgatattgtcactcagggccagcagatactggctcagggcggcagcgcactcgatgcggtgaccgaagcggtgcggctgctggaagagtgtccgctgttcaacgccggtaaaggcgcggtcttcacccatcagggaacccatgaactcgatgcctgcatcatggatggccgcacgctgggtgcaggggcggtcgcgggcgtaacgcgggtacggaatccggtgctggcggcacgtgccgtgctggaacatagcgagcatgtcctgtttatcggcgagggcgcagagcagtttgctaaagcgcacgggctggaaacggtcacgcctgattacttctcgactccggaacgctgggagcagttgcagcgcgcgctgaacagcgatacggcggtgctggaccatgatggtgccgcgcacagcgatgacccgctcgacccggaccgtaagtttggtacggtgggggccgtcgcgctggatcttgagggcaacctcgcggccgccacgtcaacgggcggtatgaccaacaagcaggccgggcgggtcggcgactcgccgctgccgggcgcaggctgctacgccagcaacgacagcgtggcggtctcctgtaccggcactggtgaagtctttatgcggacgctggcggcctatgatgtggcagcccagatgcgctacgccgggcgctcactgcagcaggccacagttaatgtcattcatgacagcgtgctggagctgggcggcagcggggggctgattgccgtcgaccgcgcaggcaacgtagcgctgccgttcaacagcgaagggatgtatcgcggtgtggcgcgggttggcgaagtggcagacgtcgctatctatcgcgaaagttaaggagcagagatgagcgacaggcaaacgttaccgccgctggcccctgagcaggtcctggcggtgcgcgatctcaatgtgcgttttcagcacgaaaccaccgtcactgacgcggtgcgtcatttgtcactcgatctgtttcgcggcgaaacgctggcgctggtgggggagtcaggctcggggaaatcagtgacctcgctggcgctgatgcggctgattgagcaggctggcgggagggtcagcggcgaggtgctgttgcggcgtcgcaacggcgacgtgctggatctgatgcgcgcctcaaaaggtcagatgcggcgggtgcgcggtgcggatatggcgatgatctttcaggagccgatgacctcgctgaatccggtcttctccgtgggcgagcagattgcggaatccatccgtctgcatcagggcctgagccacgccggcgcgctggccgaagcgcgccgtatgctggatctggtacgaatccccgatgcgcaaaatgtattatcccgctttccgcatcagctgtcgggcgggatgcgtcagcgcgtgatgatcgccatggcgctctgctgcaaaccggccctgctgattgccgatgagccgaccaccgcgctcgacgtcaccatccaggcgcagattctgcagcttatccgcgtgctgcaaaaagagatgcagatgggggtgatttttatcactcacgatatgggcgtggtcgccgaaatggccgatcgggttcaggtgatgtatcgcggcgaagtagtagaaaatgccccggtagccaggctgttcagcgcaccgcagcagccctatacccaggcactgctggcggcggtgccaaagctcggttcgatgcagggccagcccctgccggccaaatttccgttgctgcacagcgatgccgttgatgacgtgccgcaggatacggttcgccgcctgcagccacccattttgcaggtgcgcgatctggtcacccgctttgatattcgcggcggcctgctgaaccgcgtcaaaagccgggtgcatgccgtcgaaaaagtcagttttgatctctatgccggtgagacactggcgctggtgggcgagtctggctgtggtaaatcgaccaccgggcgttcgctgctgaagctggttgccagtcagggtggcaccctgacctttgacggacagcggatagaccatttgtcaggtgccgcgctggcccatctgcgacgcgacattcagtttatcttccaggatccctacgcctcgctcgatccccggctgacggttggcttctccattatggagccgctgctggttcacaaggcgatgccgcgtcgcgaggcggagcagcgcgttgcctggctgctggataaagtgggtctgctgccggaacatgctcagcgctatccccatgagttttccggcggccagcgtcagcgcatctgtatagcccgcgcgctggcgctaaaccccaaagtggtgatcgccgatgagtccgtctcggcgctggatgtgtcaattcaggcgcagattattaatctgatgctcgacctgcagcgcgagtttggcatcgccttcctgtttatttctcacgatatggcggtggtggagcgtatcagccaccgcgtggcggtgatgtatctcggtcagattgtcgagatggggccgcgtcaggcggtgtttgagcagcctcagcacccttatacccgaaaactcatggcggcggtgccggtagccgatccggctcaccggcgtcgcgaacgagccttactggtcgatgagatccccagcccgattcatgcgttaggggatgaacctgaagtggcgccgctgatggaggtggctccgggccatttcgtcgcccgccacgttatcagtgcgacctgaacagtgacgatgtcgccccggcgaccaacccgacagggattacaggagaacaagatgcagattacgatgcgtaaagggttactggcggctggcgtgttaagcagcgcaatggcattgcccgcctgggcagcacaggatgcggtgattgccgtcgcgtccaacttcaccactctcgatccctatgacgccaacgacacgctgtcgcaggctgtcgcgaaatccttctatcagggcctgtttggctttgataaagagatgaagctcactaacgtgctggctgagagctatcaggccagcgccgacggcctgacctacaccatcaagctgcgttccggggttaaattccaggatggcactgacttcaatgcggaagcggtaaaggtcaacctcgatcgtgccagcaatccggataaccatctcaagcgctacaacctgtttaaacatatcgccagcaccgaagtggtggatccaactacggtaaaagtaacgctgaaagagccgtttctccgcctttatcaacattctggcccatccggcggcggcgatgatttcacccaccgcgctgaaaaaatatggcaaagagatcggtttccatccggtaggaaccggcccgtttgtgttcgaaacctggaaccagaccgattttgtgaaggtgaaaaagtgggacggctactggaagccgggctatccgaagctggacagcattacctggcgaccggtggtggataacaacacccgcgcggcgatgctgcagaccggcgaagcgaactttgctttcccggtgccctatgagcaggcaaaactgctggagaagaacagcaagcttgctgtggtaaccacgccatcgattatgcagcgttacatcagccttaacgtcactcagaagccgttcgataatccgaaggtgcgtgaagcgctggaatatgccatcaaccgtcaggcgctggcgaaagtggcgttctccggttacgccacgcctgctaccggcatcgtgccgcccaccatcgacttcgctcagagctatccggccatcagctacgatccggccaaagcgaaagccctgctgaaagaggcgggttacccgaacgggtttgaaaccacgctctggtcgtcacacaaccacagcaccgcgcagaaagtgttgcagttcacccagcagcagctggcgcaggttggcgtgaaagttaaagttacggcgatggatgcgggtcagcgtgccgctgaagtagaaggcaagggccagaaagagagcggcgtgcgcatgttctacaccggctggtccgcctccaccggcgaagcggactgggcactgacgccactgtttgctactacggcctggccaccggcgatcttcaataccgcgttttacagcaatcctaaggtcgataaagatctggcagatgcgctgaaaaccaccgatcgtgccgagaaagcgcgtctctacaaagatgcgcaggataccatctggcaggatcacccatggatcccactggtggttgagcagctggtttctgccaacagcaaaaacctcagcggtttttatgtgatgcccgatacctcattcaattttgatgaggcaactctgaagtaacggagccggccagcccgcgaggctggccgcagctgcaggatgttgcatgtttaactattttctcaaacgactctttgggctgatccccacgctgctgattgtggcggtgctggtattcctgtttgttcacctgctgccgggcgacccggcgcgtctgatcgccgggccggaagccgatgcctcggtggtggcgctggtgcgtcaggagctgggactcgacctgccgctgccgcagcagtttctggcactttatgctgaatgcgctacagggcgatttcggccagtcgatggtctcgaagcggccggtcgcggaggagatcgcctcacgctttatgccaactttgtggctgacgctggtcagcatgatctgggcagtgatttttggcatggcaatcggcatcgtttctgctgtctggcgcaatcgctggcccgatcgactggggatgacgctggcggtgtcgggcatttcgtttcccgcctttgcgctgggcatgctgctgatgcaggtcttctcagttgaactgggatggctgccaaccgtcggtgcagagagctggaaacattacattctgccctccatcaccctgggtgcggcggtggcggcggtgatggcgcgctttacccgtgcctcgttcgtggaggtgatgcaggaagattatatgcggaccgcccgggccaaaggggtgcgcgagtcgctggtggtggtgaagcatggcctgcgcaacgccatgatcccggtggtgacgatgatggggctgcagtttggtttcctgctgggcggatcgatcgtggtcgaggtggtatttaactggccgggcctggggcgactgctggtcgattccgtggcgatgcgcgactacccggttattcaggcagaagttttgctgttttcactggagtttattctgatcaatctgtttgtcgacatgctctatgcggtgattaatcccgctattcgctttaaggagtcgcgatgaaaaactggcgacgcgaagcggcactgaaaacgatgccgctgattgcggagaatcgggtgcgaacgccgtggcgtgaattctggcggcgtttcagaggacagccggtggcgctgctggccgggctgtttgtgctggtactgattgtgctggcggttatcgccccatggattgcgccgttcgacgcagagaactacttcgattatgaccggctcaatgacggcccctcgctgatgcatctgtttggcgtcgattcgctggggcgtgacattttcagtcgggtgctggtcggcacgcggatttccctgattgcgggcttcttttcggtagtgatcggcgcgctgatcggtacattctttggtctgttagccggctattacgaaggctggtgggaccgcatcaccatgcgtatctgcgatgtgctgtttgcctttcccggcattctgctggcgattgcggtggtggcgattatgggcagcggcatgagtaatgtgattgtggcggtcgctatcttcagtatcccggcgtttgcccggctggttcgcggcaatacgctggtgctgaagcatcagacctatattgagtcggcacgcagcatcggcgcttctgactggactatcatgatgcggcatatccttcccggcacggtatcgccgattgtggtctatttcaccatgcgggtcggtacctcaatcattaccgcggccagcctgtcgtttctggggctgggcgcacaaccgcctacgccggagtggggggcgatgctgaatgaggcgcgggccgacatggttatcgcgcctcacgtggcgattttccccagcctggccatcttcctcaccgtttctggcatttaatttactcggagacgggctgcgcgacgcacttgatcctaaactaaagagatgaaacctttcgattatgatcaggacttcagcactatcgacttccgccagcaccccgagctttatcaggtcgggcgtggtgagcagggtgtgctgatggtcgagccttataaaggcgaaatactgccacactggcgttttcgtaccgttcccattgctgaagagtcggctgagaaaatcatggtgctgtttgaggagtatcggcgcaaagatgattttgtcggcatggatatggcgcgcaaatttattcagatggggtatacccgtgcgcgccgttacagcaaccacaagggcggacgcaaatatgacgcggatggcaaggagctgccgcgcggcgtcaacgaggaaaaagccgcggcggcggctgttttcaaaggctactgggacaaacttcgtgcagatgaagactatctgcgacgtaaaaaagcgcatcagcagcagtatggctaagcgttaatcctgctctcccggcagccgctaacccctgctgccggggttattttaatgaacccgtcctgctcaatcttatccctcattccttgctgcaacggttctgctgcagcgcccgtgctgccagatgcgcagccgtttcgccatgccctaaaacgccatagcccgccacgcttgccagataaggtcagacagcagcagaagagaaaccttttctgctggcgagccgggggcgtaaagtagtgaaaaaacgcgtaaaagccgatccacagcacaggcaaaaaaacgggcggttcaaaccgtgctttttccaataacttcccgtgctataaaaagaaattggctgcggagcctctgactgatgaacaagcgaaacgctgacagtggccgttgtttagagcatccggtaaaaggcgggttgatattcacttgttttcattaataataaacgggcaaaccccactgagggggctatgcccctcaggtaatgaaatggataatgtgagagctaaataatgaaagagatcatcaacggatttctgaatttccagcagaatgtgtttcctgaaaggaaggatcttttcaaaagcctggcatcaaatcaaaatccgaaagcgctgttcatctcctgttcagacagtcgtctggtgcctgaactggtgacgcagcaggagccaggagagctgttcgttatccgcaatgcgggcaacatcgttccctcattcggcccggagccaggcggtgtctccgccactatcgaatatgcggtggtcgcgctgggcgtctccgacatcatcatctgtggtcactctaactgtggtgccatgaaacgccatcgcctcctgcgcctgcatggataccatgcctgcggttgagcactggctgcgctatgccgatgcggcaaaagcggtggttgagcagcgtgagtatgactcaccagagaagaagctgaacgagatggtcaaagagaacgtcatcgcccagctgaacaacatgaaaacccatccttccgtctccgtcgcgctgcgtaacggtaagctgcgtctgcacggctgggtttacgatatcgaaagcggcaccattatggcgctgacccagggtggcaaacagttcatcaccctgtctgagaatcctgatacctgctttgagtaatctttttcgcccgctgtgctctgcagcgggttttcctgctatttattctgcataacagcgttaaatcgcctctgttattctgcatttcccctctggcttatctatgcttgcttaaaccttcctgatacaagcgagttgatgatgcgtaaaacttccgttgctgctcttctggcggtctctgccgtgctgctcagtggttgtacttctcatgttgctgataagcagcaatattcaggttttttaagcgattacagccagttgcaaccgacgtcgtcagccagtggtgaaccgactctgcgctggatatcacccgactatcaaagcagccattataaagatgtgctttatacatcgctggtctactacccggcggcgcaccccacgccacgcgtcactcagcaaacgctggatcaggtgctcagttacaccgagatccagctaaaaggcgcgatagccacccgcctgccgctggtgaatcaggctacgccgcataccctgaaggtaagggccgccattaccgccgtgtcagcagaaaatcagggcgtgcagttttatgaagtggtaccggttgccgcggtcgttgccagcaccatggcggcgtcagggcatcgtactcagaacagcgaactgtttctggaaatagaagccaccgatgcggtgacgggcaaaccgatgatccgggtggttcgcaaagcctttggcaaaacggtcagtaacagcaatacgccgatcacctttgacgagctgaagcctggtatcgatacgatggtgcgtgacacggtaagttttaacgcgccctgactctgacgggcgacagcagagcgctgtcgccctgattaatcttttgtaaatcctcaacatcattgcagaggggctgactacgcttaagggcattctatcccgtcaggagatcgttatggcccgtttctcaactgctttgttgctaagtggctccctgttctgtaccgcccccctgtttgccgccgacgtaaaggtcgaggtattacaggataagttacaacatccatggtccgtcgccttcctgcccgataacaaaacgctgctgattaccgaacgtagcggacaactgcgcagctggagcccggagagcggcctgtcgcagccgatccagggcgtgccaaaggtctgggcagaacggcagagtggcctgctggacgtcgtgctggcacccgattttgccaccagtcgccgcgtctggcttagctataccgaagcgaacagcagtggcaaagcgggcgcggtggtaggcgtgggcacgctgagcaaggataaccggcaactcagcgatttccgcgaggtgattcggcagacgccgatgctctccagcggcaacaacatcggtacccggctggcgtttgatacccagggctatctctggatcgccttcggcgataattttgccagcagcgctgcgcaggatctcgataagctgcagggcaaactgctgcggctcaacgccgatggcagcgtgccggacgataacccgtttgcgaaacagcgcggcgcacggccagagatctgggcctttggtttgcgtaatccgcaggggctggcgcttaacccctggaccggcaagatatgggaaaatgaacatggcccgcgcggcggcgatgaagtgaatatcatggagcggggcaagaattacggctggccgctggcaacctacggcatcgactatagcggtgacaaagtgccggagtcacaaggcacacaggttgcgggtaccgaaccgccgctttatcactggaaggattctcccgccatcagcggcatggcgttctacaatagcgcccgttttccgcagtggaaaaactcgctgtttatcggcgctctgaaagagaaaaacctgattcgtctgagtatcaacggcgagaaagtggtggaagagcagcgtctgctggacgatcagaaggcgcgcattcgcgatgtgcgtcaggggccggatggctggctctatgtgctgaccgatgaggccaatggcaagctgctgaaagtgggattagcgcaggacgctggtgcgtcccgcggctaagagcctgtccccgggctattttatgtgtcagtctgggcctgggcagtgctcacacaggctgctttagcaacctgaacgcccgtcagggcggccctgaaggggcgagcgcagcgagtaatcctcacggactacgtgtactacggattgtgccgcgctgcccgtgtccaggctgccagcaatagttaccccagatggaataagctctgagtcagcgcgcccagtgataaacctgccagccgcggtttaacgcttcctggtgtaagtgttcgtcagggttgatgacatgggcatgatcggcctgttccagcagcggcaggtcgttcatcgaatcgctgtaggcccaggtgcggtcaaaggcctcgtcctgctgcagcgctttccagtcacccagtcgcgtgactttgccctctttataggtcatggtgccgtaagtgttgccgctgtagcgctcgtccacgatttcaacgccaatcgccagcgcgccgcaggcacccagcttctctgcaatcggcaccaccagatgctcgccgctggcggagatgatcatgaccttgtcgccacgcgcccggtgccactcaatccgctcgcgggctgcaggataaacgcgtggcatgatgtcgcggtgaatgaagcggcgcacccagccttcaacggtaagcgtggccatgcccgccaggggggagagtgttttattcatatactcttcaatcgacagcgtaccggcatagtactggctcattaatgcctgttcctgatcaatcagttcactgggggcgaatccctgtgataccagccagcgcagccacaggctggtgctgtcttcacaaatgagtgtttcatccagatcaaaaagggctaagtccatggtcggtctcctcggctgactggcgttcaggttaactgatatttgtgacgggcttaactcttctgcgaaaaatcggaatttcacgcagttttcatagcgacagaatcggggaaaagcggcacgcgcgcggcacttatgccagggttactctactaaactctaaaaaactttacgattcgacggtttttttcgctgccgtcaagggttagcgtttgagtgagaattttctgcccctggaatttcgatttaacaaggacaatccggccaagcccatgacaaacactcgcttcacatctcgcctgcggcaccttgctgccacttcattactgattcttgcccccgtcagcgtttttgctgagcaggctcccgccgcgccaggcattgatgctaaagcgtggattctgatcgactacgccagcggtaaggtgttaaccgaatccagtgccgatcagcgcctcgaccccgccagtctgactaaaatgatgaccagctatgttgtgggtcaggcgattaaagcggggaaaatcaagccggatgacctggttaccgtcggacaggatgcctgggccaccggcaaccctaagctgcgcggctcgtcgctgatgttcctcaagccgggcgaccgtattccggtgcatgagctgaataagggaatcgtgatccagtccggcaatgacgcctgtattgcgctggcggattatgtggcgggcagtcaggattcgtttatcggcctgatgaacaactacgtgaaggcgctgggactacagaatacccactttatgacggtgcatggtctggatgcagaagggcagtacagtaccgcgcgtgacatggcgctgattgctcaggcgctgatccgcgatgtgcccgaagagtacgcgctgaataaagagaaagagttcaccttcaataatattcgccagatcaaccgcaaccgcctgttgtggagcaccaatctcaaggttgatggcgtcaaaaccggccacacctcaggcgcggggaataacctggtcgcttcagcaaccgaaggggatatgcgtctgatctcggtggtgctgggcaccgccagcgatgcgattcgtttccgcgaaagtgaaaagctgctgacatggggcttccgtttctttgaaacggttacgccgattaaagcggatgcgccgtttgcgcagcagcgggtctggttcggtgatcgcagccaggtcaatctgggcgtggcgaaagatgctgcgctgaccatccctaaagggcagatgaagaatctgaaggcgagtttcagactcactacgccgcagctggaagccccgctgaagaagaatcaggtggtcggcaccatcgatttccagctggacgggaaaaccattgagcagcggccgctggtggtgatgcaggatgtgccggaaggcgggttcttcagccggatgattgatttcgtgatgatgaaattcaatggctggttcgggaagtggttttcataagtaagcagggacgctgatatgttcctctcagacgagcgctgtttctaaaacaggatctaaccgcaacgcattagctcagcgcgcagggagctgggtcagaagaggaaagcgtcccgcgccagggatggcgcgggccgagcatgccatggatggcggtttttgcgtctttccgatctgacccagttccctgcgcaggctcgatctcaccgctgtcaggtgcagtttttttccgacagcttcagggacgctaacgcgtccctttcttaatcctgcgtccagcctttgcgaatcggcacggcaaacagcgaccgatagagtggattgattaccgccagcatccgctcgccatagaactgccacgccagatgcgaagccagacagctcagcagccccaccaggaacccgcccagcatatccattggccagtgaacgccaaggtagacccgcgaccaggcaatagcgcaaccggccaccatcagaaccacacctgaccagaggcgatgccagaagataaaggccagtgcaaaggtgaatattgtggtgccgtgatcgctgggataggagtcatcggcggcgtgatgcaggaactgataaccaaaaccgatagcgaaagggcggggatgcggcaacagctggcccacagaccaggagatcgccagcgcatagatcagcgccataccggttttcagtaccagcacccgctgcgaagacacctgatcgcgcggtccccagagccacatcgccacgattaacagcggcacgatggcgatcagatctttggcaaaaaacgtcgccagctgcagtaaccaggcgggtgaagccggtgtggcattaatggcagtaaacagtgaatggttcagctcttccatttcgggataaattcctcagcagacagtccggttaacggcagctggcagcatcccgccagcccggtccgataacagcggcaaaaaaaacggtcagcgacagcacgctcacccaatcagtcagcacaaattgctaactaaacagcggtctatcctgctttttaccgttttgttcgtctatagaaaggctcttaatctgccgttgagttgtgtaacggtttaagttttatgacacttgaagttgcgaatcaggcggggaatgacggggagggacgaaaaaaggcataaaaaaacccgccgggaaaaagaccagcgggctccacaatttggggatttcaaagaaaagcagtggcacttattatgactatcccttaacaataaagttctggacgcaggcaaaaaaattttataagggcaatatcggccagataatcacaatcagcgttcccgccagcgtcagcaacacgttggcgatggcataggtcccggcatagcccagcgccgggatattgctgcgtgccgtatcactgatgatctccatggccggtgcgcaggtacgtgcgcccatgatggcgccaaacagcagggcgcggttcatccgcaacacataagcaccaaacagatagcagatgatcaccggaatcaggctgaccagcaggccgcacagcagcatcagcgcaccatcgctgctcaggccatgattaatgccgctaccggcactcaatcccactcccgccataaacaccatcagaccgaactctttcaccatagtgagcgcgccctgcggaatataaccaaaggttggatggttggcgcgcaggaagccgagcatgataccggcgaacaggaggcccgcggcgttaccaataccaaaactgaaattgctgaactggaaggtgatcagaccaatcatcagacccacgataaagaaggcgcagaaggctaaaagatcggtcatctgactgtgaatcgcgataaagccaatgcgatccgccacgcttttcactcgtcgtgcctcgccgctgacctgcagcacatcacctttgttcagcatgatactgtcgtcgatcggcatctcaatctggctgcgtatcacccggttcaggaagcagccgtgatcggtgaggtttaacttgctgaggcgtttgtttaccgcattgtggtttttcaccacgatctcttcagtgacgatgcgcatatccagcaggtcgcggtcaaaaacctctttgccgttgcggaagctggggtcgagccgggcgtgagcatcgggatagcccaccagcgagatatcatcaccgagctgtaacaccgcatcgccatcgggactggcgagaataccgttgcggcggatgcgctcaatgtagcaaccggtctgacgatagatacccagttcgcgcaggtttttgccgccgctccatgccaccagttccggaccgacgcgataggcgcggatcaccggcaggaaaactttgcgctggctgtccgcatccagaccgcgttcccgggcgatctgctgggcgcaggtgggcagatcctgatgttgcagacggggcagataacgtgcgccgaaaatcagactgaccaggcctatcagataggtcacggcataaccgaggctcagctgatcctgcatcagtccaagctgtttcggatcgctgatgctttgccgcagggtatcgcccgctccgaccagcaccggcgttgaggtcatcgacccggccagcatgccggcggtgagaccgatatcccagccaaagagtttgcccaatcccagcgccagcaacagtgcgctgaccaccatgacgatggcgagcatgaaatagtttttgccgtcgcgaaagaaaatggaaaaaaagttgggaccggcttcgacgccgacacaaaaaataaacagcataaagcccagactcaatgcatcggtattgatcgtaaagtgctgctggcctaataagagcgaaaccactaatacgccaatcgaatttcccagctgaaccgagcccagacgcaacttacccagacagaggccgagcgctaaaacgacaaacaataacaaaatgtcatttccgcttaacaatcctgcgacgttaatattcactgtttaacttcttgtttacatgtaacctattgaagagtagcctgtttttcgctatcgtgagcaggccgttgaggtgctgttgcatcagtactgcaaatggaacctttaccgcggcgctattctaatcacaaatatctttcacagccattggctgttttcattcgttgccacagcgaactgtttctttttatttccatctgaacgcatcagggttatcagcaggttattgtcggggttacttttaatcagtggggtggtatgccgcagcgttcttatctctggactacccgcctgtgcggcgtggtgttgtacagtctggtgtttgtctttacctgtcatttctggcaggtcggtcccggcccgcttcgtggtcagcccgaattactgctctttatgttgcccggtattgtgatggcattggtgcaggtggagagcccgctaaaaagcaccctgctgatggggctatggggaacgttactggcagcactgctgttaaacagcagcctgtttatccacagcaatgcactttttgtggtcgcatggagcctcagcgcgctgtttctgggcaggctgcggggctttgctggtacggttgatgcagatagtgatggcatcactcaattaaacagtgttgggcgatggatgaccggcagagcgcaaaaaaggcgagacaggaaaatcctggctcgcctttttcattccggctatcagcgcttacgcggcaaatcccagattctctttggtccaggccgcaaactcggtgtagccaccgatatgtttttcgtcgacgaaaatctgtggcacggtgctgaccggtttaccggcgctcgcttccaggtcggctttagtaatgccttctgcgttaatatcgacatactggtagctaaaatcatcacgttcagcggttagtttgtcggccagttcatgggcacgcacacagtagggacagcccggacgaccaaaaataacagcaatcattgagaactccttgcagcgactattatgtgatgtgtatcacacaatgaaacagagaatggcaaccatgatgcccgctcgtatcgcttaaggaaagcaggatttgcctgttagtctgatgcccgcacgctatcgctgcccggtcaggaagcctctgaatcagaggctttttcgcgccggcagcccgtgtatctcgcgcaatttttgggttgttgaccataattgacgctcagtcagccgctaaggcaggaggatatcatgcagagtgtagccagattaccccggtttgtggtggtgctggaggcggctggcggcctgttaatcgtggccgcgctgctgctgatcaaccactggcttccgctgccagacaaggcggatgtaaaaacgctggccactgtgctgtttattgctggcgtggttctgatgctacctgctgcctggctgttaatgtggcgcaccgcgaaagcgatagcaccacagctgtttaatcaaactgacaaaaaaagataatattgctggagactttatgacaccgaccattgatttactgtgcagccatcgttcaatccgcgcctttactgatcagccggtcagcgaagcacagcgtgaagcgattattactgcggcgcaatcggcgtccacatccagttttttacagtgttcctccattatccgtatcaccgataaagccctgcgcgacaagctggtgacgctgacgggcggacagacatgggtcgcggatgcgcctgagttctggatcttctgtgctgactttaatcgccacctgcagatttgccctgatgcgcagctgggtcgtgccgagcagttgctgctgggctgcgtcgataccgcgctgatggggcagaatgccatggtcgcggcggaatcgctggatctgggcggcgtctttatcggcggaatccgtaacaacatcgcggaagtgacagaaactgctgggcctgccgaaatttgtcctgccgctgtttggtttttgcctgggtcatccggagtcaaagccggacgtcaaaccgcgtatgccgcacgcgatgctggtgcatgagaaccgctatcagccgctggatccggcggtgctggccgaatacgatagccgcacagaactctattatcagcagcgcggcagcaaccagcgcagcgaaacctggagtgagctgatccagcgcctgatcattaaagagacgcgtccgtttatgctcgattatctgcatcagcagggctgggccacgcgttaagccagtaagggagagcagcgatgaagatagctatcctgtcgcgtgatgagacgctctactccagtcggcgactgcgtgaggaggccgccgcacgcggccaccaggttcagatcatcgatccgctctcctgctatatgaatattaatcccgcctcaccagcggttcactactgtggtgaaccgctgggccattttgatgcggttatcccgcgcatcggcaaccctatcactttttatggcacggccgtgctgcgacagtttgagatgtgcggcagctatccgctgaatgagtccgccgccattacccgcacccgtgacaaattgcgctcgctgcagctgctggcacgggaaggcatcgacatgccggttaccggctttgcctcctcacccgatgacaccgctgatctgatcgccctggtcggcggtacgccgctggtggtcaagctggtggagggcacccagggcattggcgtggtgctggcggaaacgcggcaggcggcagaaagcgttatcgatgcctttcgcggcctgaatgctcatattctggtgcaggagtttattaaagaagcgcagggtcgtgatgttcgctgtctggtgattggcaatcaggtggtggcagcgattgagcgggtggcgaaagagggcgactttcgctctaatctgcatcgcggcggcaaagcttatcccgtcgtcattacgcaacaggagcgccagatcgccgtgaaagcggcggctacgctcgggctggaagtggcgggcgtcgatattctgcgcgcccatcgcggcccgctggtgatggaagttaacgcctcgcccggtcttgaaggcattgaaaccagcagtgaccttaacatcgccgccctgatgatcgaacggattgagcagcaggccatccccgggctccgtcctaaaaccgctggctgacacgcgcttttcagcggttttcatggcatcgtcgcgcatttttccgtaagctaagtcgcctgtttatcaccccactgggattttacgatggattctcttgtcgttccggatatcgacctgctgcgtcgctggctggatcagcaaaatatcacctggttcgaatgcgatgcctgtcaggcacttcatctgccgcacatgcaaaacttcgatggggtgtttgacgccaaaatcgatctggtcgacaacgtcattctgttttcggcgctggctgaagtgaagccgacggcgctgattccactggttggcgatttgtcgcagatcaatgccagttcgctgacggtgaaagcatttatcgacattcaggatgataatctgccgaaactcattgtctgtcagtcaatgattaccaccgccgggttaacctttggtcagttctcgcactttatgaaacagagtgaagagcagatctccatggtgatcctggaagcctttgccaacaatctgttgatcgtgggcgaagaagaagagcacgtttccggtgaccagcgttcattctgtgctgcactaagcccgacatggtcacacactaagccgtccctgagacggcttttttatgcccgccatccgctgccgcgataattttttattctgcattttgccctttaacgccagatattagtcgtggtttatgccatcaaagccgaacctcatagctcaaacatgcataaaatatcgctttcaggcgttttttacgctggggtctggtgaagcctgaccgggggggctatgcttgcggggctgtaacaggcgcgtaactgcgcctcagctataggtttttgctattaaactcccgctgaataatgattcattgtgtcactgacgtcttgtacagaacgcaatgcagggatctctggtttgcagcgttgtaatgacccgctcaggaggatggaaaaatatgttcaactcacgtcagaaatggctgtcagctgtggtagctgctgcgctgatggccgcatcggccagcagcatggcggaagataaaacgctgcacgtctacaactggtccgattatatttcgccagataccgtgccgaactttgaaaagcagtccggcatcaaagtggtctacgatgtgtttgactccaacgaagtcctggaaggcaaactgatggcgggcagcaccggctatgatgtggtggtgccatcctccagcttcctggcgcgtcagctgcagtccggggtattccagccgctggataagagcaaactgcctaactacaaaaacctcgatccggcgctgatggagaaagtggcgcagcacgatccgggtaataaatatgccattccttatctgtggggcaccaccggtatcggctacaacgtcgacaaggtcaaggccgcactgggcgccgatgcgccggtcaacagctgggatctggtgctgaagccggaaaacctggagaagctgaaaagctgcggcgtctccttcctggatgcgccagaagagattttcgccacggtgctcaactacctgggcaaagatcccaatacctctgatgccaaagagtattccggcgcggccactgacctgctgctgaaactgcgtccgaatatccgctacttccattcatcgcagtacatcaacgatctggccaacggtaacatctgcgtcgctattggctggtcgggcgatattctgcaggcgaaaaaccgtgctgatgcggcgaaaaatggcgtgcatctgggctacagcgtaccgaaagagggcgcactggccttcttcgatatgatggcgatcccgaaagatgcgaaaaatctcgatggtgcttacgcctggctgaactacatcatggatccgaaagtgatcgccgatgtctccaacaaaatgaactacgccaacggcaacaaagcgtcgctgccgttgatcaatgccgacgtccgcaacaacccgggtatcttcccgacgcctgaagcgatgtcgaaattgtttgtgctgaaagtccaggatccaaaactggatcgtgtgcgtacgcgcgcatggactaaagtaaaaagtggtaagtaattcgtccttaacggattgacctgtcatgaatcagcaacagaggcgcggtgtcggcctctgttgtgccatttttagcggcaaattttgtcgccatgttccgcctggctccggagagaaaacctttgtgaacgatgccattccccgtcctcaaaataaaaccgcaaaggcgttaacgccactgctggaaattcgcaatctgaccaaatcctttgacgggcaacacgccgtggatgatgtcagcctgactatttataaaggtgagatctttgccctgctgggcgcatcgggctgtggtaaatcaacgctgctgcgcatgctggccggttttgagccgccaaccagcgggcagattgtgctggatggccaggatctgtcccacgttgctccctatcagcgcccgatcaacatgatgttccagtcctacgcgctgtttccccacatgacggtggagcagaatatcgcctttggtctgaaacaggatcggctgccgaaaggggagatcaccagccgggtagcagagatgctggcgctggtgcatatgcaggagtttgctaaacgcaaaccgcaccagctctccggtggtcagcgtcagcgtgtggcgctggcccgcagcctggcgaaacggccaaaactgctgctgctggatgagccgatgggggcactggacaagaagctgcgcgacaggatgcagctggaagtggtcgatattctggagcgtgttggcgccacctgtgtgatggtgacgcacgatcaggaagaggcgatgaccatggcgggccgtatcgcgattatgaatcgcggcaagttcgtgcagattggtgaaccggaggagatctacgagcatcctaccagccgctacagcgcggaatttatcggttcggttaacgtcttcgaaggcttactgcgtgaacgtcaggcggatggcctggtgatcgacagtcccggcctgatgcatccgctgaaagtcgactccgatgtctcggtggtggataacgttccggtccatgtcgcactgcgcccggaaaaagtgatgttgtgcgatgaggtgcctgccgatggctgtaactttgcggtgggtgaagtggtccacatcgcctatctcggcgacctctctatcttccatgtccgtctgcacagcggacagatgatcagcgcacagttgcaaaacgcgcatcgctaccgcaaagggttgccgacctggggtgatgaagtccgcctctgctgggaatgcgacagctgcgtggtgttgacggtttaaggagcggctatgagccagattttccaacgcgctaaagcgcctgcccgactggtcggcacgccgctgcaacgctgggccacgcggataaaaatgcagcatggccgcaagctggtgatcgccttgccttatgtctggctggtgctgttatttctgctgccgtttctgacggtgctgaagatcagcttcgcggacattgcgcgtgcgattcccccctacaccgagctggtgagctgggctgatgaccagttcagcattgtgctcaatttcggcaactacctgacgctgaccgacgatccgctctacgtcgatgcctatctgcaatcgctgaaagtggcggcgatctccacggtgatctgtctgctgattggctacccgctcgcgtgggccgtggcgcacagcaagccatccatgcgcaccattctgctgctgctggtgatcctgccgtcatggacctcatttctggtccgcgtctacgcctggatggggctgcttaacaacaacggtattctgaaccggttcctgctgtggctgggggtgatcgatcatccgctggtgatcctctacaccaatacagcggtctatatcggtatcgtctactgctatctgccgtttatggtgctgccaatctacaccgcgctgacccgcattgattactcgctggtggaagcctcactggacttgggtgcgcgtccgctgaagacctttttcagcgtgattgtcccgctgaccaaagggggcattatcgccggatcgatgctggtgtttatcccggcggtgggggagtacgtgatccctgaactgctgggtggcccggacagcatcatgattggccgtatcctgtggcaggagttctttaacaaccgcgactggccggtggcctctgcgctggcggtcatcattctgctgatcctgattctgccgatcatctggttccacaagcatcaaaaccgtgaaatgggagagaaggcatgaataatttgccaaccattcgctcaccctggcgtaccggtattctggtctgctgcttcctgttcctctatgcgccgatgctgttgctggtggtttactccttcaacagctcaccgctggtgacggtgtgggagcgcttctcgttccactggtacagggtgctcttccaggacagcgcgatgattgacgccgttctgctgagtctgagcattgccggtctctccgccaccatggcggtggtactgggcacgctggcggcggtgattatcgtgcgctttggtcgcttccgcggccacaacggttttgcctttatgctgaccgcgccgctggtgatgcccgacgtcatcaccggtctgtcgctgctgctgctgtttgtagcaatgggtaacgcctttggctggccgagtgaacgcggcatgctgaccatctggctggcccacgtcaccttctgtaccgcctatgtggccgtggtgattaactcgcgtctgcgtgagctggaccgctccatcgaagaggcggcgatggatttaggcgcaacgccgctgaaggtcttttttgtgattaccgtgcccatgattgcaccggctattgtgaccggctggctgctggcgtttaccctgtcactcgacgatctggtgattgccagctttgtgaccgggccgggtgccaccacattgccgatggcgatcttcgccaccgtgcgacgcggcgttaacccggaaatcaatgcgctggcttcattgatcctgtttgtggtcggtttagtgggttttatcgcctggcgggtgatggcacacgaagaaaaacaacgtttaagcgatattcagaaagctaaacgtggctgaaatccgtaacctttgccactatatgaacgggccggtctgaccggcccgtttttcgatcaggtggagtcacggactatgtcagaaatcttcaaaagcagtgccacgctttcaatcgcgccggttccggtgacggttgcgggcattgctattattgcgacccgctgcctgagcgtcctgatgctggcaaacgagctgggttacagtgaactcgccaattttgttcaccgcagcgcccagtcctgggacgcgacactcatctttgtcgccagccagctgatcttcctgttcgaactgcgctgcgcctttaccctgatgcgcggcagtaaccgtggacgctggggctatgtggcgacgcaggtgattgtgctcagctatatgctggtcgcctcgctgggctggatctaccccgagattttcagcattgatggcgacaataacgtccagattatccaccataccctgtcgcagaaaatccccgatctgctggtgctcctgctgctgtttctgcctgccagcagccgcgcttttttcaggaagcgatgatacaatcgcgctccgcccgacccgatcgttaaggctttaccatgcactgcgcgctttatgacgctaaccgttgccgctcctgtcagtggctggaaaaaccctatcccactcagctgaacgacaaacagtcgctgctggaacagttactggctgagcagccggtcgctgcctggttgccgccgatcgcatcaccgcagcaggcatttcgtaataaagccaaaatggtggtgagtggcagcgtcgagcgtccggtgctgggattaatccatcgtgatggtgaagctgtggatctgtgcgattgtccgctctatcccgccagcttccagccggtttttgctgcacttaagccctttatcgcccgtgccggactgacgccctataacgtggcgcgcaaacgcggcgaactcaaattcctgctgataaccgaaagccagcagggcggcgtgatgctgcgctttgtcctgcgttcaaccgcgaaactggaacagctgcgcgccgcattgccgtggctgcaacagcaattgccgcagctggcggtgatctctgccaatattcagccggtgcatatggcgattctggagggggaagaggagattgcgctgacgcccgcgcagtcgctggcagagaacttcaacggagtgccgctgtggatccgcccgcaaagcttcttccagaccaacccgcaggttgccagcgcactctatgccaccgcgcgcgactgggtcagggcgctgccggtcaacagcatgtgggatctcttctgcggcgtgggcggttttggtctgcactgcgcgacagcggagatggaactgacgggcattgagatcagcgccgaggcgataaaatgcgcccagcgttccgctgagatgctgggactggaaaaagtgcagtttgcggcgctggattctacggcgtttgcgaccggacgcgatgcggtgccgcagctggtgctggttaatcctccgcgtcgtgggattggtgaggcgctgtgtgactatctcagccagatggctccggattatctgctctattcaagctgcaatccgcagaccatggcgcaggatattgcccgactgagcgcctatgaggtgacgaaggtgcaactgttcgatatgtttccccacaccgcccattttgaagtgctgacgctgttaacccgccgtcagcacgcgtccgggaaagcatcggcagaggcagcctcagccggtaatcactccgggaaccacttctgattaagctgctgccagctgccgttggctttcagttcgttcagcgcctgattgaactgatcgcgaagcgccgtattgcctttgcgtacggcaatgccgagaccggtgccaaagtagtccgcatccgtaacatgttcaccgacagtggcgagatccgcattggtcttcagccactgattcaccaccgcgctgtcgccaaacacgccatccagccggccactcttcatatccagaatcgcattctgatagctgtcataggccaccactttcacttccggatgcttatcctgcaggtacttctggtgagtggtgccgttttccacgccaatgcgcttgcccttaagctcagcaaagctgctgaactggcctttacgggcgatcacgatggcggagttagcgtaataaggctgggtaaaatcgacctgcttgctgcgctcagtggtgatatccatgccggaaatcaccgcgtcatagcggcggaacttcagtgacgggatcaggctgtcgaaggcattgttggtaaaggtacactccgctttcatctgctggcacagcgctttggccagatcgatatcgaatcccaccaggttattttcccgatccagggattcaaacggcgggtaggtcgctgaggcggcgaagcgaatcttttccgctgcctgggcggtaagtgccagcgaagccagcgcagcggcaacaatccattttttcattttatgattcctgtgatgtggtcagccagagaaggcgataccctgccataaaatgcatttttatgcaattagtgtgatttttcaggcgaaaagggcgaggggcctcgcccggatatcagttacgtcgttcgaaggccagggcgcgcttttcgatcagccgcatcatcagcgtcagcaaaccgttaacgcagagataaaccagacccgccgcggcatagactgtgatgtcgtaggtgcggccatagagcaactggccgtggcccatgacttccatcagggtgatggtgtaggccagcgaggtgcctttgaacaccagcaccacttcattggagtaggaggagagggcgcgtttaaatgcatatggcagcagaatgcgcagcgtatctttgcggctcatgccgagcgcggcacacgattgccactgtccggaaggaatcgcacgcaccgcaccgtaaaacagctgcgtggtgtaagccgcgctgttcagcgacagcgccagcatcgcgcacagccagggctgcgacagtaaatgccacagccaggggatctgctggatcgagggaaactgtcccggaccgtaatagatcaggaagatctgcaccagcagcggtgtgccggtaaacagtgtaataaagcctttgaccagcgggttgaacaccggcgttttcagcgacagcaccacggtgaagagcagcgccagcagcagggccacgaccagcgaggctgccgtcagcgtcaggctggtatgcaaccctttcaggagttcaggcagataggccagcattagctgttcccccgttcaaagcgggtggtgcgcagttcgatgcggcgtaacaccgcctggctgaacagcgtgatcactaagtagatagcggccgccaccaggaaccaggtaaacggctcctgcgtgcgggtggcaatacttttggtttgcagcatcagatcgttgacgctaatcagcgagaccagcgcggtatctttcagcagcaccagccactgattgcccagaccgggcagggcgtgacgccacatctgcggcataatcagccggagaaagatggccgattttttcatgcccagcgcctgacccgactcccactgacccatcggcaccgctttcagcgcgccgcgcagcgtctgcgaggcgtaggcggcatagagcatcgccagcgcaatcacaccgcacaggaacggactgacgtcgaagttttcaatttcaacctgaatcggtaactgaaacaggccgaaattcagggtgaagccgtcagagagggtgagcagcagctgtgaggcgccaaaatagataaacagcaccaccagaatttccggcaggccgcggatcagcgttaccaggccggtgccaatccacgccagcggtttcaggcgcagtgactcccagccagcgaaaatcatcgccagcaccaggccagcgatgagagcacaaacagcaaggccgacggtcatgccggcggcgcttgcgagggtcatcatttcattcatcagagattactgctggaaccatttgctgtagatggttttgtacgtgccgtctgctttgatcttatccagcgcgccattgaacttggtttgcagatcggtgttaccggtacgtaccgcaatgcccaggccggtaccaaagtaggctttgtccgtgactttctcaccaacggcagccagcgcggcattctgcttcagccactcgttgacgactgcggtgtcaccgaacacagcatcaatacggccatttttcagatccagcaccgcattctgatagctgtcgtaaggaacggtggtgatttcgctgtgtttctcagtcaggtatttctgatgcgtggtgccgtttctggacgccaacacgcttgcctttcagcgcttccacgctggcgactttgcctttctgggcaacaaacagcgcggagttgtcgtagtaaggcttggtgaacagaacctgtttttcacgatctggcgtgatatccatgcccgccatcaccgcatcaaagcgacggaatttcaggctcgggatcaggctgtcgaacgcctgattggtgaaggtgcaggtcgcgtcaatctctttacacagcgcattggccagatcgacatcaaagccctgaatcttgttgtccgcatccacaaactcaaaaggaggataagaggcttcggtcgcaaaacgaatcgtctgtgccgccgtagcgctcaggctaaaaccagcaagcagtgcagcaagtaccatttttttcatttttagcatcctgacttagtgcgaaagatagtgagcaaacgcctcggtttgcggctgtgtaaagcggctggcatcgccctgttccacaatgtgaccgttctccatatagacgacgcggctggccgttttacgtgccacctccacttcatgggtcacaatcacctgggtaatgcgggtctgggccagttcgcgaatgatactgacaatctgtgcggtaatttcagggtccagcgcggctgtcggctcatcgaacagcagcacctgcggctccatcatcagcgcgcgggcaattgccacacgctgctgctgaccaccggagagatgcagcggaaagcgatcgctgtagggcgtcaggcgcagccggtcaagcagcttgtcggcgcgggcgcgggcgtcacttttgctgagacccagtacccggcagggcgcttcaatcagattctgcagcacggtaagatgcggccagagattgtactgctgaaacaccataccgacgttctgacgcagttcgcgaatcgcagcatcggagggtttctggctgaagtcgaactgattaccggcaatctgcaactgacctgaacggggttgctccagcaggttaagcacccgcagcagcgaactcttacccgcaccgctgggacccagcagtaccagggtctcgccttgcggacactcaaggttaatgtcgaacagcgcctgatgagcaccgtagaagcagtttattgcgtttagttgaatactcatgcgccagatttgaatagctattagtgtcgcggattttaacgtcaccagaatagttatgcaaataaggtgggttaaaatttgtaaaacagcaggctaaccgcaaaagcttagcacaatatcatgcactgcctgggagcagcgcgctgcagcgggacgggcggcggaaataaaaaaagcgcagcgcccgggggcgactgcgcttctctgaacggttaagcctgaggttattttttcgatttctcaagcatctggctcaggctgccaccctctgcatgcgcagggttggccatgtagcgcacatcatccaccacccagcaactgccctgatggatcatcagcacttcatcctgccactgcttgccgtcgcggctcaggtcgacccgcagcgggatgttgcgtgcatcgcggttcggaatggtggaagcatcagcgacgctggcggcggtcggaccctgtgacaggctggagaagagatcgccattgcgccactgtgcgcctgcattgctgccgctggccgcctgcaatgagtggtacagcgcatcactcaggtaagggcgatattttgccagggtgttgctgtcgggcagaccctgcgtaggctgttcgatacgcaggtcgtaaaactgctgggccacctggtcaggaccgccttcaatgcacggtgcggtacgtgggccattatccttaatcactggctcaacggtggtacaggcgctgagcagcagggccgccgggatcattagcgcaaacgcgttgtttctcatctcgatttccttatggttctctggcaaggtgccctttttagcatagagtatagccgtgctttttagtcgaaagagccttagcccggttttcaacaaggagaatgcgatgaaattttcaacaacccccacgctggaaggtcacagcatcagcgaatattgtggcgtcgtcaccggtgaagcgattctgggtgccaacatcttccgtgactttttcgctggcatccgtgatgtggtcggtggccgctccggtgcttacgagaaagagctgcgcaaagcgcgagagatcgcgtttgaagagctggaggagcaggcaaaagcgctgggcgccaacgccgtggtcggtatcgatattgactacgaaacggtcggcaaagatggcagcatgctgatggtaagcgtcagcggcacggcggtgatcattcgttgaaacggtggctgtggctgatactgtcgctgctgctggcgggctgccagtccgggatagaatcccgtgacggctactgggccgatctgcggcatccggcgcagggcgcgcgaccgcgggtgaagatgatagtgatccactacaccgccgaagatttttcttcgtcgctggcgaccctgaccgatagggaagtcagcgcccactatctgatcccccgccagccgccacagcgcgccgggaaaggcgttatctggcaactggtgccggagcagcagctcgcctggcatgccggtccaagcttctggcgcggagccagccgcatcaatgacacatcgattggtatcgaactggtgaaccagggttatcgccggaccctgacaggtcttgaatggcagccatttaccgctgcgcagatcgccacgctggaggcgctgctgcgcgatattgcacagcgctacggcatcgcaccggaaaatattgtcggtcacagtgatatcgcgccgcagcgtaagcaggatcccggcccactctttccgtggcatcagctggcccagcgcggaatgggtgcctggcccgatgccggacgagtgcagtttcatttagcgggtcaggatccgcacgcggtggtgcccgtggagccactactggaaagtttgcagcgctatggctatccggtgacggcagggatgagcgcgcgtgaacagcagagggtaatcgccgcatttcagatgcatttccggcctgaggattatcgcgggcagcccgatgcagaaaccgccgcgatagccgccgcgctactggataaatatggcgcggcgcaatagcggattattggtgtaaaaacgccttccagtgggcgacgacctgcgccagtgccgcacgatcagcatccagatgggtgaccagacgggtgcgggttcctgcgctgattaacaccccgcgcgccttcatccactcacctaatggtttgacctgggcttccggcaccgccacaaacagcatgttggtctgctgatcgatgacctgaacgcccagctcatgcaactgctgtcccagccaggcggcattgtcatgatcctcctgcagccgcgccacattgtgttctaacgcatagagacccgccgctgccagaataccggcctggcgcatgccgccgccggtcattttacgccagcgacgtgcgcgctcaatcagcgccgtgtcgccacacagcagagaaccgacaggcgtgcccagacctttagagagacagatggtcagggtgtcgcagtagcgggcaatcgccgccagcgtggtctgctgcgcgactaccgcattgaaaatgcgtgcgccatcaatgtgcagcgccagctggtgctcgcgggtaaaggtccacgcctgttccagatacgccagcggcaggactttaccgtgatgcgtgttctccagactcagcaggcgggtgcgggcaaagtgaatatcgtccggcttgatggcggccgctactacgtcgagcggcagcgtaccatcgtcggcggccagaatcggctgtggctgaatactgcccagcaccgccgcgccgcccgcctcatatttgtagttgtgcgcctgctgaccgacgatatattcatcgccgcgttcgcaatggctgagtagcgccaccagattcgcctgggtgccggtcgggaaaaacagcgccgctgctttgccgctcagccgtgcggcttccgcctccagcgcatttacggtggggtcgtcacggtagacgtcatcaccggtttcggcagacatcatcgcgcttaacatggcggcgctgggccgggttacggtatcactgcgtaaatcgatcaccctatgctcctgaacgtggcggaagaaaaaaaaggcgggcatcgcgcccgcctggatggagtctctgttttaccgcagccagttggttttcgccagttctaccacctcatcaccgcgaccattcatgatggcgcgcagcatgtagagactgaagcctttagcctgctccattttgatctccggcggcatcgccagttcctctttggcggtaatgacatccaccagcaccgggccatcgtgggcaaacgcctgctccagcgcgccattgagatcagatgccttttccacccggataccccggataccgcaggcctcggcgatagcggcaaagtcaggattctccagctcggtgccatcggtgagatagccgcccgctttcatctccatcgccacaaagcccagcacgctgttgttgaaaatcaccagtttgaccggcattttcagttgcgccagcgagataaaatcccccatcagcatgctgaagccgccgtcgccacacagtgccaccacctgacgattgcgatcaatcgactgcgcgcccagcgcctgtggcatcgcgttcgccattgagccgtggttaaacgaacccagcaggcgacgtttgccgttcatcttcagatagcgcgccgcccagacggtcggtgtcccgacatcgcaggtaaagatggcgtcatcactggcgtagtggctgatctgctgtgccagatattgcggatggatcggctgcttgtcgttgggctgcgccagttcgtccagacttttacgtgcctcgccatagtgcttaaccgcgctgtcgaggtggctgcgatcgcttttgtgcgtcagctgcggcagcagcgcctgcagtgtgcttttcacatcgccgacataggcctgatcgacgtgacaatgtgacccaaggctgcccggattgatatcaatctggatgattttagccttttccggatagaaggcgcgataggggaactgcgtgcccagcaacaccagcgtcccggcattcatcatggcgtggaaaccggatgagaaaccgatcagtccggtcatgccgacatcataagggttgtcatattcgatgtgttctttgccgcgcagcgcatggacgataggggctttcagcgcttctgccagcgctaccacctcctgatgcgctccggcgcagccactgccgcacaacagcgtaatatcgctggcttcgttcagcgtctgcgccagctgcgccagttcggcgggctgtggcaggacctgcggcaactgtggcggataccattccgcgctggcgctctctggcgccagtttaagcgcgacatccccaggcagcaccaccaccgagacgccacgattcagaatcgctttacgcatcgcgatgcccagcacctgcgggagctgctcagggttcgaaaccagttcgcagtagtggctgcattcgcggaacagctcctgcggatgggtttcctgaaaatagccgctgccgatttcgctggagggaatatgtgccgcaatcgccagaacaggaacgcggttacgatggcaatcgaatagaccgttgatcagatgtaagttgcctggcccacaggagccggcgcagaccgccagttcaccgctgatgtgcgcttccgcgcccgctgcgaatgcggcgacttcttcatggcgcgtcggcatccattcaatggtgcccatgcgattaagactgtcgctcaggccgttaagggaatccccggtgacgccccagatgcgttttacgcccgcgctttccagcgttttggcgaccagcgccgcgacggtttgtttcatgctcttctcctttgtcggcccgccctgaagagtgacgtgaccagaaccgaaaaaagaagcgtagacgacacggcagaaaagcaggcgtgaaaaaatgcgctggcagagctcagcgcatatcagacaggattcaggcggagaagagggcgataagaatcggggccagcaggctcatcacaaagccgtgcacaatggcggccgggacgatctcattgccgcccgcccgctgcagcaccggcagggtaaagtccattgaggtggcgccacacaggccgagtgcgctggagcgatgacggccaatcaacgccggaatgagcatgattgccaccagttcacgtatcaggtcgttgaagaaggcggcgctgccgatgaccggaccaaaagcttcggtcatcagaatgccggagagagagtaccagccaaaaccactggctaacgccagaccggttttcagcggcacgcccagcagcaacgccgcaatcatgccgccgataagcgcgctgaccagcaccacgctggcaaccagcaggccacgacggttcaggataatctgacgcagcgtcatgccgctgccgcgcagctgaatgcccaccagaaacagcaggaagatcagcgcatattcgctggccgtcgaggcgtggtgcagcagtggccactgggtcaggccaagcagaaaaccgatgacaaccacgccgcacagcttcagagagtccagcgccatatgcagccgcgagggcagtttctcctgccggtgtgcatgctgccagggggcatatttttccagcccgcgcagcgccagcaggttgcacagcagaatgcagaaggccgctaccagcgcggtgtgaaataccgccagcagattgctgctcaggttgtcgagaaaggccaggctgatgcccataaagaacagaatgacgtaaaccatccagcccagcagctgattgacccggcgcagggttgaagtttgacggaacggtagcagccagccggcgatcagcggcagcagaataatcaggagtccggagtacatagcgataagggccatccatggtggaagaggccacacgctagcgaaaaagcgtaacggagtaaaccctgagaaagcggcttgaccggctcgctggcggcaaccatgctgtttataaactgaggatggacgcctatgattctggaacatatcgacattcgcggtttccgcggcatcaataagctctcactgcctttaacccagaccaatctgctgattggtgagaacgcctggggcaaatccagtctgctggatgccctgagcctgttactttcggcccatgaaccggcctatgtttttaccgaggctgatttccatttcaccccaggcgatgtgactgatgcgatgcgccgtctgtcggtggtgttccactttcgcgatgacggcaacgacccggatgcggtgctctcgaccttctggcagcgtgatgctcagggccagcgtcagctctgttacagcgtcagcgccacctggcgtgacagcggtatcgaaacccgccgccgttttgttgacctgaactatcagctgttgactgagcagaactgcgcggcggccatcgatcttttgctgaaacggtatccggttctgcgattgcgcgatgcgcgtttcagtaagcggacgcggagtagtgcgccgctccccaccgcacatcctgagctactggcgggtatggagacgctggcgcgcgatctggagcaccatccgcaacagctcagcgatgaggtgctgcggcaggggctgaagacgatgcagcaactgatgcagcactacttcctggtgcagccgcctgatgcgggcaacgaggtcaggctacgggatccgcagacgcgcgaggggggacagggatggcgggcgctggatcacctgaatcaactgattgccggaaccgactcccgcagccgtcagctgatactgctgcagatgtttaccctgctgattgaggcacgaggagacgtcccgctggccgctggtgcacgcccgctgctgctgattgaagatccggaaacccggctgcatccgattatgctgtcggtagcatggaatctgctgaggctgctgccgctgcaaaaaatcgccaccactaattcgccggagctgctgtcgcaggtgccggtggaaaacgtctgtcgtctggtgcgtggaccctcgcgcgtagcggcctggcgcatcggtccggagggactgagtgccgaagagagccggcgcatcggcttccatattcgggtcaaccggcctgctgcgctgttcgcccgttgctggctgctggtggagggagaaaccgaagtctggatcatgaatgagctggcgcagcagtgcggttacaacttcgccgctgaaggcgtgaaggtgattgagtttgcgcagtcggggttaaaaccgctactgaagtttgcccggcgcatgggtatcgcctggcatgtcctgactgacggtgatcaggcggggaataaatatgccagtacggcacgcactcagttacagccgggtgaaccggagccgcgttttctgacgcagttaccggcgctggatatggaaaattttctctatcagcacggctttcaggatgtctatcatcagatggcgcacctgccgttaaacgttccgatgagttccaggcgtattattactaaagcgattcaccagagctccaagccggaaactggcgatcgcagtggctacgtcggcggcggaacgcgggccagaggccatcccgccattgatgcggcagatgtttgcccgggtgattagactggcgcagggacaggcagattaggtgacatcgaacaggaaaatgccagcggcactggctggcatttttgggtctttgttcagaaaggcgatatgtgtcaggccacagcctgcacctcgaccggcacgatcaggctggcgtgattgcctttcgggccttcgtggacatcgaactgaacctgctggcctgccttaagcgtgcggtagccttccatctgaatggtggagtagtgcgcaaaaatatcttcgccaccgccaatcggacagataaagccaaagcctttggaattgttgaaccatttaactgtgcccgtctccatgcttttacttccctcgcaagacattttataagtaggtgaggtcatcgaagctgtgagtcggatttgattaaaactcaatcagcctgtgcagctagaatgtagagaaagcgcggctgacgtcaagcaaaccaccgggccaggtggggaaaaaatcatcaaaatttgaggcagttaacgctattgcaaattttgtgatgcaggtcgcgcaggggaatttctgaataaattttcagcagcggcatgcggcttgacaggcatgttaaactctcaatatgtagctacttaaaggctaaaagcaaaatctcaacggaacactatggcaaacgcaaacgactggcttaactttgaacatctggccgacgataaagtacgtgaagggttaaagccgccttctatgtataaagtcattctgaataatgacgattatacacctatggaatttgttattgacgttgtacaaaagttcttttcttatgatgttgaacgtgcaacgcagctgatgttgaaagttcactatcacggcaaggcgatctgtggtgtatttactgcagaagtcgccgaaacaaaagcggcccaggtgaacaactatgcacgggaaaatcatcatccgttgctgtgtacgctggaaaaggcctgaacccgtctccatataggaaacaggtaagggcgataattgggggaggtgcctaatgctcaatcaagaactggaactcagtttaaatatggctttcgccagagcgcgtgagcaccgtcatgagtttatgaccgtcgagcatctgttactggcgttgctcagtaacccgtcggccagagaggcactggaagcctgtacggtggacattgtggctctgcggcaggaaactcgaagccttcatcgaacaaactacgcccgtgctgcctgccagcgaagaggagcgtgatacacaacccacgcttagcttccagcgcgtcctgcagcgtgcggttttccatgtccagtcatccggtcgcagcgaagtctccggtgcgaatgtgctggtcgccattttcagcgagcaggagtcgcaagcggcttatctgctacgcaaacatgaagtgagccgccttgatgtggtgaacttcatctctcacggtacgcgtaaagatgagtccggccaggcgccaggcgcagaaaatccggttaacgaagagcaagcaggcggggaggagcgtatggaaaacttcaccaccaatcttaatcagcttgctcgcgtcggtggtattgatccactgattggtcgcgataaagagctggaacgtaccgttcaggtgctatgtcgtcgccgtaaaaataacccgctgctggtgggtgagtcgggtgtgggtaaaaccgccattgctgaaggtctcgcctggcgcatagagcagggcgatgtaccggaagtgatgaaagactgcacgatctactcgctggatatcggttcgttattagccggcaccaagtaccgtggtgactttgaaaaacgtttcaaagcgctgctgaaacagctggagcaggacgaacacagcattctgtttatcgatgagatccataccatcatcggtgcgggtgctgcatccggcgggcaggtcgatgctgcgaacctgatcaaacctcttctttcctctggcaagattcgggtgatgggttccaccacctatcaggaattcagcaacatctttgaaaaagatcgtgccctggcgcgtcgcttccagaagatcgatatcacggagccttcaccagaagagaccgtgcagatcctgaatggcctgaagaccaagtacgaagcgcatcacgatgtgcgctataccgcgaaagcggtgcgcgcagccgtggaaactggcggtgaaatatatcaacgaccgtcatctgcctgacaaggcgattgatgtgattgatgaagcgggtgcgcgagcgcgcctgatgccagccagtaagcgcaagaaaaccatcaacgtctctgacattgaaacggtggtggcccgtattgcccgtattcctgagcaaagcgtgtcagcaagcgaccgcgatacgctgaaaaatctgggcgatcgtctgaagatgctggtgtttggtcaggacaacgccattgaggcgctgacggaagcgatcaaaatgagccgtgcaggtctgggtcaggatcgtaagcccgtcggttccttcctgtttgccgggcctaccggtgtcggtaaaacggaagtcaccgtgcagctggcgaaagcgctgggcattgagttgctgcgctttgatatgtccgagtatatggagcgtcacaccgtcagccgtttgattggtgcgcctccgggttacgtcggctttgatcagggcggcctgctgacggatgcagtgattaagcatcctcatgcggtggtgttgctggatgagattgagaaagcacacccggatgtcttcaacctgctgctgcaggtgatggataacggtatgctgaccgacaacaacggtcgcaaagcggacttccgcaacgtggtgctggtcatgaccactaacgccggggtccgcgagactgaacgtaagtcgattggcctgattcatcaggacaacagcaccgatgccatggaagagatcaaaaagatgttttctccagagtttcgtaaccgtctcgacaacattatctggttcagtcacctgtcaccagaggtgatccatcaggtggtcgacaagttcattgtcgagttgcaggcgcagctggatgccaaaggcgtgtcgctggaagtcagcgatgaagcacgcgactggcttgctgagaaaggctatgacaaagcgatgggcgctcgtccgatggcgcgcaccgtgcaggacagcctgaagaaaccgttagccaatgaactgctgtttggttcgctggtggatggcggctcggtgtcagtggcgctggatcgtgagaaaggtgaactgacctatcacttcctgagtgctgaaaaacgcaaaaccgaaggcacggtgcattaatcacctgctgcagatatgaaaaaggccggattaaatccggcctttttttttcgctgcaaattgcagagcgatgagattactgcaaattagcgactacggaagacaatgcggcctttgctcaggtcgtacggggtcagctcaacggtcactttgtcacccgtcaggatgcggatgtagtttttgcgcattttaccggagatatgagcagtaaccacgtgtccgttctcaagttctacgcggaacatggtgttaggtaacgtatccagtacggtaccttgcatttcaatattgtcttctttggccatcgaatcctctgggtgtactacctttcagttgaaccggcaagataatgcccaattcaacgatttatgtaaagaaccgtcggcgattttgccaacgctttgccggggtgcacgtcagtcgcgcgcatccggtaaaattagggtgtttatgtgacgtctgcgggggattagcgggctaagaatctgtatcaaccggttacacgcgcacgattgaaaacagttccgagagtgcgttgagattcccagcctggcaattccggctcgttattgcgaagcgcggacgacataccaaactcgaccattataccacttaatacgcctttatgtgtgcaaaacatctctgtgcgactaaaaaagggtttgtgtctgccagcagccatcgctgacaggctggcacgcaaggctttgtacatattgcagatagtctgcgcgcggtatctcctgcgcccccaaagaggccgtatgagggttaagtacctgacaatccaccagacggccctgatgtctgaggaaatgctgacaaaatacccaaagtgcggtttttgacgcattctgctgacggctgaacattgattcgccgcagaagatttgccccatcgccagcccatacatgccacctgccagctgatgttcgtcccatacttcaatggagtgggcgtggcccagttcatacaatcgcaaccaggcgcgcttcatttcaaaggtgatccaggtgccttcctcacgaccggtggcacagccctcgatcacctcggcaaatgactcattcatcgtcacccgatagggcgaacggctgtggaaacgcttcatgctccggctgagatgaaactgctcaggcaacagcactgcacggggatcgggcgaccaccagagaatcgggtcgccagaagaaaaccacggaaagatgccgcgctgataagcgttaagtaaccgggcaggggagagatcaccccccatggccagcaggccgtttggctcgcgcagcgccatctccggtgggggaaattgcaaagattcccgtgacagttgtaccagtctcatcgcgttatgttacccatcagcatttcgctaagactatagcgcaatccgctgccggaaacgccagtaccgacccgcttttgagattaattcggcatgacttccctgttccacaatcacgccattatccatcacgcagatgcgatccatctgctccaggccgctgagccggtgggtgaccattattacggtcttgccagcggtcagccgctgcagcagggtgaggatatgctgctcggttgtggcatccagtccttcggtgggttcatccagcagccagagatcgccgttatgcagtaacgcacgcgccagcgccagccgacgcagtttcgccgcctgacagcgggcgaccgccttctcccatccaggcgtttaatccttccgggctctcaagcaggcgctgcaggccgacgtcattcagcacgcggcgtaactgctcatcagtagcatcgggacaggccagcagtaagttatcacgcaggctctgactgaagagatgaacccgctgagtcaccacgctgatgcgctgacgcagcgctggctctgaccatgcggtgatcggcaggtcattcaggctgatgacaccgtgctggctatcccagccacgggtcaacagcgccagcagagtggatttgccgcagccggtcggccccagcagtgcaatgtgttcaccggctgccaccttaagggtaaagcggttcagcaccttatccgggcggtcgggatagctgaagtcgagctgatcgatagcaaccgcgagtcgtcctggccgggcgtctgaatctgccggaaaggtgatagcgggtgactgatcgataatgtcattgactcgctgagcggcatttatcacctgcgacatgggcagaaaggcccctgcaaccggtgccagcgcctcgaaagcagccagcgcgcaaaacaccaccagggcaatcagcgagccgggcaactgctgctggctgattgtcgccgcactgagccagagcaacagtgtgacggttacgccgctgatcagcagcagcaggctctgtgccgcagcctgcaagcgctgttgctggctctgagcctgctgccagcgctgttcatcttcatcaagttgctgacgccagccccgcgaggcaccgtacagggtgagttcagcctgagccgccagccactgcatcagctgtaagcgccagcgggcgcgcccacgggcaatcgcgccgcttgcgggcgatcccagacggtaaaacagcgctggtatcaccaccagggtactcagcatgatgccgcccagcgtcagtgccagctgaagatcgatgaagctcattccgagggtaaccacgacaatcaccaccagtgcgccgatcagcggcgagatgacgcgcagatagagatgatccagcgtatcgacatcggccacgaagcggttgagcagatccgcctgccggaaccgcgaaagctggcctggcgaaagggccatcaggcggctgaaggtgtggacacgcagatgctgaagaaccctgaatgttgcatcgtggctgaccagacgttcagcatagcgtgcggcagtgcgaatgatggcggcgccacgcacgcctgccgcaggcagcatatagttgaaggtatagagaccggctacgcctgccactgacgaggcggccagaaaccagcctgaaagcgtcagcagaccgatactggccagcagggtaacaatcgccagcacgatgcccagcgccaggcgataagggtggcgcagccagagacgaagaaaaggacgcaaggcggacatcagcgaatctcctgttgacgatgcttcagcatctcactgaaagcacccggctgttgcgacagctgctgccagttaccctgttgcaccagcttaccggcttccattacccagagggtctgccagtgacttagcgtatcaatctgatgggtaatcatcagcgtggtctggcgggctgccgcctggttcagtgccagcatcacatgacgttcactgagcgcatccaggctggctgcgggttcatcgagcagcaaaaaatgcgaggatttatagagtgcgcgcgcgaccgcgacccgctgcgcctgacccaccgacagctgattaccgccatcgccgggctgggtgtcaatgcccttgggcagacgaggcaggaactcattaatgccgcacgactccagcagcgccgcaaaacgctcgtcatcccaggccgcattcatcacgatgttgtcacgaaaggtggcggccggtaactgaggattctgtcctacccaactgagctgctgatgccagtcactccgtcgtatatcgcgaagttcaacgccattcgctttcagcgaaaccctgataaggcagaaaaccgagcagggcgttcatcagggccgttttaccggccccgctttgaccgaccagtgcaatctgttcgccagggacgacagtaaaagagagcgggccgcacaacacctgaccatcaggcgcacagacacgcagatcttcggcagtaagtgcgattgagcgatcggcggtgaagggcaactggccttcctgcggcgcggtggcaggcgtcgcctgcataaaggcttcaagggcatcggcaccgcctacagcctgggctttggcgtgatagaaagcgccgagatcgcgcagcggctggaaaaactccggggcgaggatcagcaccagaaagccggcaaacagcgtcacgccctggccgtaatcaccaaaatgcaattcgcccagataggagaagccaaagtagacggccaccacggcaatcgccagcgaggcaaaaaactccagcacggcagaggagagaaaggctaagcgcaatacttccatggtgcgctggcgaaaatcggtggtggcggcggcaaccgcctcctgctccgctgcgccacggtgaaacagccgcagcgtctctctgccgcgcaggcggtcgagaaagttaccgctcaggcgggccagcaccaggaagttccggcggttggcctcggccgcacccatcccgaccagcgccataaacagcggaatcagtggcgcggtggcaaacaggatcagacccgccgtccagttgagcggaaaaatagtcagcagaatgcagcaggggatcagcaccgccagggtcatctgcggcagatagcgcgcgtaatactcctgcatctcttcgatctgctccagcagcagcgtcgcccaactgccggctggctttccctgaatccacgccggccccagatcagataaccggtctaatacctgctgacgtaaagcctgacggatagcctgtccggcacgataaccggtcagttcacgggcatagttaatcagggcgcggagcacaaagcagagcagtagcagcagaatgctgacagtcaaggattcacgcggctgctggtcaacaatcagagcctgcagcagcgaggccagtaaacccgcctgagcaatgatcagaagtgcacttgccatgcccagcagggtgttgagtcgcaaccagcgaccggcgaaatgacgttgctgacgaagccagcgggtaagatgctgctgccgcgatttgtccatgcgagaccatgatgaatgtcgatgacgggtgaaaatggaaagacatttccatctcttcaggcgcaagaatctagcatgagagcaataaaaaaggcgacggaaaaaccgtcgcctggaacatttgagatcagagggttaacaacttaccgatcgtttttaaccagtccgtcaagaaagcgctcagcgtctaacgcggccatacagccggtgcccgcagaggtgatcgcctgacgatagatatggtccatcacatcgcctgccgcaaagacgccagggatgctggtctgagtggcgttgccgtgcagacctgactgaactttgatgtaaccgttctccagcgccagctgaccctcaaaaatggccgtattcgggctgtgtccgatagcaacaaaaagacccgccacctccagcgcttctgtctcatcactgttctgggtagaacgcagtgtcagaccagtgacacccatctgatcgcccaccacttcttccagggtgcgatgggtgtgcagcacgatattgccattgcgcactttttccatcaggcggtcgatcaggatcttctctgcgcggaagctatcacgacggtgaataaggtgcacttcagccgcaatattcgccaggtagagcgcctcttccacagccgtgttgccaccgccaatcaccgcgactttctggttgcgatagaagaagccgtcacaggttgcacaggcagagacgcctttgcctttaaaggcctcttcggaaggcagaccgaggtagcgcgctgacgcaccggtggcgatgatcagggcatctgccgtgtattcgccactgtcacccgtgaggcggaacggacggttctgcaaatcgacggtgtgaatgtgatcgaaaatgatctcagtattaaatttttcggcatgctcatgcatccgctccatcagcgatggacctgtcagatcgtgcgggtcgcccggccagtttctccacctcggtggtagtggtcagctgtccgcctttttccagacccgtgatcagtaccgggttcaggttggcgcgtgcagcataaacggctgcggtataacccgctgggccggagcccagaatgagtaacttactgtgtttggccgtactcatgcgttcctcagtttcattcggctgacatagcctgcgattgtagggaatatccggcgacaatgacaaggcttaggcaattttgttaacgatagctgcaaacggcgtagacgatgagcgacggttttgcctggccaatgcgccaaaagggggcaaaactcgggtcagaggggtgcaatagtggaaaaatagtcatttaaaaacagatacccagcggactgtctggcatcttgtcctgaatttggtgattttactttgacaatcgcctgcgcttttgcgaaaacattatcagaagcgaataacatttatcggaacaaaacaggttttcatcgcccgttttgcacgtaacgccgaataaaagcagcctgatatggataatgacgcatgatgtggacagacaacatgcgtcatatcgataggtgtcagaacacaggctctgttagctcacttcagaaatgccccgaacaatgagcgttttcagggcgtggcaggtaaagggaaggaattaagagagacaataataatggtagacaataagaaacgccccgggaaagacctcgacagaattgacaggaacattctgaatgaacttcagaaagatggtcgcatttcaaacgtagagctttccaaacgcgtaggcttatcgcctacgccatgtcttgagcgcgtgcgtcgtctcgaaacgtcagggatttattcttggctacaccgcgcagctgaacccgcactatctggatgcgtcgctgctggtgttcgttgagattactctgaatcgtggtgcaccggatgtgtttgagcaatttaacgccgctgtgcaaaaacttgaggaaactcaagagtgtcacctcgtttccggcgatttcgactacctgctgaaaacgcgcgtacctgatatgtcagcctaccgtaagctgctgggtgaaaccctgttgcgcctgccgggcgtaaacgacacgcgtacatatgtggtgatggaagaggttaaacagagcaatcgactggtgatcaaaactcgctgatgcggggcaggtgcaaaacctgtgagatttcggtacactcctgtgcattcatacaggatcagcgtcgggctcgcccggcgctgttgcttcttactttacaggcacctggagagtcctcttgagccaggaatatacagaagataaagacgtttcgttacaatcgatgagcagtggacgtcgtctgctggaagcgatgctcattctggtggcgctgtttgccatctacctgatggtttctctggtcagttttaacccttccgacccgagctggtcgcaaacggcctggcatgaacctatccacaatatcggcggcagcgtcggtgcctggctggctgacaccttactcttcatttttggtgtgatggcgtatgccattccgcccgtcatcctgggtctgtgctggattgctttccgtcagcgcgacagccaggactactttgactactttgccgtcgggctgcgcttaattggcgtcctcgcgctggtggtgacgacctgtggtatggcggcgctgaacgccgatgatatctggtactttgcctcgggcggcgtgatcggcagcctggtcagtaatgctattgcaccctggttcagtccggctggcggcacgctgatgctgctctgcgtctgggcggcgggcattaccctttacactggctggtcatggctcaccattgcagaaagaattggtggcgtagtcatgggcgtactgacgtttgccagcaaccgctcacgtcacgatgaaccctggcaggaagaggatgacgagcgggacgcgcgtgaatacgcggatgtgcctgagcttcatgccgccgatcaggatgatgatgtgctgctttctgccccacgtgcagctgttgagcctgcggcgtcacaacaggatccgctgctggctaaagctgcagcagccaccagtgcggcagtcgcggccaccgctgaagccgctgaggtgaccctcgccccggcagccacggtgacgcctgcacctgtcgccgcacctgctgctgctgcggtttcagcttcggcgcctgccgcgtcagcgacatccatccctgcatcgccgtctgcacaacctgcgcctgcgtacgcacagagcgcgccagctccgcagagtgtggcgaattccccggcgcagagtgcttctgcacccgcagactcaccaccgctttatcattttgaaatgccagacgacgctccggctacgccgtcgttcagtgcttacgacgatgatgaacctaaaatgggtaactggcgggatacgtcagccatccctgcggcatcggcggcagcggcatccgctgcaacggcagcccaggcaacaacgcgtactgcgcctgtttttgatttagcccctgaaaccaatctcaatccgcaggttaaacaaggtatcggcccggcactgccgcgtcctaacccggtaaaactgccaacccgtcgtgagctggcctcttatggcattaagctgccttctcagcgcatggcagaagagaaagcgaaaacggaagagaccgaaccggttagtgctggctccgtttcctctgctccggatgctgaagaggcgctgcagcaggctgaattgcgacaggctttccagtctgaacagcagcagcgttacggcaccagctggcagcaggacgaggaagatgaacaggatgcacagcagcaggatgcactggcgcgtcagttcgccgagcagcaacagcagcgctatgagccagaagtgaaaaaagagccggtattcaatattgataccgcctcagcgtttgatttttcaccgatgaaagatctggtggatgacggtccttctgaaccgctgtttaccattgcggcgacgccagaacctgaagctccagcggtttcacacgaaccctggcagcaggtgagtgaggtttcaagacctcaggctccggctcatgttcctgcaccagccagctttgccccggcagaacctgcctatagcgcgccggcagcaccgtctgaacctgactatgctgcacctgcggcaacctctgcacccgcttatggtgcccctgcggctcctcaggctccggcttacgctgcgcctgcctatggcacgccagcggcagcgccggttcagccggtggaagaggcgaaaccttcactgcatgacagcctgattcatccgttcctgatgcgccatgagcagccgctggagaaaccttccacgccactgccttcgctggatctgctgaccgcaccgcctgaagaggaagagccggttgatatgttctcgctggagcagactgcccgtctggtggagtcgcgcttaggcgattatcgcgtcaaagcggaggtggtcggtatatcgcctggcccggttattacccgtttcgaacttgacctggcgccgggcgttaaagcggcgcgtatctccaatctgtcccgcgatctggcgcgtttcgctgtcgacggtagcggttcgtgtggtggaagtgatcccaggcaaaccctacgtaggtctggaactgccaaacaagcatcgtcagaccgtctatctgcgtgaagtgctggattgccctaaattccgcgacaacccttcaccgctggccgtcgtgctgggcaaagacattgccggtcagccggtggtggccgatctggcgaaaatgccacacttactggtcgccggtaccaccggttccggtaagtctgtgggcgtgaacgccatgattatcagcatgctgtataaggcgacgccggaagaagttcgcttcatcatgatcgacccgaaaatgcttgagctgtcggtctatgaaggtattccgcatctgctgaccgaagtggtcacagacatgaaggatgctgccaatgcgctgcgctggagcgtcggtgaaatggagcgtcgctacaagctgatgtcggcgctgggcgtgcgtaatctggcgggctacaacgaaaaagtggaacaggccgaagcgatgggtcgtccgattcccgatccgttctggaagccgggcgacagcatggatatgacgccgccggttctggagaagctgccttacattgttgtgatggtcgatgagtttgctgacctgatcatggcagtcggtaaaaaggtggaagagctgattgcccgcctggcacagaaagcccgtgctgccggcatccatctggtactggcgacacagcgtccatccgtggatgtcattaccggtctgatcaaagcgaacattccgacgcgtatcgcctttaccgtttccagcaaaattgattcacgtaccattctcgatcagggcggcgcggagtcattgctgggtatgggtgacatgctctacatgccgccgaactcctcgctgccgattcgtgttcacggtgcgtttgttcgtgaccaggaagtgcatgcagtggttcaggactggaaagcgcgtggtcgtccgcaatatatcgacagcattacggcgggcgaagagagcgaaaatgccggtggcatcgacagtgatgaagagctcgatccgctgttcgatcaggcggtcggttttgtggtcgataagcgccgtgcgtcgatttcaggcgttcagcgtcagttccgcattggctataaccgcgcggcacgtatcattgaacagatggaagcgcagggcatcgtttctgcaccaggacacaatggtaaccgtgaagtgctgtcgccaccgccacacgatatgtagtggctaaatgttttgaaacacaacgcaatgagccagttccgactggctcattgtttttatgcggttaaaccccatatctgaatcagctttcggctttttcctctgttctgatggcggaacggcggccaggcttaatgcagttatcgatgggaacgtttaaataaggaattgaagcagatgaaattacgcgtaatcgctctgggcctgttggccaccttttcttcagccagcgttctggctgatgcttccagtgatctgcaacagcgcctgaacaaggtcagcagcttccacgccagcttcacccaaaaagtgaccgacagcagcggcgcgaatgtgcaggacggcgaaggcgaattgtgggtaaaacgtcccagcctgtttaactggcacatgaccgcgccggacgaaagcatcatcatctccgacggtaaatcgctgtggttctacaacccgtttgttgagcaggcgacagtcagcctgttgcagaatgcgaccagcaacacgccctttatgctgattgcccgcaaccagtcaaatgactggaagcagtacaatatcaaacagcagggtgacaattttgaactgacacctaagaacagcgacggcaatctgaaacagttcaccatccaggtgacgtccagcgggaccatcaaccgcttcagtgctatcgaacaggatggccagcgcagcgattaccagctgaaaagccagcagaatggcgctatcagcccggataaattcacgttcacaccgccaaaaggcgtgacggtggacgaccaacgtcagtgaggtcacggtgagtaacctgtccctggatttttccaccgaaaatttcaaacctctggccgcgcgtatgcggccagaaacattgaaacagtacattggtcagcaacatctgctgggcgcaggcaaacctctgccgcgcgcgattgaagcagggcacctgcattcaatgatcctgtggggacctcccgggaccggcaagaccacgctggctgagatcattgcccattacggtaacgccgatgtggaacgtatttcggccgtcacctccggcgtaaaagagatccgtgaggcgattgagcgggcccgtcagaataaacatgccgggcggcgcacgatcctgtttgtggacgaggtccatcggttcaacaagagccagcaggatgcctttctgccccatatcgaagatggcaccattacctttattggtgcgaccaccgaaaacccctcttttgaacttaactctgcgttgttgtcacgcgcccgcgtttacctgctgaaatcactgactctggaagatattgagcaggtgctggatcaggcgatgcaggataaagcgcgaggctatggggacagtgacatcgtgctgccggacaacacacgcaggatgatcgctgaactggttagtggtgatgcacgtcgggcgctgaatacgctggagatgatggctgatatggccgaaatcaccgcatcaggtcagcgagaaaaactgacgccgcagctgcttaacgaagtctctggtgagcgatccgcgcggtttgataataaaggcgatcgtttttacgatctgatttccgcactgcacaaatcggtgcgcggctccgcaccggatgcggcgctctactggtatgcgcgcattatcactgcgggcggcgatccgctctatgtggctcgtcggttgctggctattgcctccgaagatgtgggcaatgccgatccgcgcggtatgcaggtggcaattgcggcctgggattgcttcacgcgcgtcggtccggcagaaggggagcgcgcgattgcccaggcgattgtttatctggcttgcgcgcctaaaagtaatgcggtctacaacgcgtttaaagccgcaatgcgtgatgcacgcgaccatcccgattacgatgtgccggaacatctgcgcaatgccccgactaagctgatgaaagagatgggcctgggtaaagagtaccgttatgcccatgatgaaaccaacgcctatgccgcgggtgaagtctattttccgcaggaactggccagcgcgcgctattacaccccaacccagcgcgggcttgagggcaagattggtgaaaagctaagctggctggctgagcaggatcaaaatagcccgacaaaacgctaccgctgaaacagacgttacggtaatgtgggcaatgttttcaacgcattccgctggaatgcgtcccttctttcaaccaactttttatacacaggataagcatgctcgatcccaatctgctgcgtaacgagccagacgcagtcgcagaaaaactggcacgccggggatacaaactggatgtggaaacgctgcgttcgcttgaagagcgtcgcaaagtgctgcaggtggaaacagaaaatctgcaggcagagcgtaactcccgatccaaatccatcggtcaggccaaagcacgtggggaagacatcgagccgctgcgtcaggaagtgaacgcgctgggcgaacgcctggatgccgcaaaagcagaactggatgaactgcagaatcaaatccgtgacttctcactggcactgccgaacattccggccgatgaagtgccgctgggcaaagatgacagcgaaaatcaggaagtgagccgctggggtaccccgcgcgagttcagcttcccggttaaagatcacgttgagctgggtgaagcggctaaaggcctggattttgcgtctgccgtgaaactgaccggttcacgctttgtggtcatgcaggggcagattgcccgcctgcaccgtgcactgagtcagtttatgattgacctgcacaccgagcagcatggctaccttgaaacctacgtgccttatctggttaaccacgaaacgctttacggtaccggacagctgcctaagtttggcgaagacctgttccacacccgtccgctggaagaggagtcagacagcagcaactatgcgttaattcctactgcggaagtgccgctgactaacctggtgcgtgatgagatcctcgaagaggatagcctaccggttaaactgactgcgcatacgccgtgcttccgttctgaagcgggtttcttacggtcgtgacacgcgtggcctgatccgtatgcaccagttcgacaaagttgagatggtgcagatcgtcacgccggagcagtcaatggatgccctggaagagctgaccggtcacgctgagaaagtgctgcagctgctgaacctgccatatcgtaaggttttactctgcaccggcgatatgggctttggatcgactaaaacttacgatctggaagtctggctaccggcgcagaatacctatcgtgaaatttcatcctgttccaacatgggtgatttccaggcgcgtcgtatgcaggcgcgttgccgcaacaaacaggataagaaaccgcgtctggttcataccctgaatggctcagggctggccgtaggccgtaccctggtggcggtgctggaaaattatcagcaggaagatggccgcatcactgtgcctgaggttttacgcccctatatgaatggcgtcgaaattatcggctaagcaacagtaactctctgaacccggccatggccgggttttttttatgttattgctcaggaaaaactgtttagtcaggcctcaatttaatcacaaataaacgttatcgataccagccaggccggaatggctaaaaacctaatttttcatagagatagcatttagcgacctgccgcttcttacgattgtaacccactgaagattagtaaattaaattgtcgcacagcaaaatgtgctgccgttaaaattcgcccattgactttaaaaaggccagtggcaaactgcgcgcaatttccttcatttgctctggtttctatcccctatgtcaacctggtcacgccccgtgatattgctgctttgcggcctgatgttaatgactgtcgcaattgccgtgctgaatacgctcgttccactgtggctgacgcatgacttactgacaacctggcaggtgggcatcgtaagctcctcctattacaccggtaacctcgcagggactctgctggctggctggttaatcaggcattatggcttcaaccgcagctactacctggctaccttgatgtttgccgtcgcgactctgtgcctggcgatgatgtcgggtttctgggcatggagttcaatgcgtttcatcgccggtgtcggctgtgcgctgatgtgggtggtggtcgagagcgcacttctgtgcagcggaacggtacgtaatcggggacagctgctggcggcctatatggttgtctattacatcggcaccgtgacaggccagttgctggtcagcaaactgtctacggaattactcagcgtgattccgtgggtgacgtcgctggtcttctgcgccgtgctgccactggtctttactcgcgtctccgccagcggtgaagcgacagaagccgctccggcccgcatctggccgatgctgcgtcgccgtagctcacgtctgggcatcaatggctgcattatctctggcatccttctgggctcgctttatggcctgatgccgctttacctgtcacatcagggaatgagtgatgccaatgtgggttactggatggcgttgctggtcagcgcaggcattgtgggccagtggcccattggccgtctggccgatcgttttggtcgcatgctggtgctgcgagttcaggtctttgtggttatcctgggggcgatggccatgttaaccaatgctgcgatggcgccagcgctatttgttctgggactggcaggcttcacactctatccggtggcgatgtcctgggcttgcgagacggtcgcacatcatgaactggtagcgatgaatcaggcactgctgatgagttataccgtgggcagtctggctggaccggcaatgacctctgttctgatgcaaaattattctgaccagctactgttcgtgatgatcgctgctgtggcgctgatatatctggtgatgctgctgcgcaaagcgaatcatcaggctacgccagtggcacatgcctgatcgctgaacagcaaaaagggagcgttaagctccctttttttgtggcagattcttcagtacatcacttcgtggccatagctggcgagaatgtttttcacgcgctccattgtctctttgctcggtggcttcaccccgtccagcttgtactcttcacccatcgcaatccatttatgcttacccagctcgtgatagggcagcaattcaatcttctcaacgttctccatgtcacgcgtgaattcacccaagcgatgcgcggtgtcatcatcgtcggaatagccgggcaccacgacaaaacggatccatgtccgtttgccttttttctgcaggtaacgggcaaagtccagcgtacggtgattagagacacccaccagaatctgatgcacgtcatcattcatctgtttcaggtcgagcatcactaagtcggtaacgtcgagcagttcatcgatcaccggatcatagcggcgtacgaagccgttggtgtcgagacaggtatgaataccttcggccttacaggcacggaaccagtcgcgcacaaattcagcctgaagaatggcttcaccgcctgaggccgtgacgccgccaccagaggcgttcataaaatggcgataggagagtacatccgccatcagcgcttcgacgctgatctctttgccaccgtgcgtatcccaggtgtcgcggttgtgacagtagaggcagcgcatcaggcagccctggaagaaggtgataaaacggataccgggaccatcgacggtgccgcaggattcaaatgagtggatacgaccgttaactgacattgcgatgttttctccagtaagtctgccgggacagacggcgcaatctctgttgcgctcagggcaggaaatcgattctggtgggaaccttgatggagatgaccaccagaacagacttttaattaaaaggctccgcgaggagccttttttatcaggtagagcagtaattacagtgacttagtgaaggttcgggtaatcacatcctgctgctgttctttagtcagtgagttaaagcgtacagcgtaaccggaaacgcgaatggtcagctgcggatatttctctggatgttccatcgcgtccagcagcatttcacggttcataacgttaacgttgaggtgctgaccgccttcgatgctggcttcgtgatggaagtaaccatccatcagaccggcaaggttggttttccgcacgttatcatctttacccagcgcgtttggtacgattgagaaggtataggagataccatctttcgcataggcaaacggcagtttcgcgacggaagtcagtgaggcaactgcacctttctggtcacgaccatgcatcgggttagcacctggtccaaacggcgcgccagcgcgacgtccatctggtgtgttaccggttttcttaccatataccacgttcgaggtaatggtcagaacagactgcgtcggcacggcattacgataggtgttcagctgctgaattttcttcatgaagcgttcaaccagatcgcaggccaggtcatctacccgtgagtcgttgttaccgaaactgcggatattcgccttcaatgtcgaagtcgatggccagaccatcttcgtcacgaatcggtttcactttggcatatttaatggcagaaagtgaatccgcagcgacggagagacccgcgataccacaggccatggtgcggtagacatcccgatcatgtaaggccatcagtgccgcttcgtagctgtatttatcatgcatgtagtgaatgatgttcagcgaagtcacatactgttttgccagccagtccatgaagtgatccatacgctccatgacggtgtcgaaatccagtacgtcgtcgctgattttgtcacctttcggtccaacctgcattttcagcttttcatccacgccgccgttgattgcgtagagcagcgttttcgccaggttggcacgtgcgccaaagaactgcatttgtttgccgacaatcatcgggctcacgcagcaggcgattgcgtagtcatcattgtcgaaatcagcacgcatcaggtcatcgttctcatactgcaaagatgaggtatcgatagagactttagcggcatattttttgaaattaatcggcagtttttctgaccacaggatggtcatgttcggctcaggtgaaggacccatggtgtagagggtattcaggaagcggaacgtactttttgagaccagggtacggccatcaacgcccataccagccagggattccgttgcccagattgggtcacctgagaacagctcatcatattcaggtgtacgcaggaagcgaaccatacgcagtttcatcaccagatggtcaatcagttcctgtgcctgctcttcagtcagtttaccggctttaaggtcacgttcgatgtaaacatcaaggaaggttgagacgcggccaaatgacatggcagcaccgttttgtgatttaactgcagccaggtagccatagtaagtccactgtactgcttcaaccgcattggtagccggaccggagatgtcatggccatattttgctgccatctctttaatctgggccagcgcacgatgctggtcagaaatctcttcacgcagacgaatggtcgcttccagattaacgccattctctaaatcttcctgcagtgaggcgaactgagcgaatttatccgccatcaggaaatcgatgccgtacagcgccacacgacgatagtcaccgataatacggccacggccataagcatcaggaaggccggtcaggatacctgatttacggcagcgcaaaatgtccggtgtataaacatcgaacacgccctggttgtgcgttttgcgatattcggtgaagatttttttcagtgaagggtcgagttcacggccatacactttgcatgacccttcgaccattttgatgccgccataaggaatgatggcgcgttttaatggcgcttcggtctgcagaccaacaattttttccagtggcttaatgatgtaacccgcgtcgtgcgaggtaatggttgaggcgagatcggtgtcgaagtcgactggcgcgtgggtgcggttctcaattttgatgccttccagcacgctttcccacagtttggtggtcgcttcggtggcacccgccaggaatgactcgtcaccttcatatggggtgtagtttttctgaatgaagtcgcgcacattgacgctattctgccattcgccttcagcaaatccttcccatgctgaagccagttttgcattaagttcggtcataatatacctgccttatatgaggagactttacggtcgggcacagccaacttcctgtgccgtcaaaaatgcgtttaatgaacccggtcacctttacggagatagataacccagtaggtcaacccaaccagaaacgccgccgccgataatgtttccgatggtcacgggaatcaggttgtcgataataaagttactgagggtcagcgagtgaaactgtgccgccgtggtgccagctgcctgccagaattcaggtgtcgcgaagtcacgaatagcaatggcatagggtataagaaacatgttggcgatactgtgttcgaaaccgcttgcgacaaacatcgcaacaggcagaatcatcacgaccagcttatcggtcagggtgcggcctgagtaactcatccagacggcgagacagaccagcagattggccaatgtacccagacaaaccgcctctatgaaggtgtgatgcatcttgtgatcggcagtttgcaggacattcaatccccaggcgccattcgcgatcatgtgctgtccggcaaaccacatcagagcgacaaagaaaagtgcacctgcaaggttaccggcgtagacgttaatccagttgcgggccagctgtccccagctgatgcggccactggctttggcgacaacgattaatacagtagaggtaaaaaggtcggcaccgcataccacgaccagcattaagccgagtgaaaagcagatacctccaatcagtttggctatgccgtagggcatcgcgccgctaccggtggtcgctgtaatataaaaaacgaatgcgattgagataaatacgccggcgtttattgccagaaagaaggtcgtaaaaggatgtttggttgctttatagatacccgcgtcttcggccactttcgccatcgcggcgggtaataaaagattaaaagggttgtcagttttcacactaacttactcctgaagttgtctgaaaaaatactaacaaaggagtataggtcagtaattgatatggatcatgtttgccagggtggtaacacactggtcgcaaattaatgagaaaattatgagttaactaactgaatataaacaaataaatttattttaaaaatacaaaaatattttaatataaagtgatgcgccacttttttagttcagtctgtgttattaattaatggcttatgtgttaattaaaatgatgtgatgtaataagaaggaattttaaagtagctaatgtttcatagagaaagtggggaatgatggcaccagataaatccagtgccatggttagccgtctgctttcagtcttacgcgttatggtttacgcgtttttccagtagtgacgtttggcgttttgcagtttttcgtaggcggcaagcagagactgatgggccgggaaggcctgcagctcatcatcaacagcctgaaggccgttaaacggattctcaccactgatcgcggctgaggctgcttccattgcgctctcaccatacatccgcaggaaagcgtgatgatactgcaatggatcacgctcatcttccatagccagtaacagcagggtctgcaggcaacgatagtagttagcgcgctctggcgtaaagattgagctgttaaactccatcgtccattctgtccagatcaatgcctgatccagatcgccgcccgccagcgccagcatcgcttttaattcgccaacacgcagcgtgtaccagccattgtctttaccggtcgccagacccagtagctcacgaaacgcgggtgaagtcatcaaagccttcatcatcaagctgtccaatcagatccagatactcttccggattccagttgctgtcaggcagggccagcagggtttcacgcatgcccgctcccatgctgttgttcgccaggaacagatcttctgccggatagatatcagacatgcctggcacgatgatgcggcaggcatagacacccagatgctcgtagtctgcaatatagacttccttatcttccgaggcgaagattgccatcagcgtggcgaattcctgttcggtgctgcccgcgaatgaccagtcgacaaaaggataatccgcagtttctttaaacagatcccaggagatcaggccgcttgaatcgatgaagtgtgtttcaaggttggcatgctcagccacttcttcgtcatcaaaggtcggtggagtaaacacatccagatctttgaggcttcggccctgcagcaactcggtaacggtacgctccagcgccacaccgaaatcagggtgagcaccaaatgaggcaaaacaggttccgttggttgggttaaacagcaccacgcagataaccggatatttaccgccgagagaggcgtcataagcgaaaatcgggaagccttccgcttcaagacgtgcaatggcttcgatcacctcaggataacgctgcatcacgtcatctggaatcgcaggcaggctgatcgcttcagcaataatgcggtttttaatatagcgctcaaacacttcagacagcccctgaacacgcgcttcgttcgcggtattacctgccgacatgccgtttgagacatagaggttgccgataatattcatcgggatatagacagtctgctggtcggactgacgggtaaagggcagggcgcagataccacgttcagtattcccggactgcagatcaatcaggccggaagccgtcagtgcattatcgggatcgtaaaatgcgcgcaggcgtggatccagaataccttcaggtaaggactcatcatcaggtaatgcaaaccatttttcattgggatagtgaacaaaatcgccgttagcgatcttttttcccagccagaagtcagcaaaaaaatagttagttgagagacgctcgaaatactcgccaagcgcggaggccagcgccgcttttttactggcgcccttgccgttggtaaaacagagcgggcaatcgcggtcgcggatatgcactgaccagacatgggggacaggattcagccaggatgcttcttcaatgttaaagccaagatcctgcagcttgttctggaaacgcgcaatggagtcttccagtgcggcatctttgcccgggataaatgtttgcgtcatagtgccgctctctcagttgtcatagggtgcgtaaagcgcgcaatgatacggattttgctaacagaccgctatcagggcgggacatttttaccggcttactttaccggcttacttttcatcacttctgctctcaggccaaacgcggattaatggcgctggataaagcctcacaaaattccgcgcagatttgcattggtaacataacctccggcgagccagattcagaaaatgtgaccgctccctgatttatgattgcagctatcagaatgcagtgataaaaccggatggttattcataaccgttcgatatgacagtggtgaggggaaatgacgcaagtttataattttagctctggcccggcgatgctaccggttgaagtgcttcgtcgtgcagaacaggaactgacgaaactggcgcggtctgggtacctctgtaatggagatcagtcaccgcagtaaagagtttatccaggtggcggaagaagcggagcaggacttccgtgatctgctaaaaataccgtcgaattacaaagttttattctgtcatggcggggcgcgcgcgcagttcgctgccgtaccgggaaatctgctgggtaaagcgaccagtgccgactatgttgatggcggttactgggcgcatagcgcaataaaagaagcggaaaagtattgttccccacgcacgctggatgtcaaaactacgcgcgacggtaaacgagccatcctgccgatgagcgaatgggaggtgagtgagacgtccgcttacctgcatttctgcccgaatgaaaccattgatggcatcgcgattgacgaacagcccgactttggcagtaaaaccgttgttgctgatttctcatccaccattctgtcacgccctatcgatgtgagtcgttacggtgtgatttatgcgggtgcgcagaaaaatgtgggcccggccggattaacgctggttgtcgttcgcgaagatctgctgggtcaggcgcacgcctctgtgccctcaatcctcgattacaaagtgctggccgataacgattcgatgtttaacaccccgccgacttttgcgtggtatctctcagggctggtgtttaaatggctgaaagagaagggcggtgtcgctgaaattgatcgtatcaatcaggcaaaatctgacctgctttatggcgtaatcgatcacagtggcttctatcgtaatgatgtggcaacagaaaaccgctcacgcatgaacatccctttccagctggccgatgcttcactcgatgcgctgttcctggaggagtcgtttaaggcgggattacacgcgcttaaaggccatcgtgtagtaggcggtatgcgcgcctctatttataatgcgatgccgctggaaggtgtgaaggccctgaccgatttcatggtcgattttgaacgccgtcacggctgattattaagatatcagcattgatgctgatgccagacctcgtcacacggcgaggtctctgtattttttgaggatttcgtttcacatgcaggactccctgactctccaaccgattgcgcgcgtcaacggcacggtaaatctgcccggctcaaagagcgtttccaatcgtgcattgctgctggctgctctggctaaaggtacaacccgtcttaccaacctgctcgacagcgacgacgttaagcacatgctgaatgcgctgaccgcgcttggtgtaagctatacgctttccagcgatcgcaccctgtgtgaagtgacgggaaatgccgggccactgcacgcatctcaaccgctgtcactgtttctgggcaatgccggaaccgcaatgcgtccgctggccgcggcgctttgtctgggccagcacgatatcgaactgaccggcgaaccccgcatgaaagagcgtccaatcgggcatctggttgacgcacttcgtcagggcggagcaaccattgagtacctggaaaacgaaaactatccgccgctgcgtttacgcggtggttttaccgggggtgaagtcagtgtggatggcagcgtttccagccagtttcctgacagcgctgctgatgaccgcgccgctggcacagcaggatacctgcatcaccatcaaaggtgatttggtgtcgaaaccttacatcgatattacccttaatctgatgcagtgctttggcgtcgaggttgagaatcagaactatcagcgcttcctgatcaagggacagcaacagtatcagtcgccgggtgattacctggttgaaggcgatgcctcttccgcgtcctatttcctggccgctgccgctataaaaggcggaacggttcgcgtcaccgggattggacgccagagtgtgcagggtgacatccggtttgctgacgtgctggaaaagatgggcgcgacgattgagtggggcgatgattacattgcctgtacggccggaaaactgcaggccatcgatatggacatgaaccatattccggatgctgcaatgaccatcgcgactacggcgctatttgcagagggcactacccggttacgcaatatttataactggcgggtaaaagagaccgatcgactgagcgcaatggccacagagctgcgtaaagtcggggcagaagtcgaagagggtcatgactacatccgtattacgccgccagcgacgctgattcatgcggatattggcacctacaatgaccaccgcatggcgatgtgtttctctctggttgcactttctgataccccggtgaccattctcgatcctggctgtacggcaaaaaccttcccggactatttcgttcaactggctaaaatcagccagagcgcctgatatctccccttccggtgcggttcgcaccggaactcccctgattttatctggctgtaacaggccagagatcctctgaattgactaagattacgaacctgatcagtgcgaaagggtaaccaagccgtgctatgcagcgtataatgctagtcattaatggtgaccgaaaggtcaggaagcacgcagcaacaggagggaataatgacagtaactgccccggtcataactattgatgggccaagtggagcgggaaagggaaccctgtgcaaagcgatggcggaatcgctgcagtggcatctgctggactccggtgctatttatcgcgtgctggcgttggccgcattgcatcatcaggtggagattgaatctgaagaggcgctggtgccgattgccgctcacctggatgtgcgctttgtgtcacaaaatggtgaaatgcaggtcatacttgaaggtgaagatgtcaccggtgaaatccgtactcaggaggtcagcaacaccgcttctcgtgttgccgcttttccccgggtacgcgaagcattattgcgccgccagcgcggtttccgcgagatgccgggcctgattgctgatggccgtgatatgggcaccgtggtttttccggatgcgccagtgaaaattttccttgatgccagcccggaagagcgtgctcagcgccgtatgctacagttgcaggataatggctttaatgttaactttgaccgccttttagccgagataaaagaacgcgacgaccgcgatcgtaatcgcgcaattgcgcctttagtagccgctggcgatgcattggttctggactctaccgagatgtctatcgatcaagtcattgaaaaagcgctacaatatgcccgcgagaagctgggtattacggcttaactgaatctaccaccctgtaccatggatccggtgccgggcatgtgaaacaaccccatccgacatgaagtcagatggacgttaaattgaagaatcctgaagattatcaatatgactgaatcttttgctcaactatttgaagaatccttaaaaacaatcgaaacccgcccgggttctatcgttcgtggcatcgtcgtttctatcgacaaagatgtcgttctggttgatgcgggtctgaaatctgaatctgcaattcctgcagagcagttcaagaaacgcagccggcgaactggaaatccaggtaggcgacgaagttgatgttgctctggatgcagtggaagacggcttcggtgaaaccctgctgtcccgtgagaaagctaagcgccatgaagcatggatcacgctggagaaagcttacgaagacgctgaaactgttaccggtgttatcaacggcaaagttaaaggcggcttcacagttgagctcaacggtatccgtgcgttcctgccaggttcactggtagatgtgcgtccggtgcgcgatacgctgcacctggaaggcaaagagcttgaattcaaagtgatcaagctggatcagaaacgcaacaacgtcgtggtttcacgtcgtgcggttatcgaatccgaaaacagcgcagagcgcgatcagctgctggaaaacctgcaggaaggcatggaagtcaaaggtatcgttaagaacctgactgactacggtgcattcgttgatctgggcggcgttgatggcctgctgcacatcactgacatggcatggaaacgcgttaagcatccaagcgaaatcgtcaacgtgggcgacgaaatcaccgttaaggtgctgaagttcgatcgcgagcgtacccgtgtttctctgggtctgaagcagctgggcgaagatccatgggttgctatcgctaaacgctatccggaaggtactcgcctgaccggtcgtgttaccaacctgactgattacggctgcttcgtggaaatcgaagaaggcgttgaaggtctggtacacgtgtctgaaatggactggaccaacaaaaacatccatccgtctaaagttgttaacgtaggcgacgtggttgaagttatggttctggacattgacgaagagcgtcgtcgtatctccctgggtctgaagcagtgtaaatctaacccatggcagctgtttcgctgagacgcacaacaaaggcgatcgtgttgaaggtaaaatcaagtcaatcactgacttcggtatcttcatcggcctggatggcggcatcgacggtctggttcacctgtctgacatctcctggaatgcgactggcgaagaagccgttcgtgagtacaaaaaaggcgacgaaatcgctgccgttgtactgcaggttgatgcagagcgcgagcgtatctctctgggcgttaaacagctggcagaagatccgttcaacaactacatcactttgaacaagaaaggtgccatcgtcaccggtaaagtgactgcagttgatgctaaaggtgctacagttgaattagcagacggcgttgagggttacctgcgcgcttctgaagcttcactggaccgcattgaagatgcaactctggttctgaacgttggcgacgacgttgaagctaagttcaccggcgttgatcgtaaaaaccgtgtcgtaagcctgtctgtccgtgcgaaagaccaggctgatgagaaagaagctatcaatactgttaacaccaaacaggaagaaggcaatttctctagcgctatggctgaagcgttcaaagcggctaaaggcgagtaatcggcctgaagcaccgggtgggcaaccacccggtttcggtaaaagctgtcatacattcccatagggataaaccggaggttacatgaccaagtcagaaactgatcgaaagactggcgggacagcatactcatataccggcgaaagtcgttgaggatgcagtaaaagagatgcttgagcacatggccactacgctggcacagggcgaacgcatcgaaatccggggattcggcagcttttctttgcactatcgcgctccgcgtactggacgtaacccgaaaacgggtgacaaagtggatctggaaggtaaatacgttccccactttaagccgggcaaagagctgcgcgatcgcgcaaatatctacggctaagccgataccgaaccagataaacgacatctccggatgtcgtttttttttgcctgcgattcaggctcagatctgacatccggattgctgtcatcaacactgcaacgccgcactctctttgtgagagcgctccagcctgcctgatcatccgctgttacttttacctcctttgcccagaataatcgaactgaatcaatggatacgattatgctgacatggacctttctggcacgactggcgatcgttgcaacgttaccgctactgctgatggcccggctgccttccggtgaggtgatgtggggcttcctcctcacaggactggctctgctgcattgcccttaccaacccgtccgtctggccggtattactctgctgttgctggcatgggcctgtaacgacgcccgtctgatggtgcgggatatcgaaaagttctcggcgcgtcctgccacctacacccttcagatcagtgaactgcggaaagagcggaagcaaatccgggttcgtctgttgaaagaggagggcaggatgatttttccgcctcgctttgcctggatctggtttgatgctgatccggaggtctactgtccaggacaacgctggacgatgaaactgcgtctgcgaccggtacatgcccgccttaatgagggcgattttgatgcgcagcgtttcgcactggctaataatacgccgcttcagggacgaatccttaagcagactgcggtaagcgatcgctgtgatagccgctggcgatttattttatggcatcgtgacaggacccgtgcaatgcctgcacgtgcaacgctggaggcactggcttttggcattcgggatgagatgagccagcagacgcgtcagctactgcgggataccggtaccgcgcatctgatggcgatatcgggcatgcatatcgccctggccgccagcaccggctggatgattgcgcgtggggtgcaatttatcttgccagcccgttatatcagctatcttttccccctcatcgtgagctggctgtttgctgcaatctatacctggctctccggtgcacagcctcccgcagagcgtttcgctgcttgccctgacgctatgggcgataacacggtttgcgggtgttcagctgaatagctggcaggtctggacgttctgtattgcgttgctgctggtaaccgacccgctgaccgtgctctctgacagcttctggctctcggtactggctgtgggcatgctgctggtctggtatcactggttcccgctgcctgcggcgttccgtcagcaacggcgctggattccggtacagctgctgcatttacaggcgggcatgatgattttaatggtgccgttgcaggtggcgattttcaacggcatcagcctgactgcgctggtggcaaatgttgtcgcgattccggtcgtctcgtttattaccatgcctctggtgacgctcgccctgctgctgccggtggcgcatttatctggcttcttctggggagcggccgatctctctttacgtgcactgtttcattgcctgacgttgctgccaccaggctggtggccgctgagtggcacaacctggtttacggttatggtatggggcggcctgattctctggcgtgcgcagctcttcttctctctgccactaagcagctgcgccttagcgctggcgatgatactgagtcgccagccaaatcaggagcagggctggcgcatcgatatgctggatatcgggcacggtctgagtctggtgatcagccagggcgacgaggcggtgatgtatgacaccggcccgcgctggcagaacgataatgcggggagtcgggtgatcattccatggctggagcgcaggcagctacggttaaaacaggtcatcctgagtcataaacatctggatcatactggcgggctggcggcgattactcaacgctggccagcggttgaagtcagaagtgcgctggctgatgaggcacacttaccctgcgtacggggcacgcagtggcgctggcggcagctccactttcgggtggtctggccgctgacggcacccctgccgggcggaaataatgactcctgtgtggtgatcgtcgatgatggtcaggtccggctgatgttaaccggtgatattgaagcgaaagcggaacgccagctggtggcgctggagaagcaggggctgaaggtcgatattctgcaggtcccgcaccacggtagccggacgtcgtcgacctcattgctgctgcgtaaagccgcaggccacaccgctatcgcctcgctggcacgctacaatgcatggcgtatgcccgcgaaaaatgtgctggaaaactatcgaacggccggttttcagtggctggatacgggccagtcaggacaaatcagtatcaggatagagcagggcagagcgcaggtttctaccctgcgggaacaattaatgccccgttggtatcatcagtggtttggcgtcaaacgcgaatccaggtagaatggccggctatttccaacagcgtgaataaataatgcatcaagataaagatctctctacgtggcagacgtttcgccgactctggccgatgatcgcgcctaataaagcgggattaattgcggcctcagtcgccctgattattaatgctgcgggcgacgccttaatgctctcactgttgaaaccgttactggatgatggttttggtaaagctgacagatcggtgatgctgtggctgccgttagtggttattggcctgatgctggtccgcggagtcaccagttatatctccagctactgcatctcctgggtctctggcaacgtcgtgatgaacatccgccgtcgtctgttcagccatatgatgggcatgccggtttcgtttttcgaccagcagtcaaccggcaccttgttgtcacgcattacttacgattctgagcaggtcgcctcctcttcttcgggcgcgctggtcaccgtagtgcgcgaaggggcttccattattggcctgtttatcatgatgttctactacagctggcagctgtcgctgatcctgattgtactggcacctatcgtctcctttgctatccgcaccgtctctaagcgcttccgcaccatcagcaaaagtatgcagaatactatgggtcaggtgacaaccagcgccgagcagatgctgaaagggcacaaagaagtgctgatttttggcggacaggacattgaatcggagcgcttttcccgcgtcagtaaccggatgcgtcagcagggaatgaaactcgtttcagcctcctccatttccgatccgattattcagctgatcgcgtcgctggcactggcttttgtgctctatgccgccagcttccccagcgtcatggataccctgacagccggtaccatcaccgtggtcttctcctcgatgattgccctgatgcgcccgcttaagtctctgaccaacgtcaacgcccagttccagcgtgggatggcggcctgtcagacactgttctctattctggatagtgagcaggaagtggataacggtacgcgcgaaatcacccgtgctaaaggggatattgaattccgtgatgtcacctttacctacccaggccgtgaaattccggcactgcgtaatatcaatctgtcgctgccggcaggaaaaacggtggcgctggtgggccgttcgggttccggtaagtctacgatggcgagcctgctgacccgcttttatgacatccagcagggcgaaatcctgctggacggtcatgatctgcgtgagtacagcctgcgctcattgcgtaatcaggtggcgctggtgtcacagaatgtgcacctcttcaacgacacgattgccaataacatcgcgtatgcccgcagtgagcaatacagccgtgaagagatcgagcaggcggccaccatggcgcatgccatggactttatcaataaaatggataagggcctggatacgatgattggcgagaatggcgtgctgttatctggcggtcagcgtcagcgtattgccattgcccgtgcgttattacgtgattgcccgatcctgatcctcgatgaagccacctcggcgctggataccgagtctgaacgcgcgattcagtctgcactggatgagttgcagaagaaccgtacctcgctggtgattgcgcaccgactctctaccatcgagaaagcggatgaaatcgtggtaattgaagatggccagattgttgaacgcggtacgcatcaggtgctgttagcagaaacgcggtgcctatgcacagctgcacaagatgcaattcggccaatgattgaacgtatctggagtggtcgctcaccgctatggctgctgctatggccattcagcctgctgtatggtgcgatcacggccctgatacgcttcagttacaggcgcggctggcgtaaaagctggcgtgcgcccctgccggtcgtggtggtgggtaacctgactgctggcgggaatggaaagacgccggtggtcatctggctggtcgaggcgttacagcagcgcggcctgcgcgctggcgtggtctcccgaggatatggcggcaaggcggaccactatcccttgctggtcacggcgcagacccccaccgaacaggccggggatgagccggtattgatcgcccagcgcaccggggcgccggtcgcggtcgcccctcaacggcgacgggcgattgaggcgttactgaaacagggttcgctggatgtgatcatcacggatgatggcctgcaacattacgccctgcagcgcgatcgcgaaatcgtggtggttgatggggtccgtcgctttggtaatggctggtggttgcctgccggtccgatgcgtgaacgtgccgatcgtctgcagcaggtcgatgccgtgatcattaacggcggcgaagcacagcccgacgagattgccatgcaacttcagcccgggctggccaccaatctgctgaccggtgaaacctgcccgccggagcaactgggtgcggtagtcgccatggccggtattggtcatcccccgcgttttttcaccacgctgaaacagcagggtataacgccggtcgcagagatcgcctttgccgatcatcatgcctacagcaaagatgaactgacccgattactccaggcgggtcagcaactgctgatgaccgaaaaagacgcggtgaaatgccgtcactttgcccagcctgactggtggtatttgccggtcgatgcccatttaactggtaatgccgtgacgccgttactggatgacattgaacaactctgccgccatatttcctgatacccgcccccgttcaggtgaagcctgataaggaagaggatgaacagtacgcattcactttcgttacagcaagcacgccaccttcatctcgccgcgcagggcctgctgcgaactccggcaaaacgtgctgtttatcaggatctgattgactgcatttcccgcatgtcgctgctgcaaatcgataccattcatgtggtggcccgtagtccgtatctggtgctgttcagtcgcctggggaactatcctcaggcatggctggaacaggctctggcacagggcgaactctttgagtactgggcgcacgaagcctgctttattccccgtgccgattaccgacttcttcgtcatcgcatgctgtcgccggaacgtctgggctggaaatacaatgcgcaatgggtcgctgagcaccagcaggccattgccgaattacttcagcagatcagagacaacggcccggtacgcgccgccgattttacccatgccgataacccgaagtcaggctggtgggcatggaaaccgcacaaacgtcatctggagaatctcttcagcgccggtgagctgatggtcaccgaacgccgtaattttcagcgcgtctacgatctgcgcagccgcgtgatgcccgactggcaggatgcgatacatggcatcagtgaagcggaggcgacccgtcagatgctgatgaatagcgcccgcagcttaggggttttccgctcggcctggctggcggattactatcgcctgaagcgggcacccgtgaacaactttatcgctgacgcccaggctgcgggcgatctggtcgccgtcaatacagagggactaggtgagatgtggctgcatcgtgactacgtgccgttgctggatacgccgctgcaggcgacgcacagcgcgctgctgtcgccgtttgatccggtggtctgggatcgcaagcgtgcgcgtgagctgttcaattttgactaccgtattgagtgctataccccagaggaaaaacgcaaatttggctattttgttttgcccatcctccatcgcggccagataaaagggcggctggatgcccgcatgctgcgtcaggcaaaacagctggagattaaaaatatctggctggaggagaagacccgcgttacggcgcgatttttgctggatatccggcgtgctatcgaacgcttcgcgacgtggcagggtgctgaaagtgtcgctatcctgcaggcacccgacgcgcttaacgatcagtggccagccctgtggacgctggattaatcaattttgcggcagccgctgcgggatggcgttttaccccatcccgcacgcgccgcgctatggtatgcttgaatccttaagcattcggtccctgatggaggacatatggatcatcgtttactcgaaatcgttgcctgcccggtttgcaatggcaaactctacttcaacaatgctcaacaggagctgatctgcaaacctgatggcctggccttcccggtccgggacggcattccggtgctgctggaaaccgaagcccgcacgctgtcagttgaagagattcatccatgagtttcaccgctatcattcctgcgcgttatgcgtcaacccgcttacccggcaagccgctgctcgatatccacggtaaaccgatggtcgtgcatgtaatggagcgggcccgtgaatcgggagccagccgggtcattgttgccaccgatcatcccgatgtggcgcagtcagtggaagcggcaggcggcgaagtctgcatgacgcgcgccgatcaccagtctggcactgagcgactggcggaagtgatcgaaaaatatcagtttgccgatgatgaaatcatcgtaaacgtgcagggcgatgagccgatgattccggccgagattgtgcgtcaggtggcaaccaatctggcggggtcggcggccgggatggcgacgctggcggtgccgatcaccgatgtggaagaagcctttaatccgaatgcggtgaaagtcgtcatggatgtgaatggctacgcgctctatttttcacgggcgactatcccctgggatcgtgaacggtacgccgcatcgcgcgagcagatcggtgatacgctgctgcgccacattggcatctacgcctaccgtgctggttttattcgccgctatgtcgcctgggcgccttgtcctctggaacagattgagctgctcgagcaactgcgtgttttatggtacggcgaaaaaattcatgtcgccgtcgcgaaaaccattcccagtgtgggtgtggatacgccagacgatttgcaacgcgttcgtgatgccatgcaggcctgacaaatggggagcctgtctccccgtttcaacgcaacgttcttgatccgccgctaaacttatctccaacacttccttcaggatattgtgatactcatctgaggaggatgccgcatggaacagcttaaatcggaactcacgctggcgctgggtgaaaccatcagccgcctcgaaatgatcagtgaacatccacccacccggctttatgcgttatacgatcgggacgggcgccccatgccggtggtggcgaaatattttcgtcatcagggccgggcggcgatggaagccagaaagctggcgctgctgggccaggccggactgattgccgtgccagcggtctatggtctggtgatgagccagcagccgccggtgcatgaaatgctcctgctggcgcgactgaatggcgtgacggcggaagcgcctgcgcgggatgctcagcgctggcaacagttttgcgaacaggtggtcgagggagtgctggcctggcaccggctcgacagccatggcctggtcggtacggtggacagcacgcagcagaacagctggcccgcctggtatgcacaacgggttgaggtgctatgggcgaccctgagctatctgcgtcctccagcctttacgctggaagatcgtcagattctgtttcgctgccgggcacgactggcgcatctgtttcgcggcttcgacgatccctgcgtgatggttcacggcaacgttcagctgcagagcatgctgaaagatagccgcagtgaccagttaatcgcgatgacacagccgggcaccatcctctgggcaccccgtgaatacgatcttatccatctggatacctcgcctgcagaaacggcgctgctgcacagctacctgcaacgggcgccggtttcagagggttttgtctggcgtcggtgggtttatcaactgtgggactgcattgagcatctggtacagaccggcacttttaatcgtccgcgttttgaccatgcacgcgcgcaattacttccctggctcggctgagtccgactcctcgcctttcagccgttgcaatagtgtgccaagcgtttcgtagaccgcacgttcgctgtgactcagccagatcgatgagggtatcgcccgctcccatccattcagcggtgacgtaatcgccagctgattcgcgggagcggccattggcttcaacccgatcgcgtggaaaaagcgtattgcgcgcggcatatgattcgcggatgtgaccagcagaaacgggcgatcgcccaccacggttttgaccgcctgcgcttcatccgcggtgtcgcggggctggtcgagaatctgaacatgttcgcggggaacgcccagactttccgccacctgtgccgctacccaggcgctactctttggattggtgccgcccgctgcgccggtaaaaatcagcttcgactgcggattccgctgccactgacgaacgccttctgccacgcgcggcagactgttattcagcaggttcgagctgggtgcccacgccgggttaaaggtgtagcctccgcccagcaccacaatgaagtccaccttctctgatccgttccaggtcggatagcggctatccagcggcaaaagcagacgatcggccagcggttgcaggctcagcagcagcagtaacagccagctgacggagatcacggttttgccgcttttctgccagccagtaaaccaaagcagtaaaatgccaagcgccatcagcaaaagcagaaacggcaggggtaaaagcagcccgccgataacttttttaagggtaaataacatcaaaaaagagtcctgttgtccgaaaatagagcacccggaagggaagatggggatgaaaggttcattcttctggtgcctgtgacaaaatagcacaagtctcaccgcagcataccggagcgcatgccatgcaggatcgtaactttgacgatctcgcggataaattttcgcaaaatatttacggcaccactaaagggaagatacgccaggccatcctctgggatgagctggagaagatagtgcccggtctgtcaccgcacccgctgtcggtgctggatgctggcggcggtgtcggccaggtctccagcgggcttgctgcgcagggccatcaggttctgctgtgcgacctttccagcgagatgctgcgccgggccgcggaaaatgcagcggcacagggtgtgagccacaacatgcaattcagacaaattagcgctcagcaggtgggcgaacatttggataagccggtggatctggtattgttccacgctgtgcttgagtgggtcgctgaaccggagaaggtgctgaaagcgctgtacgatctgctgcgtccggggggcgtcatgtcgctgatgttttacaatctgcacggcctgacattgcgcaccttaacgctgggtaacttcggctatctgcgcaccaacctgaccaaacgcaaaaagcgaacgctgtcgcctgactatccgcgcgaccccgagcaggtctatcgctggctggaggcgtgtggctttgtgattgagcagcgtgccgggatccgggtgttcagtgactacatgaagccgccgaagggcgagccaaaaagcgacgacgaaattattgagatggagcggcgttactgccgtcaggaaccctttttgagcttagggcgctacatccacgtgaccgcgcgtaaacccgggcagaaggacgaattatgagtgaattttcccagacggtacctgaactggtctcctgggcgcgcaaaaatgacttttcccttgcgctgccagtggaacgtctggcctttttgctggctatcgccaccctcaacggtgagcggatggatggcgaaatgagcgaaggcgatctgattgatgctttccgtcacgtcagcaaagctttcgaacaaacccatgaaaccgtgttggttcgtgccaacaacgccatcaacgacatggtgcgacagcgcctgctcaaccgttttaccagcgaaatcacggaaggcaatgccatctatcgcctgacgccgctggcgatcggcatcactgactattacatccgccagcgtgagttctcgactctgcgcctgtcgatgcagctgtcgattgtggccaatgagcttaagcgggcagccgatgctgcgcaggaaaatggcgatgagtttcactggcaccgcaatgttttcgcgccgctgaaatattccgtggcggagatcttcgacagcatcgatatgacccagcgtctgatggatgaacagcagcaggcggttaaaaatgatatcgccgaactgctgaacaaagactggcgcgcggccatctccagctgtgaaatgctgctttctgaaacctcaggaaacgctgcgtgaactgcaggatacgcttgaagccgcgggcgacaaacttcaggaaaatctgctgcgcattcaggatgccacgctggacagtcccgatctgggcttcgtcgataagctggtgtttgatctgcaaagcaaactcgaccgtattaccagctggggccagcaggcgattgacctctggatcggctatgaccgccacgtccataaatttattcgtaccgccatcgacatggataaaaaccgcgtctttgcgcagcgcctgcgggtatcggtgcagaattacttcgatgcgccctgggcgctgacctatgccaacgccgaccgcctgtatgacatgcgtgatgaggcgctgacgctgcgtaacgacgaagtgatgggcgaactgccgccggagatggagtacgaggagatcaacgaaatccgcgaacagctggcagcgatgattgaagaagcgctgcaggtctacaaatcgcaacaaaaaccgctcaacctcgcgtcagtgatgcgcgactacctggcccagtatccccgagcccgccatttcgatctggcgcgcattgtggtggatcaggcggtgcgccttggcgtagcggaagctgatttagccggtttgcctgtggaatggcaagccatcaatgattacggagccaaggtgcaggcacatgtcatcgacaaatattgaacaagtgatgccggttaagctggcacaggcactggccaacccgatttttcccgcgctggacagccagttacgcgccggacgccatatcggtatcgaagagctggataatcacgcttttctgatggactaccagtcgtttctcgaagagttttacagccgctataacgttgagttaatccgtgcgccggaaggctttttctatctgcgtccgcgttcaaccacgctgattccgcgttccgtgctctctgagctggacatgatggtcgggaagattctctgctatctctatctcagcccggaacgactggccaatgaaggtatcttcacccagcaggagctgtacgacgaactgctctctctggccgatgagaaccgcctgctgaagctggtcaaccagcgctcaaccggttcggatctggatcgcaccaaactgcaggagaaagtgcgcgcctctctgagtcgtctgcgtcgccttggcatggtgtggtttttcggcaacgacagcagcaagttccgcatcacggaatcggtgttccgctttggtgccgacgtgcgcggcggtgatgacgcccgtgaagcgcagcttcgtctgattcgtgatggcgaagccatgctactggaaaacgcgacagcaccggtcgacaccgatgacggtgaaggtcaggaaggcgacgcgagtgagaacgcagaggaagaacaggcatgattgagcgcggaaagtttcgttcgcttacgctgatcaactggaacggcttttttgcccgcacctttgatctcgatgaattagtgaccacgctgtcaggcggtaacggtgcgggtaagtccaccacgatggcggcatttgttaccgcgctgatccccgatttaacgctgctgcacttccgtaataccaccgaagcgggcgcgacatcaggatcccgtgacaagggtctgcatggtaaactgcgggctggggtctgctactccatgctggatgtggtgaactcacgccatcagcgtgtcgtggtcggtgtccgtctgcaacaggtcgccggacgcgataaaaaggtcgatatcaagccattcagtattcatggcctgcccaccgacaccaacccaaccgatatgctgacggaagtgcttaacagccgtcaggcacgcgtattaccgctgaacgaagtcaaagagcgggttgaggcgcaggaaggggtacagttccgcgcctataactcagtcaccgattatcacgccatgctgtttgatcttggtgtggtgccgcgtcgtctgcgctctgccagcgatcgcagcaagttttatcgtctgattgaagcctcgctgtatggcggtatctccagcgccatcacccgatcgctgcgtgattacctgctgcctgaaaacagtggcgtgcgcaaagcgttccaggatatggaagccgcgctgcgcgagaaccgcatgacgctggaggcgatccgcgttacccagtctgaccgcgatctcttcaagcatctgatctccgaggcgaccagctacgtttcggctgactatatgcgccacgccaacgagcgtcggggacacctcgacagcgcgttacagctgcgcagcgagctgttcagcagccgtaagcagctcgccaccgagcagtatcgtcatgttgagatggcgcgcgaactggctgagcacagtggtgcagaaaacgatcttgaagtcgattatcaggccgccagcgatcacctgaacctggtacagacggcgatgcgtcagcaggagaagattgagcgctacgatgcggatatcgaagatctgacgctgcggctggaagagcagaccgaagtggtcgcagaagcgcgtgaaattcaggaagagaatgaagcgcgggccgaagcggctgagctggaagtggatgagctgaaaagccagctggccgatttccagcaggcgctcgacgtgcagcaaacccgcgccatccagtatcagcaggcattgcaggcgctggaacgcgcccgcacgctctgccagttacccgatctgagcattgaaaatgcggctgaatggcaggaaagcttccaggccaaagaggaagaggcgacagaacggttgctgcgcctggagcagaagctgagcgtagcggaagcagcgcacagtcagtttgaacaggcgctggcgctggtgaccagcattgccggtgacgtgacccgtcaggacgcctggcaaaccggccgcgaactgctgcgtgatgccagcaaccagcgtcatcacgccgaacagctctcttcgctgcgtctgcgtctcaatgagctggaacagcgtctgcgcgagcagcatgaggcggagcgcctgctggcggaattctgcaagcgtcaggggcagcattatgaagcggatgcgctggcaggcctgcagcaggagcttgaagcacagattgaacagctgaacagcagcgtctccgacgccggtgagcaacgcatgatgatgcgccaggagctggagcagctgcgcgaacgcatcaccagcctgaccgcccgtgcgccacactggctggcggcgcaggagatcctgacccagcttagcgaacagaccggtcaggcgctgaacagcagccaggacgtgaccgaatatatgcagcagctgctggagcgtgagcgtgaaaccaccgtcgagcgcgacgaagtagcggcgcgtaaacgtgatatcgagcagcagattgagcggctcagccagccgggcggtgccgaagatgcgcgcctgacccagcttgccgaacgttttggcggcgtgttgctgtcagagatttacgatgatgtaacgctggatgatgcgccttacttctcggcgctctacggtccgtcgcgtcatgcgattgtggtgccggatctctcgcgcgttcgtgagttgctggatggtctggaagagtgtccggaagatctctacctgatcgagggtgatccgcagtcgttcgatgacagcgtcttcagcgtcgatgaactgcagaatgcggtggtggtgaaggtggcggagcgtcagtggcgctactcccgcttcccgaaaataccgctgtttggccgcgcggcgcgtgagaatcagctggagctgctgcaccttgagcgcgataagctggccgaacgctacgccacgctgtcgttcgacgtgcagaaaacgcagcgtctgcatcagtcattcagccgcttcatcggcagtcatctggccgtcgcctttgacgccgatccggaagcgcagatccgtcagctcggcgcacgccggggtgagctggagcgcgcgctgaatcagcatgagagcaacaatcagcagcagcgtcagcagtatgagctggccaaagagggcgtatcacagttaaaccggctgctgccacgcgtcaatctgctgctggatgagacgctgggcgatcgctgcgaagagatccgcgagcaggtcgatgcggcacaggaagcggcgcgcttcctgcatcagcatggcgctaagctggcgaaactggaaccgatcatcgccgtgctgcagagcgatcctgaacagcatgagcagttacaggcggattatcagcaggcgcagcagcagcagcgcaacgcgcgtcagcaggcctttgccctgacagaagtggtgcagcgtcgcgcccacttcagctacgacgactcggccagcatgctcaacggcaacaacgacctcagcgataagctgcgtcagcgtctggagcaggctgagggcgaacgcagccgcagtcgtgatcgcctgcgtgaacatcaggcgcagctgacgcaatactcccaggtgctggcctcgctgaaaagcgcctatgacgccaagcgcgacatgctgaaagagctgcagcaggagatgcaggacattggcgtccaggctgacagcagcgcggaagaacgcgcgcgcgttcgccgtgacgaactctacacggcgctgagtcacaaccgcgcccgccgcaatcagctggagaaacagcttaccttctgcgaagcggagatggataacctgcagaagcgactgcgtcagctggagcgtcagtatcatcaggtgcgcgaacaggtggtcagcgccaaagcgggctggtgtaccgtactgcgtctggtgaaagagaatggcgttgagcgtcgtctgcatcgccgtgaactggcctacctgagcggcgatgagctgcgctctatgtcggataaagcgctgggtgcgctgcgtctggcggtagcggacaatgaacatctgcgcgacgtgctgcgactgtcggaagatccaaaacgtccggaacgtaaaattcagttctttattgcggtttatcagcatctgcgcgagcgtattcgtcaggatattattcggactgacgatccggtcgaagcaattgagcagatggaaatcgagctgaaccgtctgacggaagagctgacggcgcgtgagcagatgctggcaatcagttcgcgcagtgcggccaacatcatccgtaaaacgatccagcgtgaacagaaccgtatccgccagctcaaccagggcctgcagaccgtcagctttggtcaggtacgcagcgtgcggctcaacgtgaacgtgcgtgaaacccacgccatgctgctggatacgctgtcggaagagcacgagcagcatcaggatctctttaacagcaatcgcctgaccttctctgaggcgctagcgaagctctaccagcgtcttaatccgcatatcgacatggggcagcgtacgccgcagaccatcggtgaggagctgctggactaccgcaactatctggagatggaagtggaagtcaatcgcggttccgatggctggctgcgcgcagagagcggggcgctctcaaccggtgaagcgatcggtaccggtatgtccattctggtgatggtagtgcagagctgggaagaagagtcccgtcgtctgcgcggcaaagatatttcgccatgccgactgctgttccttgatgaagcggcccgtctggatgcccgctccatcgccacgctgtttgaactctgtgagcgactggagatgcagctggtgattgcagcaccggagaatatcagtccggaaaaaggcacgacctacaaactggttcgtaaggtgtttaataacaccgagcatgtgcatgtggtcggtctgcgtggttttgctgccgatccttcgccggtgcgggcgggaagcgacgcagatgcgctgcccgatttaaccgctgaaaattcgcaggcggaaacgtagtcaaaaactgaaccattcgttaatctggttacggcatttgtcacatgaggcaaatgccgtttttgtttgtatactcacatgatgagtcacggcgcggtcgcagtggatacagggaacactgcgaagttgaaaaacaagggggcagggatgttgctggtaaaaaaattaaatcatcatcgcgttctatcattgttagcgctggcgctaaccgttgttccatttacgctaccgcaggccgctgttatcgccgctttgcccgggacaacgcaggcggtcacctccgtctccgaaagtcagcaacgcatccggcaggcgttttccagcgccgatcagccgttttatctggcaccgctggcgacgctctatgcatcccgccatatgcaaccgctctggcaggatcccaaggcgatacaaaaatttcagcagcagctggctgaagtggcactttccggtgttcagccacagttcacgcgctggattgagcgtctgacaaacccggcgatcaccggctttgcccgggatgtcgcgctgtccgatgcgatgctgggctatctgcaatttgtttcgaatgtgccgacgcagggtgaaacctggctttacagcaatgttccctaccggctgacacagccgtcggtggcggtcgtgaatcagtggcagaatgcggtcaatgcaggatcgggcaacacgtttattgcgtcactgcagccgcagcacccgcagtatcagccgatgcacgccgcgctgaaaaccctgctaggtgataaacaaccctggccgcagctgaaaagcagtgaaacgctgcgcccgggacaggtcagtgacgatgtgccggcgctgcgtgaaatcctgcagcgcagcggcatgttaacggcgcaggttaatgcacctgcaccggatgacgatgcggtgccggtggccgcctcaccagtgacccacagcgaccagccggttgcggtcagcccttccgccgcgccagtcaccgatctgtccgcgccttcactgcattcgccgggtaacgttcagagtcagacgctggaagggaataccgccaatgtctatgacgagacgctggtggcgggtgtgaagcgtttccagcagtggcagggactggatggcgacggtgctatcggtgccagaaacgcggcagtggcttaacgtctctccgcagatgcgtgcttcgttgctggcgctgaacattcagcgactgcgcctgctgccggacgatatgcacaacggcattatggtgaacatcgccaactactcgctgatttattacaacaacggcaacaagatcctctcatcacgcgtcatcgtcgggcgtcccgatcgcaaaacgccgttgatgcgcagcgcactcaataatgtggtgctgaacccgccatggaatgtgccgaccacgctggtgcgtaaagatatcattcctaaagtgaagcaggatccgacctatctctataagcatggctataccctgctgtcgggctggagcgctgacgctgaagtgatcgatcccagcatgatcgactggcgcatggtcaccgcttcatctttcccctatcggttgattcaggcaccgggtgtggcgaatgcgctgggccgctataaatttaatatgcccagctcagatgcgatctatctgcacgacacgccgaaccacaacctgttccagcgggatatccgcgcgctcagctcaggctgcgtccgggtaaataaagcgtccgaactggcgggcttattactgcaggacgcgggctggagcgatgcccgcatctccagtacgttaaaagagggtgacacccgctacgtgcccattcggcatcgtattccggtcaatctctattatctgacggcgtgggtcgctgatgatggcaaaccacagttccgcacagatatttacaattatgatgacaccgcgcgttcgggcagccaggctttgagtcgggctgagcaattgctgctctagtgattgattttaaatcgttagcggcgggccggttattcagaaaaatgttatcaaatggcgattcctgcagggatcgccacgcaaacaggttgcagatgggttgacgctctactgagagaaagttatggttcgggctgtgcgctttttgcacatttctatggcttcactctcaggtaaatcgttacatgtctactattgattcttttcgtcgcaaactactgctgtgcggtagcgccgccgccggtctggcattattacccgcttctgcaagggcctcgctttctacctctcgcccgcgtgtattgatgcttaataatcttcataccggtgaaacccttaaaactgagttttttaatggtaagagttacgacaaggatgagttgtcacgattaaatcactttttccgtgactatcgcgccaataaagtgaaaagcatcgatccgcacctgtttgatcaaatcttccgcctgcaggcgctgctgggaatgcgtaaaccgatacagctggtttcgggctaccgttcactggcaaccaacaacatgttacgtgagagtggtcctggggtggcaaagcacagctatcacaccaaaggccaggcaatggatttccatatcgaaggagtttctctggctaatgtacgcaaagcggcgttatctctgcgtgcgggtggtgtaggatattatccccgcagtaactttgtacatattgataccgggccgatcaggcactggtaatgacaccggcaacgctgcgtgagccggtcatggagcgttatgaattaccacattattcctgttaccgcgtttgcccagaactgttcagttatctggtgcgagtccactcgtgaagccgcgctggttgatccaggcggcgatgccgatctgatcaaagagacgctggaacaacgccagcttaaaccttcccggattctgctgacccatgggcaccttgatcacgtcggggctgccgtcgagctggctgccttctggcagattccgattgtcggaccacaaaagcgtgatgcattctggctggaggcgctgcctacccagagccggatgttcggacttgatgagtgcgcgccttttacccccgatcgctggctggaagagggggagagcgtacaggtagggctgaccacgctggaagtcctgcactgtccgggccattcgcctggccacgtggtgttcttcgatcggccaggaaggttactgatttcaggtgacgtgatttttaatggtggtgtgggacgcacagacttcccgcagggcgatcatcaacagttaatcgatgctatccgcacgaaactgctgccgctgggcgatgatgtcacttttctgcccggtcacggcccgatttctacgctggggcatgaacgcatcagcaatcctttcctgcaataaaaaatgggccagcaggcccatttttcaattcggtcatcctgcttacagcacggcgacaatggcttcgcacagcgccgacatattgtctggcgtcatgcccgccacattcacacgccctgagttcaccgcgtagacgccaaactcttcacgcaggcgaatgacctggtctttggttaagccactgaacgagaacatgccgttctgcttaataataaagctgaagtcgcgctgtgcgcctttctccgccagcgtgtttacgaagagctggcgcatgcgctgaatgcgctgacgcatgtccgacagctcctgctcccagatggtacgcagggtatcgttgcccagaatggtggcgacgatggcggcgccatgtgccggcggattggagtagttcgcgcgaatggtgtacttcacctgactgaaacgcggtatcagccacgctcgcatcggcggcaaccagcgtgatggcaccgacacgctcgttatacaggccgaaattcttggagtaagagctggcgacgatcagttcctgatgcgaggcggcaaaaatacgcaggccttctgcatcttcctccagaccacgggcaaaaccctggtaagcgaagtcgaacaatggcagccagccattggcctgtgacagctgcgccagctgttgccactgctcagcggtcgggtcgataccggtcgggttatggcagcagccgtggaacagcaccacgtcgcctggctgaacctgttttagcgacgccaccatgccatcgaaatccagcgtatggtttgcagcgtcataatagtggtattcacagacctcaagaccggcagcgttaaacacgttgttgtgattcggccagcttggattgctgatccagacccgcttcaccgatgtttgcgtggcgaggaaatcggctgcaacgcgtagcgcaccggtaccacccggtgtctgagccgtgcgagcgcggccagcggtgattagcgggctctggttgccaaacagcagggcctgtgtgcagcgggcaaaatcagctaggccatcaatgctgagatagtttttggtggtttcattttccagcagatattgctcagcttttttaacactggtcagcaccggggtcttgccggtttcgtctttatagacgccgatacccagattgattttttccgggcggtcgtcagcacgaaacagatcggccagcccaagaataggatcggcgggtgcagcagagatcgattcaaacatgtgtcaggtccattagcgtgaactttagcgaaaagagctctcaggttagcgtccggccagtcaaatgccaaccgtttgcgagacaaattcatacattttgtagtgtggattgcgcgacggggaaatgcagacgtttaagcggagtagaagggcgtgagaaaacagagttctggtgaatagcagccataaaaaaacggggccttagccccgtttttcaacatgttttaagcagtattagaactggtaaaccaggccaactgctacagtgtcatcagtgttcagattcagacggttgttgtcatccagctggttgatctgatagtccacataggtagacatgtttttgttgaagtagtaggtcgcgccgatatcaatatatttgatcaggtcagcatcgcccacaccttcgatatccttgcctttagactgaacataagcaatggatgggcgcaggccgaagtcgaactgatactgtgctaccagctcaatgttctgtgctttgtttgcaaagccagtggtagagaacgcgttaccgttagccagagtaccggtagcagtaactggtgttgagttgcgagtttcaccgtacattgcagccaggtaaacgttgtttgcatcgtacttaatagccgttgcccagttttcagcgcgtttaccagcaccctgaccggtgacattggtaactgcagcaccgccgccattagcctggctaggtgtaacagttgtctgtgcgcctgctgcctgagcattagtacgatcgctgctgctataagcacctacgatacccagaccgattggtgaggtataagaggttgacacaccgtagccgtcgccgttggagcgacgcaggccgtcggtaccggtgcgctcgtttttaccctgatactgaactgcgaagtcccagccatcaaccaggccgaagaagttggtgttgcggtaggtcagcaggccggtgctacggccgttcatgaagttatcggaatatcctgaatcaccaccgaaactctggcagcatatcggtccagccgattgcatcataaaccacaccgtagttacggccgtagtcgattgagccagcatcgccgaatttcagaccggcaaagcccagacgggttttgttgccattctgtgcatcagaaccttcagagttgttcgcctgaacgttgtattcccactggccgtaaccggtcagctggtcgttaatctgagtttcacccttgaagccgaagcgaacgtaagtattgtcgccatcgttgccgtcgttatcagagaagtaatgcaggccaacagctttaccgtacaggtccagtttgttgccgtctttgttatagatttctgcagcgtttgctgcgccggcggctaacagagcagggataaccactgcaagaatattgcgcttcatcattattcattaccctcattggagttatttgtacacctgccactgccgtcaagaaacctttacgggaaccctgaacgaagtttggtgtcttcctgtgtctgcacgcatctttccatcccacccgccgtaattctagcgcttaaatgctactaaactcgcaatcttgtttcattaagaaaatatgtattacaaaatgtaaaaaacacggaactttgtgagagaactcaaaatttacaaaaataaaaaaaggccggcagtgccgacctcgttatatatatgaatttcttatatttaatgccgaatatcagaaactcgcgttgcgtggggtgcgcgggaaggggattacgtccctgacattttgtacgccggtgacataggcgattaaacgttcaaagcctaatccaaagccagaatgtggcacggtaccgtagcgacgcaggtcacgataccaccagtaatcttctttattcagacccatctcttccagacgcgcatccaggacatccagacgttcttcacgctgtgaaccgccaatgatctcaccaatgcctggcgccagaacatccatcgccgccacggttttgccatcgtcattcaggcgcatatagaacgctttaatgtctttcggatagtttttcaccaccaccggcgctttaaagtgtttctcggccaggtaacgctcatgttcagaggagaggtcaataccccaggaaaccgggttttcgaaggtctgaccgcagttcatcaggatctcaaccgcatcggtgtaatccacctgcgcgaaatcggtggtgatgaaacgctgcaggcgctcaaccgcctctttatctacccgctcagcaaagaaggccatgtcatcggcacgctcttccagcaccgcgttgaagacatacttcagcattgattcggccagtgcagcggcatcatccagtgaggcaaaggcgatttccggctccagcatccagaattccgccagatggcggctggtgttggagttctctgcgcggaacgtcggaccgaaggtgtagatcttcgacagggcgctggcataggtttcgccattcagctgacctgaaacggtcaggaacgcctctttaccaaagaaatcttcactgaagtcaactttgccctgatcgttacgcggcaggttttccatatccagcgtagagacacggaacatttcgccggcaccttcggtatcggaggcggtaatcagcggcgtcgagacccagaaatagccattttcatggaagaagcgatgcagcgcctgcgccagggtgtggcgaacgcgggcgaccgcgccaatcaggttggtgcgcggacgcaggtgagccacttcgcgcagatactcgatactgtggcgtttcgccgccatcggatagctgtcgggatcttccacccagcccacgacttccaggctggtcgcctgaatctcaaacgcctggccctgacccggcgaggccaccactttaccggtgacgataacggaacagcccgtagtcagacgcagcacttcatcctgataattattcagagaattattgacgacagcctgaacgggattaaagcaggagccgtcatagacagcgatgaaggaaagaccggctttggaatctcttcgggtacgcacccaaccacgtacggtgacttcactgtcaaccgcgacgcgaccgtgcagtacgtccgctacaggcactacgctcataaatatctctctatatagaagaagtgagtaaaaaagttgccccatccggggttttgctatgttacttgcgagtcttcaggaaacaagcaaaattcagggggaaagcagatttattacagcagaggcggggcgtatcaacgccccgataagaagaggattaactcgcttttttcaccagcggcagatcaaaagctttacgcagggctctgacaaaggctttatcctggcagatagttttgcccgggctgtctgagagtttcgccaccggcttgccattgcactgcaccagtttgataacgatattcagtggcgtcacgcccggaatatcgcaggtgaggcgggttccgatgccgaacaccacgttcgtccgctgaccaaagtggcggtaaagcgccagcgctttgtcgagatttaagttgtcagaaaagaccaggtgtttgctttgcggatcgatacccagcttctggtagtgggcgagggctttctcgccccattcgaccggatcgccggagtcgtggcgcagtccctgatagcggcgggcaaacaccgggccgaaatcgcgcaggaatgcgtccatggcgatgcaatcggtcagggcgatgcccagcttatcgtcatactcatccagccacgcctgtaacgccgcgcgctggctgttggccagtaccggactgatctgctggaaggcctggaaccactcatgcgcctgtgttcccaccggcgtcagtgacaaacggcgcgccagatcatagttactggtgccaatcagccacggaaattcctgtttcagcgttgagacgatcgactgctgcacatcctgcgaatagcgacgacgggtgccgaaatccatcaggcggaagcgtgacatatcaaggtcagccacctgggctttaaagtcgccgagtttctgatgtaaatggtcaagtgcctgctgagtggtgacctgtggcgtgcgatgacgatgcacaatctcactgatcagcgccagcagcggcacctcccacatgatcacttcgcgccacggcccctgaatacggagttccagcttgccatggtgattgcgcacctcaacctgatccgggttatagcggaactggcgtaaccagctgaggtaatcctgccggaagaagggaaggtgagacaaccaggtcgcttcatcatcagtcagcgccaggtgttgcattgcggttatcgcgtcacgaatttcgtcagcgtagagacccagcagtttcgtcgccgcggcagcgaaactccgccgccaccgttatgtcatgatagcggtggaaaacggcctgctgcatatggagcttataggcgtccgtatccagcagcgaggtcagtatcggggaagcatgtcctgtcatggcgcgtttcagcatcctgttcggtggcgcagagcccggtgttgtacacagtcataaagacgcaaaagtataattcactatctgaagccgatcacagcatatttcagacgggcgggtcgaggccaatctgtgccattgttaacaaagtgtagccatttcaccctttaggtgcattgtgcgtggcaagcttgtagtaacaagcttagactttgccggtaaacttataacaacgcgagacgcaatatgacgcaacagccccaaatcaagtatcgccacgactaccgtgcgcctgagtacaccatcaccgatatcgatttaacttttgaactggatgcgtccaccacccgcgtaacggccatcagccaggttaaacggctgggcgacagccaggctgagctgcgactggacggcgaagcgttaacgctgattgcgctggaggttgacgggcaagcctggacggccttccgtgaagaagagggcgcactggtcatcagccagctgccggaaagcttcaccctgaaaattattaacgatattcacccggaccagaacaccgcgctggaagggctgtacaaatcgggcgaggcgctctgcacccaatgtgaggctgaaggcttccgtcatattacctggtatctcgatcgccccgacgtgctggcgcgctttaccaccaccatttatgccgacggtgagcgttatccattcctgctctccaacggtaaccgcattgacagcggccgggatgagcagggtcgcagctgggtgaagtggcaggatccgttcccgaaaccctgctacctgtttgcgctggtggcgggcgatttcgacgtgctgcgcgacagcttcaccacccgttcaggacgtgatgtggcgctggagatcttcgtcgatcgcggtaacctcgaccgtgccgactgggcgatgacgtcgctgaaaaacagcatgaagtgggatgaagagcgtttcggtctggagtatgacctcgacatctttatgatcgtggcggtggacttcttcaacatgggcgccatggagaacaaaggccttaacgtcttcaatgccaaatatgtgctggctaaagcggaaacggcgacggacaaagattacctgggcattgaagcagttatcggtcacgaatatttccataactggaccggtaaccgcgtgacctgccgcgactggttccagctcagcctgaaagagggactgacagtgttccgcgatcaggagttcagctctgatctgggctcacgcgcggtgaaccgcattgataacgtgcgtatcgtacgcggtgcgcagttcgccgaagatgccagcccgatggcacacccgatccgtccggatcaggtcattgagatgaacaacttctataccctgacggtgtatgaaaaagggtcagaagtgatccgtatgatgcacaccctgctgggtgaagagaatttccagaagggcatgaagctctattttgatcgccacgacggcagcgccgccacctgtgatgattttgttcaggcgatggaagatgcctcgaatgttgacctgtcgcagttccgccgctggtacagccagtccggtacgccagtgctgacggtacgcgacgattacaacccggagctggagcagtatacgctgcacgtcacgcagcacacgcctgcgactgccgatcagaaagagaagctgccgctgcatatcccgctggatattgaactctacgatggcgaaggcaaggtgatcccgctgcagaataatggtcatccggtacatcatgtgctgaatgtcaccgaggagttccagacctttattttcgataatgtctacttccagccagtgccgtcgctgctgcgcgaattctctgctccggtgaagcttgattacaaatggagtgatgctcagctcaccttcctgatgcgtcatgcacgcaacgacttctcccgctgggatgcggctcagagcctgctggcgacctatatccgtctgaatgtcgcccgctatcagcagggccagcatctgtcactgccgctgcatgtcgccgacgccttccgcgcggtgctgctggataccgactgcgacccggcactgaccgcgctgattctgacgctgccgtcggaaaatgagattgccgagctgtttgatactatcgatccgcaggcgattgcgctggtgcgtgacgcgctgcaacgcacgctggcacgcgaaactggccgatgagttctttgcgatctacaacgccaatcagcagcctgaataccgcgtggagcatgacgcgataggtcagcgcagtctgaaaaatatctgcctgacctatcttgcattcagcgatgcgcagctggcggataaactggtgcagacgcagtatcaccaggcgaccaacatgaccgatgcgctggcagcgctttctgctgcggttgcggcacagttaccgtgccgtgatgcgctgctggcagcttacgatgagcgctggcatcaggatggtctggtgatggataaatggtttgtgctgcaggcgaccagtccggccgctaacgtgatgcgcaatgtgcgtcagcttctgaatcatcgctccttcaccatgagtaatccgaaccgcgttcgctcgctggtgggtgcctttgcctcggctaaccctgccgccttccatgctaaagatggcagcgggtacaagttcctggtggagatgcttaccgaccttaacacccgcaatccgcaggttgcggcacggatggtggagccgctgattcgcctgaaacgttatgacgaagtccgtcaggcgatgatgcgccaggcactggagcagctgctggagctggataaactctctggcgacctctacgagaaaattacccgggcactgaacgcctgataataaaaaaggggagtgtctgagacactcccctttttcagcgctgctgcgcgaaacgaaccggctgcggtcgctccgtacgctgcatgacccgatccagtacctccgcttccagctcggccagccgcgccgatccgcggcggcggggacggggcagatccaccagcagatccagcccgatttgaccctcttcgatcaacagcacgcgatctgccatcaccaccgcttcactgacatcatgcgtaaccagcagcacggtaaagtgatgctgctgccacagtgactcaatcaatccctgcatttcaatgcgggtcagggcatccagcgcccccagcggttcatccagcagcagtaaaccgggccggtggatcagcgctctggccagtgcgacgcgctgtttctggccgccggagagggcggctggccactcatcagcccgatcggcgaggcctaccgccgccagcgcatccagcgccgcgctgcgccattcgcgtccgcgcagacccagtccgacgttatcgatcacttttttccacggcagcagtcgcgcatcctgaaacatcaggcgggtatcttcacgagccgactgcagcggcgcattgcctgccagcagttcaccgctggagctctgttcgagaccggccagcaggcgcagcagcgtgcttttgccacagccgctgcgacccaccaccgccacaaactgaccggagggaatatgcaggtcaatcttattcagaatggtgcggctgccatactgtttgctgacgccgttaacgccaaccggggtgccggtgttaaggcgcgccggtgagagagtctgactcatgcgttctcctccttcagttgataagcgggatgccagcgcagccagacacgttcaagtaacaacgcggcgacatctgccagtttgccgagcagggcgtaaagaataatggcgaccactaccacgtcggtctgcaggaattcacgcgcgttcatggccagatagccgatacccgcgttggcagagatggtctctgcgacaatcagcgtcagccacatcagacccagcgcgaaacgcacgccgaccataatattgggcagcgcgccgggcaggatcacctggataaacaggctccagccggaaaggccatagctgcgcgccatctcaaccagcccgcgatcgatgttgcggatgccgtgataagtattcaggtagatcgggaacagcgtccccagcgccaccagaaagatcttggcggactcatcaataccgaaccagaggattaccagcgggatcagcgccagatgcggcacattgcgcagcatctgtaccgaggtatccagcagtcgttcaccggttctggaggtgccggtaatcagcccgagcagcaggccgatagaaccgccgatactgaagccgatcagcgcccgccagctactgatcgccaggtgttgccagagctcaccactggcggtcagctgccagaaggtggttacaattttctccggtgcgggcagaatgcgggtcgacaaccagccggtttgcgaggcaatctgccacaccaccaccagcagcgtcggcagcagccagggcaccagcgtatcagcaaggcgttttcgggttctggtcatcatgctctcctcagccccgggcgacttttttctcaggggtaaaatcgttggctaccgcttcaccgtgtgcctgaaccacgcgtggctggggcaccagtggaatctgcagatcaagatgcgggaacagcagtttcgccaacgcgatacgcctcttccaggtgcggataacccgacaggataaaagtctcgatgcccagcgcttcatactctttgatgcgagcggccacggtcgggccatcgccgaccagcgcggtcccggctccgctgcgcaccaggccgacgcctgcccacaggttagggctgatttcgagcttgtcgcggcgaccgccatgcagtgcggccatccggcgctgccccacagaatctgcccgctggaacgccgcctgcgctttcgcgatggtggcgtcatccacattggcaatcagtttgtctgcggcctgccaggcctcttcattggtttcacgcacgatcacatgcagacggatgccaaaccggacggtgcgtccctgggctgccgctttcgcgcgcacctgatcaatcttatctttaacctgcgcagggggttcgccccaggtgaggtaaacatcgacctgttcggccgccagctcctgggctggctcagaagagccaccaaaccacagcgggggacgaggctgctgcaccggtttaaacatcagacgcgcaccgcgtaccttcacgtgcttgccttcataatcgacggtttcgccttccagcacccgacgccagacgcgggtaaactcggcggattccgcgtagcgctcgcggtgatcgagaaacacgccgtcgcccgccagctcttccggatcgccaccggtcaccagattaaacagcgcacgtccgttagaaagacggtccagcgtggcggcctgacgtgctgcctgggtcggtgaaatcaccccaggacgcagtgcgaccagaaaccgcaggcgctgcgtcaccggaatcagcgaggcggcaaccagccaggcatcttcacaggagcggccggtcgggatcagtacgccgccaaagccaaggcggtcagcggcctgcgccacctgttgcagataggcgtgatcaaccggtcgcgccccttcggcagtaccaagatagtggccgtcgccatgcgtcggcaggaaccagaaaatggatacgctcattgttgctccttattgcgtcacggtatgcggatgccagatgcgatcctggatcgtcacttttactggcaagagatgattggcatagaacaggtcagcagtgcgctgctgagctgcggcagtttcggcactgaccggcgaaatccgggtgggtggccgatggctgaggtagctggcgataaccggttcgggcaagcccatcgcctgtgccagtaacgtggtgctctgctgacgctggctgattgtcagcgcgtcagcagagctgaaggtgtcgagcacctgctgaataaacgcgccatgggcttcggcatagctgcgggtcgctaaatagaaggagccggtaagattaagggagctgccatcaatcagcaggcgcgaatttccctgcagcagcaccgatgaatagtaggggtcccagattgcccaggcatcaacgtcaccctgctggaaggcggcacgcgcatcggcgggagtgagataaaccggcgtgatgtctttaaaggtcagacccgcctgctgtaaggcgcgcagcagtaagttgtgagagctggagcctttctggaaagccactttcttgcctttcagatccgcaacctgtttcagtgggctgctttttggcaccagaatcacttctgctttgggttttggcggctccgcgccaacatagagcagatccgcgcccgcggcctgggcaaacagcgggggaagatcaccggtactgcccaggtcgatactgttgatattcagcgcttccagcatttgcggacctgcagggaactcgatccacttaatccgggtatgaggaaatcgtttttccagtaactgatgtgactttgccagcaccatgctgaccgaacctttctgatagccgatacgaatctcagacggatcggattcggcggcctgtacctgaaggccggccagcagaagtccggccaccagccactttcctaatctcagcttcatcgatcgcttccttataccgcttgcgcaacgggatggtggtgacgggtcagtgccagccagaaggcggagacggcctcatccaggcgctgtgacagtgaatcctgcagtttcgggctgacggtcgtaatgactgatctgatgatcctcggcataaacaccatgcaggatctcctgcgcctttaaggcgttgagcaccggcttcagggcgtagtccagcgccagcatatgaccggcactgccgccgctggccagcggtaacacgactttgtgttccagtgcgcgttcaggcagcagatcgagcagcgtcttcagcgcacccgaaaacgacgctttatagataggtgtcgcaataatcagtccatcagccgaagccagatcgtcacgcagggcgagaagcgcaggtgcatcaaaacgcgcattgattaaatcgtcaggctgaaagttgtgaatattccacggaatgacttcaataccacgcgcctccagcttgtgctgacacagcgtcagcagtgaggttgagcgggaggggaatcgtgggctgcctgccagcgtaataactcgcatcatcactccttataactaaaagttattgattatcaaatgttgagaacttatgccttcatactgtcagagcaggggagtgggcttaaatgatttatccggcaaagtaagggtgaaatctgcaaatagaaggcgttgcgacagatgtcagcatcgccgcttccgataattcttaaattaagcgctgacagcggaacaattcattaaggggcatgatacgagatcgtcaaaatgtgtcggttgagcagaaaaaatatctttcgtctgattgcttaatcattttttctgagagtggcgcggccataaagcgcaacggctgaaaaaatagcgctgcgaagcagcacagaatcagcttatctgcggcagcctctgccaaagattaagatttattgcagaaagcaaactgtaataataatgaaggaatgctgaacttattcatcgtttcagatgttcgcttacagatttctgaatctggttacgtctgctttgcagggctaatttaaatcgatcctcaacggttttaacattactgcgggctatagatgcactttcgttaagagtgatgctcacatgaaacattaagatgatttttacggctggtcttttttcgcattacaggtttaagataatcgggctcaatgaaagcaatcataataatcgcgccttactcttttcgacgtttcgcctctggtcagaacctgcatcaggcaggtgaatcgtattgtcattttctaacagcagagaattgcatatgtctgacatcctgttatccgttattattccaacctataatgttgagaaatatattgtagagtgcgtcgattcgttattacgccaggttaaagcgcccaatgaaataatcattgtgaatgatggatctactgatggaacattagccttaattgaacagaattatgcacacctttctcaggtgaaagtgatcaccattgaaaatggcggcctcggcaatgcacgggacaccggcattgcactggcaaagggtcagtttctctttttctgtgatccggatgatgtcgtggttgatggcctcgtcactgagctggcaatggtggcggagaagcatcctgaaacggatcttttctgttttaactcctgcgtctatgaagatggccacattgatatcacctcgccaaaagtgaagcatgaccagtttggccagcagaaaccacaggaggtctttctgcgcctgctgcgtaatggcagatatacctctgccgtctggaattacgtcttaagaaaaagcgtcattgaacagcataagttgcgctttgtacgtcgggttcatgaagaccacaactttacgctctccgtgtttatgaaatgccagcacgcatgggtcagccgtcaggtctattataagcagcgcatccgcagtggttcactgaccaacagtaccaaaggcaatgagtttttctatcagcgctatgacgcttttatgcatgcttataatacgttaaccagttcgctccctaaatcagcctggcgtagttcgctggaaaaatcttatttacttcactcgttccgtctgatgatctatttgtctctctataataaaacgccggtaccagaatatgttcttaatgctattcgctttatgggacgcaacgtaaaaactgagaacattaaagagtggctattgttcaatcggcctgaactgtttattgcactgcagcattataaggtcaaaaaagaactcaggcgcgcagcctgattctgaaaaacagcctgattctgaaaaatgtttagcgatattgtttatgccttagcgaaatgagaaggtgagacatgcaatgtgtataaggttgttgcgacatggcaaaagtactcgataaaagtctggttattaatattttctcgctgctggcttaccgtggcgcgtcgtttctgtttccgctggccacgctgccctatcttgcccgcgtttctgggtgtagagcaaatgggtacgctggcgctggcgatcgcctgcgtcctctattgcagcaccatctccgactggggattcaatgtctttaccaccaaagatattgctcaccatcgtgatgacaaagaacgcgtcagccagctcttctggtcaacattcaacgccaagctgatgctgctggtggtcaccagcggcacgctgctgactgcgacctggttcaatccctcctggcaccctctgttcttcatcattctggcgaactgcaccacgctggtcggctcgctgttttcattcggctggctgatgcagggctttgagaagctgggtaagacggcgatgatcgccaccttcggtaacttctgtgcgattccgctgacctttttgctggtgaaatctccgcaggacacctggctggctgccctgatccctggcgcggtctccattatcagcgcggcgattacgcttaagttcgtgctggagatgaaagtcattggccgctatcgctttgaaccgcgcgaaatcaaacagcgcatcaccgacagcatggatgtatttatcgccattgccggcgctaaccttttcaacagcgtcaacgtggtgattctcgccacctttgcttctacttacatggtcgggatctacaacggcgccgatcgcctgcgtaaagcggccaactctgtgccggagcagatcggcagcgccttcttcccgcgcgtcagccacctgttcggccgggataaacgggccgcgattgccgcgacacgcaaaagcctgctgctgtcgttttccctgagtctgtcgattgtaatcttcacctggttctttgctgacctggtggtctcaatattgctgggtaaagactttatccagtcagcggatgtgctgcgcgtctttgtgctctgcttcctgtttggcaacattgcctacccggctggattacagattctgatcccacatggtctggcccgccagcgtatgtgggtgatgatggccgctggtgtggttaacgtgccgctctgctgtttcctggcgtggaagtttggcgcaatcggtgccgcatggtcgatggtcggggctgaagcgttcgtctgtctcggtatttttggcatcatgcaacgtcacggcatcctgcgggaatatctgtttccctctgaggtgaaaaatcaaaccgtaaacgattccgccgcgtaagatcaaagcattttcagatagttttatgcatccccgctgttcgatttacttttgcgccagagcactttaccattctggcgcacattttcccgtgcaccgacttccacgatcgcttccgtccttcaggagagtgcatgttttatcctatcgtccgaccggcgctgtttaaacttgatcccgaacgcgcacacgaactcacttttcagcaactgcgttttatgaacggcaccccactggagatgttttatcgccagaatctgccgtcgcgtccggtcacctgtatgggactgacctttaagaatgccctgggcctggcggcgggtctggataagaacgcagagtgcattgatgcgtttgcggcgatgggctttggctttgttgaagtcggcaccgtcacgccgcgcgcccaggcggggaacgataagccacgcatgtttcgtctggtggaagcgggcggaattatcaatcggatggggtttaataatctgggtgttgatcacctggttgaaaacgtgaagaaagcgcgctttaacggcgtgctggggatcaatatcggtaaaaataaagatacgccggtcgagcagggcaaagatgattatctgatctgcatggaaaaggtttatgcccacgccggttatatcgccatcaatatttcctcacctaacactcctggtttacgttcgctgcaatatggtgaggcgctggatgatctgctttcttccatcaaacagaaacaaaaagagctggaacagcgtcatctgaaatatgttccgctggccgtaaaaattgcgcccgatctctctgaagaagagttaattcaggtcgcggacagtttaattcgtcatcagattgatggcgtgattgccagcaataccacgctcgatcgttcgctggtgagcggtcttaagcatgctgaagaagcgggtgggttaagtggacggccagtgcagtcgcgcagcacggcggtgatccagcgcctctctcaggaactgcagggacggttgccgattattggcgtcggcgggatcgattctctgacggcagcgcgtgaaaaaatcgccgccggggcaacactggttcagatttattcaggctttatttatcaggggccaggcttaattaaagatatcgtcacccatctctaagacaattctcacaatcattggccggggggtttatttatcccctcggctcgtttatattttgtcctgttgcacgctttttcagcttttccttatgtttcttttttcgctgaattctgcgtgatttttggcgcagcggtaaatacagggcacacgatgaaaattaaacccgatgataactggcgttggtattttgacagtagccacgaccgaatgatgctcgacctggcagacggtatgctttttcgttcccgttattcccgcaaaatgctcacgccggatgccttcactgaatcgggtttttgtgtcgatgacgccgccctttattacacctttgaagagacctgccgtcagtgcaaactcagtggcagccatcgcgctgaactggtgttaaatgcgctggtcgctgcacgtttcctcaagccactgatgccgaaaagctggcatttcgcctcttatgctccggcaatgcagccccgtcccggtgaaatggtacaggttacgctggcagaagagggaaacgcaggcacgactgctggtggttgagagtggcgataatgcggcgctctgcctgctggcgcagccgggattgacgctggccggaaaaaacatggtgctcggcgatgccatcaaggtgatgaacgatcgcctgcagcccctgtatcaggatgtcgcgccgcgctacgcccgcgcagtctgactaccttagttctacatcgccagccggaatacagctgcagctcaacagcgtgccgtcctgacgcagggcgctctgtttcagcgccttaacctcacccgcgaccagactcagcttgcaactgccgcacagtcccgcccgacaggagtaggggatccggaagccctgcatctccagctgatccagtaatacctgctgattatccccggtgaacgtctgaccctgaaacgtgatagccacggcatctggcgcctgctgctttggtttcagtgtttcgaccacttcaccggcaccatagctgcgcggtgcatgacgtttcaggacaatcatctcatcaccggcgcgcaccaccccactgttgcgcgccactaagttcagaccgaaatcaatatccccgctgccatccagggcggtgcggaacgtctgcagcgtggccagtggatgaccggcaggatgcttaacgccggtctcggtgctgacagtggtgagcacgcagcgactgcatggcttaggcacctcgaatatcacgtcgccaatctgaatctccgcccagctgtcttcatcccatgcggcagcgccgctgacgaccagattcggacgaaactgttcggcacggacgctggccgggcagcgctgttgcagatcatgcagcgacgcgttgttgatcagcaaaaacggaaagccgtcggcaaagctcagcggaatatgattaaacgctttaacccggcggctgagttgcggcccgacccagcgcaactgaacctcacgcgggaagaactggctcagccattggttaatcgcaggcggcgctatgcgcgcggtgaaatgatttccccagacttcggtggggtgatcctgctcatcgaaatcgctgaagcggatcagggagtgactgccatccggggccgtcagcagcaggccatccggtaaaatcgcgggcgtgaagcgcaccatctccggatgctgacgcgcggtaataaaggtgccatcaggttcggtcaccataaacagacgatcaaatgccagtccgctgtcagtgaccagcgcgtgtgacagcgctaatccccgcatcgacttcacaggatgaataaataagcgggaaagcgtgatcatggtgttctccttgaacccgacgcgcagcacaaaagaagctaactttatgacataggtctccgattcgctataatgcgcgacaattttctcaagagttaaaaagtgacgatatgaattctctgtttgccagcacggcgcgtgggctcgaagagctgttaaaaagtgagctggacgcgctgggcgcgcaggatttgcaagtggtgcagggaggcgttcactacgaagccgacgatcgcaccatgtaccaaagcctgatgtggagtcgtttagcatcacgcatcctgttgccgctgggagagtttggcgtctacagcgatctggatctctatctgggcgtgcagagcgtggactggccgacgatgttcggcagtgacaaaacctttgttgtgcatttcagcggcaccaacgattcgattcgtaacagccagtttggtgcgctgaaagttaaagatgccatcgtggacagctttacccgtcagaatctcgaacgacctaacgtcgatcgtgaacaggcagatatccgtgtcaacgtctggctgaatgacgatcgcgccagcattgcgctggatctcagcggcagctcactgcatcagcgtggttatcgccagcagaccggtcaggcgccgttaaaagagaccctggcggcggccatcgtgctgcgtttctggctgggagccgacgacaccgctgatcgatccgatgtgtggttccggtacgctgctgattgaagccgcactgattgcctgcgatcgtgcgccaggcctgctgcgcaagcactggggcttcaccgcctggagccagtttaacgctgcgttgtggcaggacgttaaaaccgaggcgcagaaccgtgcccgcactggcacggctgccacccaggcgcgcttctttggctacgacaataatggtcgggtgctggagtgggcgcaggcgaatgcccgccgtgctggcgtctttgaacttttcaccttcggccagcaggatctgctgaagctgactaatccggttgacccggcggttcacggtacggtgctgagtaatcctccttacggtgaacgtctggagagcgaaccagccctgattgcgctgcacagccagctcggacgtctgatgaagcagcattttggcggctggaacctgtcgctgttcagtgcctcgccagaactgctgagctgcctgcagctgcgtgccgatcgccagtttaaagcgaagaacggtccgctggattgcgtgcagaaaaactataagctggcggttaacagtcatgaaagcgccggacagattgcggaagattacgctaaccgcctgcgtaaaaacgtgaagaaactggagaagtgggcgcgtcaggaaggcattgaatgctaccgtatttatgatgccgatctgccagactacaacgttgctgtcgatcgctatggcgactgggtgattatccaggagtacgcgccaccgaaaaccatcgatcctgataaagcgcgtcagcgtctgttcgatgtcatcagcgcaacgctgagcgtgctgcaactgcctgccgaccgtctgattatgaaaacgcgtgaacgccagaaaggcaaagcgcagtatcagaagctcagcgagaagggcgactatttcgaagttaaagagtttaatgcgcgtttctgggtgaatctgaccgactatctcgataccggcctgttcctcgatcaccgcattgcccgtaaaatgctgggccagatgagtcagggcaaagatttcctgaacctgtttgcctataccggtaccgccagtgtgcatgccggtctgggtggcgcgcgttcaaccactacggtagatatgtcgcgtacctatctggagtgggcggagcgcaacctgcgtctcaacggactgaccgggcgtcagcatcgtctgatgcaggcggactgcctgagctggctgaatgagagtgacgagaactttgacctgatctttatcgatccgccaacgttctccaactcaaaacgtatggaagagagcttcgacgttcagcgcgatcatatgatgctgatgcgtaacctgaagcgcctgctgcgtcgcggcggcaccatcatgttctccaataacaaacgcggtttcaaaatggacatggatggcctgaaatcactgggcctgcaggcgcaggatattacccagaaaacgcagtcgcaggacttcgcgcgtaaccgtcaaattcacaactgctggctgatcactcacgccggtaaggaataagcttacatgtcattaatcagtatccacggcgcttatctctccttcagcgatgcgccgctgttagacaacaccgaaactgcacatcgaagagaacgaacgcgtctgtctggtgggccgtaacggtgcgggtaaatccacgctgatgaaaatcatcaatggcgaacagccactggatgatggccgcattatttatgaaaccgatctggtcgtggcgcgtctgcaacaggatccgccgcgcaatattaccggttcggtgtatgacttcgtggccgagggcgttgaagagcaggctgagcatctgaaagcctatcacgccatttcccatgtggtgatggaagaccccagcgataaaaacctcaatgagatggcgcgtctgcagagcattctcgaccaccagaatctgtggcagctggagagccgcatccatgacgtgctggagcagattggtctgcagcccgataccgagctgtcgtcgctctcgggcggctggctgcgtaaagcggcgctgggccgtgcgctggtgagtaacccgcgcgtcctgatgctggatgagccaaccaaccacctcgatatcgaaaccatcgactggctggaaacgttcctgaagaacttctccggcagcatcatctttatttcccatgaccgttcgtttatccgcaacatggcgacgcgcattgtcgatctggaccgtggcaagctggtctcctggccaggcaactacgatctctatctggaaggcaaagaggaagcgttgcgcgttgaagagatgcagaacgcggaatttgaccgtaagctggcgcaggaagaggtgtggatccgtcagggcatcaaagcccgtcgtacccgtaatgaaggtcgtgtgcgtgcgctcaaagcgctgcgtcgtgaacattcagaacgtcgtgaagtgatgggcaaagccaacatgcaggtgggcgaagcgtcccgttccggcaagattgtgtttgagctggaaaatgtcgactacgcggtcgatggcaaagtgctggtgaaggacttctcaacccaggtgcagcgtggcgacaaaattgcgctgatcggaccgaacggctgcgggaaaactaccttactgcgcctgatgctgcagcagctgaaagctgaccatggccgcgtgcattccggtaccaagctggaagtcgcctactttgaccagcatcgcgctgaactggatccggatcgcaccgtgatggacaacctggccgaaggcaagcaggaagtactggtcaacggcaaaccgcgccacgtgctgggctatctgcaggacttcctgttccatccaaaacgtgccatgacgccggtgcgcgccctttcgggcggtgaacgtaaccgtctgctgctggcacgcctgttcctgcgtcccagcaacctgatgattctggatgaaccgactaacgacctcgacgtcgaaacgctggaactactggaagagctgattgatggctatcagggcaccgtgttactggtgagccacgatcgtcagttcgtcgataataccgttaccgagtgctggatttttgaaggcaacggtgagattggtacctttgttggcggttatcacgatgctcagcaacagcgcgccgcctaccggcagcacaaggcggcagcaccggcgaaagcgacgggcaacgtctctaagcctgcagccgagaagggtgatgcgaagcgtagcgtgaataaactcagctacaatctggcgcgtgagctggaacagctgccgcaaaaactggagcagctggaagcgcgtatcggagaactgcaggcgaagatgagtcatcccgacttcttcagtcaggcacacgatcagacgcaaccggtgctggataatctggctcagactgagcaggagctggaaaccgcttttgcgcgctgggaagagctagagtcactgaaaaacggcgcgtagggcagggctaacggatgtgttcagcagtgaaaagtaacgcgtggatgctctgtccacaatgcgatttaatgattaagctgccggacattcccgttggcagccgtgcgtcatgcccgcgctgccacacctccctgacggccaactggcacgaaccgcgtaaacggccaacgggctatgcgctggcagcggtgtttatgctgctgctggcgaatctgtttccttttgtctcaatgaaggtggcggggctgaccagccagataaccctggcgcagatacctcaggtgatggtgacggaagattacagcagtctggcgacgctgttccttctctttgtgcaggcggttccggccttctgcatgatcaccattatccttctggtcaatcgggtcccgttgccgactggactcaaaactggtctggcacgtattctgtttcagctgcgtaactggggcatggcagaaatctttatggcgggcgtgctggtcagtttcgtcaagctgatggcctatggcgagatcggcctggagaccagcttctggccgtgggtttctgttctgtctgctgcagttgcgggcctttcagtgcgttgatcgacgcggcttgtgggacagtctgtccccccggcctgcactgccccatccgcccgaagtgggcatcagtggtttagagcagggtctgcgctcctgtccctgctgtacggccattctgccggaagcagagcataagtgtccccgctgcggcgttacggccgaggcacggcgtaagcacagcctgcagtggacgctggcgctgttgttcacctcaatactgctttatatcccggccaacctgttgccgatcatggtgacggaaaccctcggcactgcctatccctccaatatcatggcgggggtgattgtgctgtggggtgatggctcctatccggtggcgctggtgatctttatcgccagtatcatggtgcctacgctgaaaatgctggcgattggctggctttgctgggatgccagcggacgcggacagcgtgacagccacaggatgcacaaaatttatgaagtggtcgaatttgtaggccgctggtcaatgatcgacgtgtttgttattgccgtgctctctgcgctggtgcgcatggggcaattaatgaatgtttatcccgcgtggggggcagtattgtttgcaatggtggtgattatcaccatgattgctgccatgacctttgacccgcgattaacctgggatcgtgtacgcgaaaacaatatgaaggagtcgcgccttgacggaaactaatcacggccatgcaaaggtggaacagattaagcgctggtcgccggtctggattgtccccatcgttacgctgttaatcggcggatggatcctcttttatcacttcagccatcaggggccggaagtcaccctcatcaccgaaaacgccgaaggcattgttgcgggtaaaaccacgattaaaagccgcagtgtggatgtcggtgtggtggaaagcgcggtgttaagcgacgatctccaccatgtggaaatcaaagcgcgcctgaattcaggcatggaaaaactgctgcacagcgacagcgttttctgggtggtgaaaccgcaggtgggtcgcgaagggatcagcggtctcggtactctgttatccggtgcctatatcgaattacagccgggcactaaaagccaggcacccgagcagtttaagctgctggatgcgccgccgttagcgccaccggatgccaaagggattcgcatcgtgctggacagcaagaaagcgggtcagctcaatccgggggatccggtgctgttccgtggctatcgcgtcggtacagtcgagaccagcgcttttgataccgaaaaacgcatgatgacctatcagctgttcgtcgctgcgccttacgatcgcctgattacaaccaatgtgcgcttctggaaggacagtggcatcgccgtggatatgtccgcttcaggaatgcgggtggaaatgggatcgctgaccacgctgttcagcggcggcgtcagttttgacgtgccggatggctgggagctgggtcagcctgcgcagaataagtctgactatcatctgtttgacgatcagcgcagcattcaggactcgctctacaccaaccatattgattacctgatgttcttcaccgactccatccgtggtctgcaggcgggggcgccggttgagtttccgcggcattcgcctgggtaccgtctcagaagcgccattgatgaaagccggtctggaccaggcgctgaacaatgattaccgcgtgccggtgctgattcgcattgagccggatcgctttatcagccgactgggtgagaacttcgatctgcaacagcatctgcaggatggtaaaaaacgtggcctgcgtgcgacgctgaaaaccggcagtctgttgtcgggtgcgctctatgtcgatctcgacttctatgacaatgcaccgccttacaaagggccgcagaaagtctctggctatgaagttatcccaacggtcagcggtggcctgagccagattcagcagaagctgatggcggcgctggataagatcaacagtctgccactgaacggtatggtcaatgaagcgacaggcacgctgaaagagagccagaaaacgatgcgtgatctgcagcgcaccatcgacaacatcaacaaagtcaccgccagtccggctatgaaaaccctgccggaagacctgcagcagacattgcgcgagctgaaccgcagcatgaaaggcctgcagccaggttcaccagcctacagcaagctggtgggggatatgcagcgcctggataaggttctgcgtgaactccagccggtgttaagaacgcttaacaccaagagcaatgcgctggtatttgaggcaaaaccgggacaggatccccagccgaagagggcgaaacagtgaataaaggattgatactttgtgccgcgctggtgttgagtgcgtgcagtagcagcgttgacaatacctggtatcagctgccctccggggcggcttccatgcaggtcagcagcagccagctgaatgaagcgcaaccgatgttatgggtgcagcaggtgacggtgccggactatctggcaggcaacggactggtttatcagaccagcgatgtcaaatacgttatcgccgcgaataatctctgggccagcccgctcgatcagcagttgcagcagacattgatcactaacctgagcaaggcgctgccaggccggctggtagccggttcacctttaggcgcgcagcacgatacgctgaatgtgaccgtaacaggcttccaggggcgctatgatggcaaagcagttgtcagtggcgaatggacgctggaacatcagggccggctgaccaaacagacgtttaacctggtactgccgcagaccgaagatggctacgatgcgatggtcagaacccttgcggcgggctggcaacagactgcacagaagattgccaatagcgtggttgcgttaaattaagattgatgtgaataaataagctaagcccctgaccgattgtcgtgctttcccgacaggggtcaggggcttttttattagcttaatcagaaagatagtgttgtcgcatgcatcacagaacgtcattatttttaccgattaaggtcacatttatgacactggcatgaagattgggcattgatctttgggtgcgcaggaggtagaacataagggtggttgaacattaattcaccacttttctttccaccagattccacagaccttacatgagggacacggagtatgaagagacagaaacgagaccgcctcgaaacgcgcccattcacgtggttatcaggcaggcattactggacgctcaaaagagatgtgtccgtatcagttgattgacgctaagtctcactggttgggaggttggcgacaagccatggaggacaggtcggtagctgcataaccggatgtcactgaaaagggaatataacctccgccatgcgcggaggtttttgtttccgggggaaacacttagaaagcggcggtatctttaaacaggccgactttaagatcgctggcggtatagatcagattaccgtcaaccagcacttcaccatctgccacacccataaccagtttgcggttaataacgcgtttgaagtgaatgcggtaagtcactttcttcgcatctggcaggacctgaccggtgaatttcacttcacccacgcccagcgcacgacctttaccttcgccgcccagccagcccagatagaaaccaaccagctgccacatggcatcaaggcccagacaacccggcatcaccggatcgccaataaagtgacagccgaagaaccagagatcaggattgatatccagctccgcttcaacaaagcctttgtcatatttgccgccgtcttcggtcattttgaccacgcggtccatcatcagcatgttgccggatggaagcggcggaccattttcgccaaacagttcaccacgacctgacagaatcagatcttctttggtataggattcgcgtttatctaccatgttttcaataagccttgttttagtgaatcacgaatattagcgaacagttgtatgctgagcaaatcggattaacggtggttgaaccagttaagccagcgcagcgcccagggacgttgcggaccgtccggctggttgaacaggctaatgcgttcctggatggtattcagcaggcaatcgcccaggccatcctcggtactccagattttaccggtcagcagcggtagcgcttcatcggcacggtcaattgcccagatatggaaatgaccctgttcaaccgcactgacaaccgcctggctgaggctgagatgacggacattgctggcgggaataatcacgccctgctgacctgtcagttctcgctgatggcagatatcaaagaagccttcgattttctcattcagtccgcccaccggttgtacgttgccgaactgatcaaccgagccggtcaccgcaatttgctgattgatgggctgattagccagcgcgctgattaaggcacagagttcagccagtgaagcactgtcaccatccacctcggagtaagattgctcaaagaccattgaggccgagaagggcagttgctgatcgagttccagtttcggcaatcaggtaagcctgcataatcatcatgcctttggcatgaatattaccgcccagctccgctttgcgctcgatatccatgaattcgccatcgccgggatgtaccacgcaggtaatacgcgagggatcgccccaggcacggggatggccaggatattcaacgaccgacaggccattaatctgaccaaccacttcgccttctgtttcaatcagaatctgtcgcagcaggatctcgtcacgcatccgctcattgagataattctcgcgccacaaacgcgcttccagcgcatcacgcagcgcttcagcgttcagttcatcgcccatcagggccgattcgcgcatctggcgttgtagccagcgggggcagagtggcagcgtttcctgatcgccgctgtagcggacgccttctttaatcagttctggccagaagtccgcttccggctggggcagacccgcctgttgcgccagttcgatgttccagcgacaccaggcaagcatgtcatcttcatccagaatctgaatattctcttcaaattcagtatagatggccatttcgtgagcttcgggatccagctcctgaaattctgccagcgcttcccgatcgccacacaggaccagtttcagattgaggggcaagggaggaatcgagactggcagcggccggcgttcatcctgagatgtccactcaacataaccctgctcaatacactttttcaggcgtaaccagagaatcggctgcgtcatcaggctacgcagtgaaagcagcagcgtgccgccattagcacgatggatcaggcccggttccagctggatgcgatctttatactggcgcacgcagccaaacaactgctccatctcagtccattcagcaaagtgaataccaccctgactggtgaatgggcgttgaggatcggatgggggctggagcgtgacgttgtcggccatgatatggtaatcaccgccgaatagagtggtactgtcggccataacccgctctgcggcctgggcaatgaatgtcagataatcgcgattctcctggctacgaaccagcagtaacgggaaaccctgcgtctgatggtgtaaatgcgccagtgcattcagcaaccggggctgtaccgttgccagagcatcagtttcttcatcagcaattcgggagaaaacggattggtattgcgcgctatctggctgtaaggtctgccacgtaagttgagtgctggtcaaaataatcgcatttgtctgttttaagaaaagcgagattatacaggattcacccttgttaagcactgcagacttcctgttgaagatgtgatggtgacagcatgtttttcgttgctgcatccgggaaaaaagctgttattcttagttcgttacgtgatcacgatgagattccgatgaaataccagcaactcgaaaatcttgaatgtggatggaagtggaaatacctggtgaaaaaacatcgggaaggtgaactgatcacgcgtcaccttgagttaagcgcggcgcaggcagcagtggataagctgctggcaatggaaaataatccggttacagtgaatgaatggatcgcagaacatattcacgctgatctggataaccgactgaagcagaccatccgtgcccgacgaaaacgccatttcaacgctgaacatcagcatacgcgaaaaaaatcgatagacctggagtatctggtctggcagcgactggcaggtctggcacagcggcgcggctgcacgctctctgaaacgattgttcagctgatagaagatgcagaaacgtaaagagaaatatgccactcagatgtcgagcctgaagcaggatttgcaggcgattctgggtaactccggttcagagagcaaataatcgggcagggcaatcagagcctttatccttcagtccggttttattaccggcataaaaaaaccccgccttagcggggtttttttattacgtgtaaacttaagcctgtggctgagttacaacgtctttgatacctttaacgtcgatttctacacgacggtccggcgccaggcagtcgatcagggcattacggcctttcacgctgtcacaggtgttgccggtaactgggttagattcacccatgccacgtgcagagatcttgttagaaggaatacctttagataccaggtaatctacgactgactgagcacgtttctcagacagtttctggttgtactgctctgaaccgatgcgatcggtgaagcccagtacgacaacggaaccatctttaggatccattgagctcagctggctgtacagctgatccagagcctgctggccttctggcttcagggtagatttgttgaaggtgaacagaaacgtcagacttcagagtgaaacgcttggtttcaacaactggagctggtgctggagccggagctggcgccggagcagcgacgtcatcctgaccgaagcggtatgaaacgcctacgctcagcatgccgttgtctggacgagtaccaacggtctgtgcatcaccgatgttgttaacccactggtaatccagacgggtagcccagtttttggtcagcgcatattcaacaccaacagcagccagcggagatacgccggtgtcgtggtcgctgatgcggccagtagttgagttagtctgcgttgagtctgcacgccataccatgccgcccagacgagtatacacgtccagatcgtcatagattgggtagctcagtttagcagccagctgaacgccctgtgctttgaatgcgccgttagtcacgttgcctttgttaggcatgcgacccagccagtcatagcccagctcgaagcccaggtatggatttgcctggtaaccaacgaatgcacctgcacccagctggctttcatgagttggaccgtcattgttttcgtaaccgttaccgtagtaaccagtgtcgtgatactgagaccagcccagtttagcaccggtgtaccaggtgtcatctttcggagcggcctgcgctacggtagcgaagccagccagtgccactgcaattgcgatagctgtctttttcattttgcgcctcgttatcatccaaataggcaatgagcaaaaaggttgctcttggtttaaatccttcgccgggtcaaaacgctcgcttatgactctaccgcaaaaaacggaggttattgagcaccctggcgagctaaagtctacaacgagattggaaacttacaagtatgatgtgaggcgcttatgtaaaaaaacagcgatttatacacaatttctaacaattaggctggtcttattgtcgcggcaaaaagccctaaaaacttgctaaaccattgtcaacgctcgaactaacagaatcagtggtttagctgcgacagataagaaaaatagcttgggaaacttctgatttttacttaatgaaacaaatccgactgaatttttatcgcagtttgcggtctgagaggcgcttctgatgtcccgcttgcacgcaaaatcaatcctaacgcttcaccctctgccgccgcattttcaagttgacgtcgttcatcttcgtcaagatcgtaaggaatccatgccagaaacgacactgtaatttcctgtacgcaatgctttaaccatcgcttcaaccgcattcagacgttcagaatcggcgatatgcatacttttatccagtggtaatcctgattcctgcagccaggtgcgattcagtttatatgccggtgttaaccacaactgccagcgtgattgctgactcagctgctgcaataaaggcaacagcaacatctgcatcataccgggctgttcgctgtagcgtaactcagtaattccaccgccctgagaggccggaacggaagaggacgcataatgatgagcatagcgtgaattattaggatgttgtgttcgcataagttaatcaccagcagtggactgtatgaatatacagtactgtcatcctggataaagatcaacccaaatttctgaaaacgcctcgcaaaatcgcgacaagattagttgaaacgctatttattcattgaacccgttgacgcttttttttatcttctaattacctgatacccaaggtaatttacgatatatttcttacatggaggtggtgcaatgaaaaaggtgaatccggttgtagagcgctccagagcgcgcctggccccattaggaacaatagagtcgcgcacccagttcggaggctatgccctggctgtagaaagtgtggtttttgccttaattaataaagacgaactctatctgcgtgccagtgaacctttgcgggaataccttacagatcgtccgctgcaacccctgatttttcgcaagcggggcaagctggtgagtctcaattactttcgggtcgatgaggcgttgtggcgcgaccctgaccatctgctggcgctctctgctgcctctttagaaacggcgcagctggagttgcaggaccgacaatcctcaccgcggttaaaagatctgccaaatctcagcgtacgtatggagatgatgctgtacgaggcgggcgtcatgagcgtcaatcatctctaccagatgggggctaaacagtgctggctgaagcttaaagcgatcaaccagcacgttgggttccagacgttacttgcgctgcagggggccatcacgggccaccatgccgccgcgctgccgcaggcgacacgggcggagctgaatgcgtggttccagcgcacgcttttatcaaaccccaatctcagaagcggcgaaggctaatcagtgattagcgtgcggcgcaggcgagccacatcgggcattaatgccaccagcagaccgagttgctggagcaccagcggcgcacgcgtatccgcatctgcggccagctggctgattcgctgagccagttgatggcgcatcatttctacgtgctcatcgctgacaacttccgtttgcagcacatcctccacatagcaaaccgtatcatccagcaatgtcagcagttcgggtgcggtaattttatcgcggtgagcgcccagcgcagaaatgtaactcagaaacgaatggttggagcaaagcagctgaaaagccgaatcgcgcagcttctggctggtgcgactttcactgctcatgtttgagaccactgacgccagttcagcatccgcgttatgcgcatcacgccgtgcaatgcgataggctagacggttatctttgccctgatgatattgctccatgatcgcgtccagatagcggcaattcgctttcagcgttcgttctgccacggcaggtaactgacgaaagcgccagtctggccagataaacgcgacagccagccaggccagcccacagcccagtagggtatccactacccgcggcagggcaacttcaaatccttcacccagcaggttaaagcagagcagcaccagcagagtgataaacagcgtggcctgtgcatactgcacctgcctgaaagcgaagaacaatacgcccgtgattactatcaggattaactgaccttcaatcgaaggcaccagccataaaacgggcagaccaatcgcaatccccgccagcgttccgccgatgcgcaaggccagccgtcgctgcgttgcattgtagttgggctggcagacaaacaggctggtcagcaaaatccagtatccccgctccagcccggttacctgaataaaaccatatccaatacagagcaccacagacatgcgaaccgcatgccggaacagcgccgattcgggagagaggtggcggctgaagcgcagccggatatcactccagccactcaatccttcgcgtgacagcagattgtcgctgtgatgaggatcttcaccggccagcgtctgttctgattcgatcgaagcaagctgtgcgtcgatggcgcgcaggttgcgcagcagccagaaaagagcacgggtatgcgtagcgtcgggatcatgctgctccagacgttctatcgctttctgtaatcgttcaaatgcacgctcaaaacggctgtcatgcacccacctttgacgcatcagaatgcaatgtgccagctggcgacaggcctgagcctgcatattcagcagacgctgaaagcgaaacagaatttcgttgtagcgccagtcgccgcgcagcagatgatattgcagatgggaagagctggctcgttcatgaatatcctgcgccacaaagtagtagtgcagactacggcgggtgccgcgcgacccgcgatcgccgcgcaggcgactctgcagtgtggtcttggtcagattgagctgcgccactaactggctgttgaccatcgccgcatcgataaacgcggcatcatcctgatcgcccgcgtcgggatcgaaaagattcgctttggcatcaaggtaacgcgccagttgtgaaaaactcccggccagctgttcctgcaccggccggaccggaaacatcagatggcccagtaatgtcagcaggttgtaccacagcgcgccgaccagcagcagcatcggctgcatataccactggctgaacagtccgatgccgagcatggtatagaccgcaatcagcagagcaccaaaggcgatagtcgcgtagcgctggccaagggcgcccagcagaataaagccccaggtcgagattgccagcccgataataaaggcgaacggataaggaaacagtaactcgactgaaaccgaggcgatgcagaagcagagcagggtaatcagcagattcttcaggcgaccggccaggcgatcatcgagatcggccagcgcagccgcgaccactcccagggtcagagggatcgtccactcaatctgatgcagccaccagggaatggcggcgcagccactcagtgcaaacaggatccgcagcagatagcgccacgtactgttaaacagatatttgcgccagcctggcacggcatccgacatcatattagtagcggcggacattggcttcgcgcgcggcacgcgcctcttccactgacaccacccgacggccaaccggccagagcgcgatagcggcgatcttaaagttcgcaatccctaccggaataccgatgatactgatgcactgcacaatccccacggagatgtgcgaaaggcagagccaccagccgaagaaaatcagccagaagatattcagaaaggtgccgccggtattcagaatatgactcttactttccggacgcagcacatcaacatgcaccgcctcgttgccaaacggcagcagcgagagtttggtgatttcccagcaggagcgggtcagcggcagagtaaaaatcagcacgatgctgattaacgtggcaaacagccagctcagggtggtgaaaaaaccgcccagaacaaaattaagaatatttaaaacggtgcgcatgatcttcttttccttttgcattccgcaagatgtgacgccaagtttagcctgttttaaggctggagcgctaagggtctgacaggtaaactccccctaatcctattctctgacgttggtgtcggcgtggaaactgaaagcaacctcgatgggcaaacggcttgcccagcatccttataatcgtgtccgtttgatggcggcaggcgtcgaagtcagcggcgataagcatgagtatctgatcccctttaaccagttactggatatcgcctgcaagcgcgggctggtgtggggcgagctggagtttttgctggccgatgaaaaagtggtccgcctgcatggcacggaatggcaggaaacgcagcgctttcaccactatctgctgcaggcctggcagagctggagtctggagatgagcgcagtgtgccgcgaggtgctgcaggcgctacgcgacgaaatcgaggcgtttggcgcgcaggatcgctggctgaaccgccacgagttacaggcgctgaaaaccaacatcctcaaacagttcgatgcattgccgatgccgctctcccgcttaaaagattttgctgactgccgggacaactggcaattctgtcagcgctggctggagcagggcgaaacggcgttgcggcagcgaaaccgcgactggacggccgccatgctgacccgctatcaggatttctttgccagcgtcgagagcacgccactcaatcagtcgcaatgtgaggcggtggttaatggcgagaattctctgctggtgctggcaggcgcgggcagcggtaaaacctcggtgctggtggctcgtgcaggctggttaatgcagcgcaagctggccagcgccgatcaaatcctgttactggcatttggccgccaggcggctgaagagatgaacgcacgtatccagtcgcggctctccgccgctgacatccaggcgcggactttccattctctggcgctgcatattattcgtgaaggcagtaataagcagccggttatcagcaaacttgagagtgatgccgatgcgcgtcgcacgctgctgatccagcagtggcggcagcagtgccatgagaagaaggcgcaggcaaacggctggcgtcagtggctgcgtgatgaactggagtgggagttgcccgaggggccattctgggaggacgacaggctggcaaaccggctggcgtcacggctggagcgctggcttggtctgatgcgcatgcatggcggcgcgcaggcagcgatgatcgccgacgtgcccgaagagatccgcgatctcttcagtaagtgcattaaactgatggcaccgttgctgaaagcgtggaagagcgcattaaaagaggagggcgcggtcgatttctcgggtctgattcaccaggcgattgccattctggaaaaaggacggtttatcagtccgtggaaacacattctggtggatgaattccaggatatctcgcctcagcgtgccgcgctgctgagcgcattacgccagcagaataagcgtactgcactgtttgctgttggcgatgactggcaggccatctaccgctttagtggggcggagatgacgctgacgacggcattccatcactattttggtgaaggagaccgctgcgtactggacacaacctaccgtttcaacgaccgcatcggcgacattgccaaccggtttatacaacagaatccgcagcagctggcaaaaccgctgaacagcgtcaccaaaggcaataaaaagtcgatttcgctgctggcgcaggatcagctggaagccttgctgaacaaactcagcggttacgcgaagcctgatgagcgaattctgctgctggcgcgttatcactatctgcggccggatttactggataaagccagaacccgctggccaaagctcaatctggaatttatgacgattcatgccagcaaaggtcagcaggcggattacgtcattttgctgggattacaacagggtaaagagggcttcccggcagaggcgcgcgaatcgattattgaacagggcttattaccgcagccagaagcgttccctgatgcagaagagcgccgtctggcctatgtggcactgacgcgcgcgcgtcagcaggtttttctgatgttcgataaggcagcgccgtcaccgtttgtcgatcacttccgcgagctgggtgtgccggtgctgcgtaaagcctgagttacttcagacgatcggccagatagcgctgatagtcggggatcataatctctacactttgcgcaaacagtggcgactgaatgataaagtcagccgtggagcggttagtggctaccgggatattccatacggtagccagacgcagcagcgctttgacatccggatcgtgcggcactgcgttgagtggatcccagaaaaaaatcagtgcatcgatctttccttccgaaatcagcgcacccacctgctgatcgccgcccatcgggccgctcagcatggctgtcacattcaggcccgtatcgcgattgatcagattcccggtagtgccggtagcatagaggatgtgcgattccagcgcgggctggttttgtttcacccagtcaagcagggcagctttgcagtggtcgtgggcgaccagcgcgatatgttttgtggtgccgagggtacgaacagtctgttccataaaggcgtcctggtaaggcccatgcgcaagaagagagagcatgagtgtacctctggcctttcgactctatcaactcgtacgtagcattttgaccagcgtcagaagctgctgacgcgtggcttcatcgaagcggtgaaaccagcggtgcagcgagggcagttcggcctgagtagtccagtccagatcggcggtaagccggacggaagagggcgttgcagaaggggtatttgcaaaccggggcacagaggcaatctggcgggtgcgattataattcagcatcgctttttccatatctgcggatgtggtgaccggcaggtggtcgcgcacgctggtaatctccgtgcctttttcatccaccagctgaaagttcaggctgcggtcaaaatgataacgctcgcgttttgtctccagcgcaggcaaccgaatggtgatggttttggcaaccgcggtgaacgtgacaatcatcggtaccgactgataagcgatgacgttctcattctgacctttgcgctgctgctcgacccgaaacagaaactgatgctgaccgcggtccagctccaggctgtctgcgcctttgaggagggagcctgaaatttttcgaccatccagcaccagcaaatcgatctgaggatcgagctttaatgtgatggcagaacaggacgccgaaacgaggagggtaattaaccccgttacagccagcgacagcttcatttcaactccggtaactgaagacacaaaggatggtgtgtagcaaattcttacattatggcagttaatttacatttaaacatatttattcgtgcgcgggttcaattaattttgctgaggacttacccgctaaagggcacgccaatctacactcaacactggcctgaaaggagataaacatgaacgatcagacaattcgtgaggtgctgacgcgcacccaacgtatcgccttagtcggagcaagcgatcgccccgaaacgtcccagttacggtgtgatgaaatatctgctcgaccagggatatgaggtgatcccggtcagcccgaaactggcagggaaaacgctgctggggcagcaggggtatgccagcctggcggatgtaccgggcaagattgatatggtggatgtctttcgcaattctgaagccgcgtggggcgtggcccaggaggctattgccgttggggcaaaaacattatggctgcagctgggcgtgattaatgagcaggcggcggtactggcacaggatgcgggcatgacggtgattatggatcgctgcccgaagattgaaattccgcgtctgggaataacgcgtcagaaatgatgagtgtggcggcagagcgtgccgccacagattaatgtcgcagatgaggtgcctgtaattgctgacgcaccgatgctgccagctcatccattgaaggctgctctgggtgttcaatgctggtttcgccggaaagctgaatctcagcaacgtaggtatgtacctgatcgccttcctcatcttccatcaccacatgataccagggcgcggtgcgcattttctcttccgcgccaacatcttcaattttaggctcatctaacgagtattcaggatcgacatcgacgataacgcccagtacgccggacaaacgatgacgaacctgctgaccaataccaaatttactggcaatcattgtgacctccgaaaaaaaagctctcttaccaatatgggggcaggagccgttttttcaagtcacatgacgcggcaggcgaaacctttcaggtagagaccttccggatagctggcgatcaccggatgatctgcggcctggcggaactgctcaataaactgcacttcacggcccgcatccagcgcggcatcggcgatgatcttctggaacagatcggtggccatcagaccggagcaggagaaggtcattaatacgccgcccggattcagtaactgaatggcgagcatattaatgtctttatagccgcgacaggcgcccatcaactggcttttgttttcgacgaactttggcggatccataatgatcagatcaaatttctcgccactgtcacgataacggcgcagcagtttgaaaacatcatcacgctcaaattgcgcgcgggagagatccagctcattgagttcaacgttctgacgggcaacgtccagtgcctcctgtgaggtatccacgctgatcacttctttacagccacccatcagcgcagaaaccgcgaatccgccggtgtaagagaagcagttaaggacgcgggcatcctgtgcgtaacgacgcgtggcgagacggctgtcacgctgatcaaggtaatagccggttttgtgaccgccctggatatccaccagcagcttcatgccatgttcggtaatcggcagcagcggcggtggcagttcaccggtaacggtgccctgcgtcagcgccagcccctctttcttacgaacggcgacgtcagaacggtcatagatggcgcagccagggaaacagtgctgcagggcggtgatgatcgctgcacgctgatattctgcgcctgctgagagcagctgcatcactaaaaagttgccaaagcggtcaatggtgacgcccggtaaaccatcagattcaccggcgatcaggcgatagctgtccagaccatcgcgggccgccagccattcgcgccactgctgcgcctgttcaaaccggcggacaaagaaggcgatatcgatggattcatcggcctgccagctccagacgcgggcgcggatctgcgactcgggtgaataagcggcgcgagccagccatttaccgttgctgtcacaaacgtcaatggtttcacccagttgcgctttaccttccagacgcgcaacggcacctgaaaagacccatggatggcgacggagcagggacttttcacgtccctttgcgagaatcaatctgactgtcatagtttgctatgcttacctgaaaaaatgaggcgccattgtccggtggataacgggaaattgcaacgaacagcagcaggagagaataatgtcagcagcctgttttaaagcatgggttcatggccgcgtccagggcgtcgggtttcgttacagtactcaggcagaagccaggacgctgggcgtactgggctatgcgcgaaatctggatgacggcagtgtcgaggtgctggcctggggtgaggcggagcaggtcgatgcgctgatcgcctggcttaaagcgggcgggccacgcagcgcgcgcgttgaaaaggtgctggtggagccgcaccagcccgcagagccgccccgcgattttacgaccggttaattacagacatttcgccggtttaggcaggccggcgattttcgtcgcctgtttagccggcccttcagggaacaggcggaacagatagcggctattgcctttctcttcgccatatttctgcgccatcgccttcaccagcattcgcacggcgggtgaggtgttatattccagataaaaggcgcgcacaaaatggaccacttcccagtgtgcttcagtcagggtcaggccttcctgctcagcgatgtggacagccagtgcttcactccagtcgccgggatgcttcagatagccttcggcatcgacggcgatttcgttaccgttaaaattcacgtgacatcctcttagtaaatgacggcgcagtttatcaaacctggcgggcagtaaaagcaaaaaccccgccgaagcggggttttacaggccactgtcactgcggattagttactgcgggcaaaccccagcaggctcagcaggctgacaaagatgttatagagcgaaacatagaggctgaccgtcgcccggatgtagttggtttcgccaccgtgaatgatgttgctggtttcccacaaaatcgcaccggctgaaaacagaatgaacagggcgctgatggccagatgcaatgcaggcagctgcaggaagatgttggctaccacagcaaccagcaacacaacgaaacctgccatcatcatgccgccgaggaaggacatatcacgacgggtggtcagcacgtaggccgaacagcagaagaacaccagcgccgtgccgcccagcgccagcgctatcacgtcacccatgcctgcggttaagaatgagctcaggataggccccaggcaataacccaggaagccggtaaaggcaaaagcggccagaatgcccatcgggctgttagccagacggtaggttaaaaacattaagccatagaagccaaccagcatcaggattaaacccggcgcaggcagggccagcagggtgctggcggtagccgtaacggccgagaaggccagggtcagtccgagaagaaaataggtattgcgcagaactctgtgcgtagacagcagtgaggactgcgatgaggtgacaattctttccatgttgcgctcctttaagcagaacaccaaatatgtgccgagaatacgcaggccattaaagagggaaaaggcgttttacccttctttacgcgctaaactgctaattgtttgagcagagtggcgattttgacaccgaaaaatcacaatctggctgtttttcaggcgaatagacagataggtgctttacatccctaaacggggtgtttatagtgcgcgtcattgcggaggggtggccgagcggcttaaggcagcggtcttgaaaaccgccgatgggaaaccatccgagagttcgaatctctcctcctccgccactttatctgccctgggcaataaagcggcaaaaatagatgttttgccaatgcagtacagtttcaaaacggaggggtggccgagcggcttaaggcagcggtcttgaaaaccgccgatgggaaaccatccgagagttcgaatctctcctcctccgccacattttacaggccagcacgcagtgctggcctgtttcgtttctgctctctctgttacttcttcctgtctgaaaaaagcgtgccactctctgtgacgcgtggctgcgcattcatctctccggtgcatctctgctatagtccactcaccgtttttgcaaacatctggcgcttttctgaggcgagctgagttacactgttgattacatcgctctgaggcgagctaatgggttgatagccagagtgtttctttactgaatgaatggaataggcacaatgatcaagaaactgagtctttgcgcattgtcagtgctcgctgcattgccggtcggaacggtagcatttgctgctgagggtgatatgcagctgcaacaggtgctgatgttaagtcgtcacaatctgcgtgcaccgctggctgataatggcagcgtgctggcgcagtcgaccaaaaaaagctggccgcagtgggatgttcccggcggacagctgaccacgaaaggtggtgtgctggaagtctacatgggtaactacacccgtcagtggctggcacagcagggcctggtgaagaacggcagctgtcctgacagcaataacgtctttgtttacgccaacagcctgcagcgcactgtggccaccgcccagttctttgttaatggcgccttcccgggctgtgacgtcgctgtttctcatcaggatgaaatgggctccatggatcctattttcaatccggttatcacagatggcagtgaagcattcaataagaaagcgctggctgagatggccgctgcgaatgaaaaactgtcgctgaagcctgccttccagcgcctggaaaagattgttgactacaaagcatcgcctgcctgcaacaataaaaagcagtgcgatctcagcagtggtcagaacaccttcagcgctgaaaatggtaaagaaccgaatgtcagtggcccgctgaaaacggggaattccctgatggatgcgttcacgctgcaatattacgaaggtttcccgctggatcaggttgcatggggtcagatcaaaacgcctgagcagtggaaagagctgtcagcgattaaaaatggttaccaggatgcgctgtttaccagcccggacatttcccgtgaagtggcggcaccgctggtggactacatccgcagtcagttagtggatcaggacaaagccaacgcgccaaaaattacgctgatggtaggccatgactcaaacatcgcctcgctgctgagcgcgttgcaggtcaagccttatgaactgcctgataccttcgaaaaaacgccgattggcggtcaggttgttttcgaacgctggcatgatgcgaaaaatgataaagacctgctcaaagttgagtatgtctatcagagcgccgatcagctgcgcaacgcagacgtgctgagcctgaagaacccaccgaagcgcgttacgctgcagctggcgggttgtgagaccgatgcaaacggctattgcagctgggatcagttctctcaggtgctgaatgctgcgttgcagggcacgccaatgcagccagtggcggcaccacaaccggcagcccagtctgacgacgacagtgcgaaagccgcagcgaccaatgacgctgctgctgataaggctgaagcggataaagcgaccgcggcgaaagagaaggctgacgccgataaagctgccgctgagaagtctgaagcggataaagccgccgctgaaaaagcaaaagcggacaaggcagcagccgataaagctgcagccgagaaggcaaaagcggacaaggcagcagcggataaagccgccgctgagaaagcgaaagcggacaacgcggaagcgaaatcagccagtgccgataaaggtgcggctgaccaggctaacgcctcgaacacgcctgcaacagcgcacaacgacgaatcaaagtcagcggctgtggcaacacagtaatcgtgctctccggctgataataaaaaaccccgtcgagacggggtttttttatggctgcaaggcgattaacccgccacgaccaccagtttctggttagcaaactctttgatgcccaggtcagacagctcacggccataacctgaacgtttcacgccaccaaagggcagctccgctgaggtgtcgctctgggagttgataaacaccatgccggtttcaatggcggaggccagtttacgaccgcgtgcaatatcgcgtgtccagaccgagccgcccagaccatagtgagagtcgttcgccagcgccacagccgcctgatcgtcacctatgacataaacctgcgcgaccggaccgaagaactcctgataataggcgggattatccggggtaatgccagtgagaatggttggctgataatagcaacctgcaccttcgacggctttgccgcccgtaaccagttttgcgccattggcgacggcttcgtctacctgttttaccaggcggtcacgcgcgtcagcggaagagagcgggccaagcgtagtcttctcatccagcggatcgcccagcgtagcggaactcagagcagcgctgaactggctgataaagcgatcggcaatcttctcatgcagaataaaacgttttgcggcggtacagacctggccgcagttgctgaggcgagcctgcacgccctgacgtaccgcttcgtcgagatcggcatcatccagcaccacaaacacgtcattgccacccagctccagcgtcgatttcttaagatgcttaccggcctgctcagccacggcgctgcccgcgcgctcggatccggtcagggcgacaccctgtacgcggtcgtcagcaatcagatcggcgacctgatcggtggagatgaacaggttagtccaggccccttcaggtgcacccgcttcacgaaccagcttctcaaagacatcggcacagtgcggcacgatattggcatgttttgccagcaccgggttacccagcgccagattaggtgccagcacgcgcatcagctgatagtaagggaagttccacggctcgacggcgactaaaacgccaatcgggtgatactcaacccaggcttcgcccagatcgctgggataggactgcggctgcagaatacgttccgcattctctgcgtagtagcgggcaatctgcgagcagattttcacttctccgcggctctgaccaatcagtttacccatctctttactggcgatggtggccagttcttccgcgcggctatcaatcaggtcagccagttttttcaatacctgcagacgcggctgaatatcacctttgctccatgaagaatggaaaaggcgatcggccacttcgagggcatggctgacggcggcttcatcgtgtgacggccagcttttcagcaactggttgtttgcgggattaatgctttgataggaagacatagcgtactccttggtgagctaaaaattgagggcgggaaagtcccgcccctgaatcatacgttcttacgtttctacgggcttgtcatcccaggtcaggagatctttatcggttttttcaaaggcgcgaatcagcacgtcatcactgccttgctgacgccagatctcttctgccagtttttcatcgtagttagccacttcgaaaatggcctcggcaatttcaggggaggtatgacgcagacttgcccattcgccaacgtgatgtgctttcgattgttcagtagacatacttttctcctttgattaaatcagtcctgcagtttgacggtcagtccggcaacatgttcgccctgaaaacgggcgatattcagttccgcttcggtaggctgacgcgaaccatcgccgcccgccagggtggtggctccataaggcgttccaccgcgaacctgtgaaatatcgaacaactctttggttccgtagccgattggcacaatcaccatgccgtgatgcgccagggtggtccagacagacgtgatggtctgttcctgaccgccgccggtgccggttgaggtaaagacgctggcaaccttgccaaacagcgcgcctgacgcccagagtccgccggtgcgatcccagaatgtccgcatctgtccggccatgttgccgaagcgggtcggagtaccgacgataatcgcgtcatagtgcggcagcacctcaggcgtggcttctgccgcctgctgatcggttttgccacccacctgggcaaagcgatcggcctccatcgtttctggtacccgcaggatatccacttccgcgccgtgaacccgacgagcgccttctgcaaccgcgttcgccattgtttcgatatgtccgtacatcgaatagtagagcaccagaatcttagccattgatctctccagatggttttgacgtccagaaaaagtatagaagagctttcgttttacgcaggcgatgccgaagccggaacggaggagtcgggcaataaatcagcagctaatcggttgtaagtcggcagagtgttcgttgtttagccaaatttctggtgattactctgttgctaaatgtgactggcggacgagtgaaaggataatctggctattatttaaacatgggctgagctcgcgtttcgggccgtcagccctctgtttttaattcttaattatcgcactacgcgacaggagcaaatgatgacaacacatcgtgggggttctggaaattttgctgaaaaccgtgaacgtgccgcagaagcgggacgtaaagggggaaaaaacagcggcggtaattttaaaaacgatccgcagcgcgccgcgcgtgccggggagaaagggggacgcagcagtcctaaaaaaccggacgcataaccccacactgccgccggttgagaccggcggttaacgtcgttgcttttccccctcgctctccccacaatattgtccggacacattatcaggtgaattatgtcggacacactccgcggtttaaccctgcgcctgacgcggcaggagctggtattacttttcataaccatgatctggggcggcacctttctggtggtgcatcgtgcgatgcagcactccggcccgttcttctttgtcggcctgcgttttgccaccgccgcgctgctgctggcgctctttttccgccgctatctggcaggcatgacctggctggaggtgaaagcgggtgcgctgattggcctgtcgatcgccgggggctatggtcttcagacgtggggaatgcagaccatctccagcagtcagtccgcctttctcaccgcactctatgtccctgtcgtgccgttgctgcaatggctgtttctgcgccgtccgccgggattgatgtcgtggctggggattgtactggcgtttaccggcctgttgctggtggccgggccgcaggatggtcgcatcactctgaatgcgggtgaaatagcgacgctgatcagtaccctggcgatagctgccgagatcatcttaatcagccgctatgccggtaaggtcgatgtgcgccgtgtgaccctgatccagctggcggtggcgtcgctgtgcgcctttggtctgatgatccccaatggggaaacggtgcctgccatctcaacgccgctgctgctcagcgcgctggggctgggtgcggccagcgccctgattcaggtcaccatgaactgggcgcaacgcagcgtttcgccgacccgcgctacggtgatttatgccggggaaccagtctgggccggcgtcgtggggcgtattgcgggtgagcgcctgcctgcgctggcgttgctgggcggcgcgctgatcgtctgcggggtgatcgtcagtgagctgcggctgaaacgaaaaaaagcggtgcagcctgctgccacaccgctggagtaggtcgttaaccctgctgtcgcgccagtggcttgtcctgctttgccgcactgcgtcggcgcagaatcgcattgaggataatcgcgccaaaggtggcggtaccgataccccccagcgtgaaagaaccgattttcagcgcgaaatcaccggcaccgagcaccagtgtggtcgccaccatgatcaggttactgttctggcctaaatcaacatggttctgtacccagatgcgggcacccgctaccgcaatcagcccgaacaccacaatggatgcgccgccaatcaccggtgccggaatagtgtggatcagcgcaccaaacttcggcgagaaaccggcgaggatggcgatgaccgccgcggcgacaaatgccagcgtagagtagactttggtcaccgccatcaccccgatattttcggcataggtggtgacgccactgccgccgatcgagccggagagcatggtggccaggccatcgccaacaaaagcgcgtcccatgtaaggatcgagattgcgtccggtcatgcccgccaccgctttcagatgcccgaggttttcagccaccagaatgatcgccaccggggcgataagcaccatcgcctgcagatcaaaggtgggagcggtggtgtgcggcagaccaaaccaggcggcctgtgacagcagggtaaaatcgaccggcttacccagccccagaccgttggtcagcagtgcatagatcgcccaggccagaatcaggccgaccagaatcagcagtcgctgaatcatcccgtgggtaaataccgctaccagaccaatgcagagtacggtcatcaccgcaacccagctgtcgaatgacgaggcggagacgctgtgaaccgcaatcggggccagattcagcccgatagccatcaccaccgcaccggtcacgaccggcggcatcagattttcaatccagcgcgtgccggacttcatcaccaccagaccaatcagcgtgtagagcaggccgcaggcgatcacgccgcctagcgccacgctgagattgggattcagcccctgaccactgaagccggttaccgcaatgaccacgccgacaaaggcagcgctcgacccgagataactgggcacccgaccgccggtgataaagaagaacagcagcgtgcctatacccgagaccagaatggccagattgggatccagccccatcagcagggggcatcagcaccgttgcgccaaacatcgctaccgcatgctgtaaacccagcaccagcgtctgccccagaggcagggtctcatccggggcgataataccgttttctgttaatgccgacttcttttgccattgcggaaaccaggatcgtgccatcgtctactccagagcgttatgaatgccggtgggattcagggaagcgttaacaggcatcctgccgcaacaggggatggtatccccggtcaaaccacgccagaccgtgggtgtcatcattgcgcactaaccccacgacttcgcagaacagcgtgtcatgcgtaccgacgctgacaatctgagtaatgcgacagtcaaaggacgcgacggcgccgctcagcaccggcgagccggtcacggccgttgaccactcagcggcaataaaccgatcagccattggcgttttgccgccgaacagattggagagcgtttcatggcccgccgccagcgtattgacgcagagctgcatgttttcgcggaacaccgggtaaaccgaggcagagcggttaagacagaccagcagcgtcggcggcgaatccgtgacgctgcacaccgccgaggccgtaaagcctgcgcgtccggccgggccttcagtggtgatgatgttgaccgcagcacccagccgcgacatcgcattacgaaactcagttttttcaacggcaggggtaagggtatccaggctcatcgtgttctccgcgaaaaggttatccgacgacgcgctgcagcggctgcacgtcatcagtctgatccagccactgcagcagcagggcattaaagttttcgggggcggtgacgctcatggcgtggccgccccaggccatcatctgttcagtcgcattgggcagggccgcggccagctcagtggagcagctccatggcaccagcagatcgtcctggctggcgatcaccagcaccggttgtggaatggcagcagcccgcgcgctgaagtcggcgctcatcagggcgtgcagccgccgcatcagattttccatcccctgaaaatgtgcgacgtgatggctatcttcctgatccagccgtgtctgatgctgtgccatccactccgcaggatagagaaacagcggctgagcgcggacaaatgcctcgacgccgacgttgagcagcaggtcctgacgcacctgaaagcagcgacgggtatggggatgcagcgtcagccagccattgatcaccgcgatccgttcgatccgatccggataatccagcgccagctgcatccccatcagaccgcccagcgcgtgcccgatcaggctgaagcgcaggatgccgtgctgcgccagcgcggcggccagttctgacgccatcatcgccatgctgtagccttccggcaggctgtcagcgctgcgaccggtgccgcgctggtcataggtcaccacccgatagcgtgccgttagcgcggccagctgcggctgccagaaacccgccacgccgcccagaccggatgagagcaccagtgtcggtgcatcgggattttgcagacccagaatatccagctgcatcagacctccgctttgccgatgtgcgccacgctggcgatctcaatcagcgcatcaggcttgaccagaccgcactgaatacagaagcgcgccggtttttcgccgggaaagaactcggcataaacctgattcaccgcggcgtagttcgaccagtcggtgataaaaatcgaattaaacgtcacatcggtcatgctgccaccggcggtctcaatcacctttttaatggtttccagcacgtggcgggtctgcgctgcggcatcacccacatgcaccacgttgttgtcagcatcaaacggcagcgtacccgagacatagaccacaccatccgccagcgtgccgggaacgaaacggggcgatgggggtggtggtgcctggcggaacaataatacttttcggcatagcgtcgtccttatcgtggattagcgggcattcaggctttcgcagaaggtatcgacatccgatacccagccaaaaaaggtttcgatattgaacagagcagcctgctgagcaaagggcgggccggcctgataagtggcgtcttccagcaccacgccgaagtactccagaaagaagccgtcgcgcagcgtcgattcaacgcagacgttggtggcgatgccggtaaacatcagatgacggatcccgcggctgcgcagcatgctgtcgagcggggtgttatagaagccgctgtaacgcgatttcggcagcacgatgtcaccgggctgtggcaccagttcatcgaccagcgcgtaatcccagccgccttttgacagcagcgacccctgcagttcaggccgtttacgcatggttttcagggcattcgatttgtggaaattgggggaaccggcgtcgcccgcttctacatagtcactgtcccagccgttctggaaccagatgatctgaacgcctgccgcacgggccgccgtcaccgcctgatggattttcgcaatcaccggcttggtggcggaaacatcgaagcccgccagatcgagatagccgccttcagtggcgtaggcgttctgcatatccacgacaatcagcgcggtctggccaggcggaaaggcgatcggctctggccgcgccggcagttcaacctggggaacatccggcgtgtgagcacaataaacggtagccatcatgccacctcctgctgtgcgtcgagcagggcgctgcgacaggccatcagaggctgaatgtgctgcccgaagttctcgataccctgcaggaagtcatcaaacgtcagcagcacgccgtgggtgccttcgacctgcgcaacctcatccagcatccgcgccacgctggcatacgaccccaccagggtgcccatattgatattgactgccgaggtcggatccgccatctggcgcacattggtgtcgctgcccgatttggtgtcctgctgactctgagtggtgagccaggagagcgcctcttcatccgcaccggctttgtagtgttcccacttcgcccgcgcttcttcgtccgtttcagcagcgatgatcataaacagcacataggagccgacatcgcggcccgctttttcagcggcctgcttcatgcgaatcgaggtagagctgaacgcggcaggcgtgttaacacctttaccaaagcagaagttgtaatcggcgtgctgagcagagaaggccataccggcatcgctctgtccggcgcagatcaccttcatcgggcgctgcggctgcggactcacccggcagtcgttcatggtgaagaactcacctttaaagtccgattttccggtgccccacaggtcgcgcagcacggtaacgtattcggtcagataagcgtagcggctgctgaagtactcatcgccaggccacattcccatctgttcatattccggtttctgccagccggtcaccaggttgacgccaaagcgaccgcctgaaatggaatcgatggtggaggccatgcgcgccacaatcgccggaggcagcgtcagggtggcggcggtggcgtagatctcaatgcgtgatgtcacggcggccaggcctgccatcagggtgaacgactcgagattatgatcccagaactcggtttttccgccgaagccgcgcagtttgatcatcgagagcgcaaaatcgaaatggtaatgctctgctttcagcacgatcgctttgttcagttcaaaggtcggcatgtactgcggcgcattggacgaaatcagccagccattgttaccaatcggaataaagacgcctatcttcatgtgaaacctcgttgcgatgggggaaaggtgtttcacgcgctgcgctgcatcctgcatcgtccgtgtgggccgcgctcagtcacaattctgcaaactgtgtgccactttttttattgttttaaataacagtgagttaaaatcaacccgaaagaggtaagtggagtaactggtccatttcagaccgtctggtcaaaattcgctgcacgttttccatgcaggctgagcaaaaaaggtgcagagcgcggattgggcagcgatgaatccctttgctatgatgcgctgacaccagaaggatgaggtaaacgtgtgaataccgatgaaaaaaagccaacgcgacgttcgcgtgcggtcgcagcgaagcgggccgccatactggaagcggcattaaccttcttctcacagtttggcattcacggcaccagcctcgataaggtggccgagctggccgatgtctctaaaaccaatctgctctactattttccctctaaagaagtgctctatgtggcagtgcttaagcagattctggatgtctggctggcaccgttgcgcgcgctggcgcacgatcaggatccactggtcgcgattcggcgctacatccggctgaagctggaagtgtcgcgcgatcatcctcaggcttcccggctcttctgtctggagatgttgcagggtgctccgcttctgaaaggggagctggcaggcgatcttaagcagctggtggatgacaaagcggcaattattgaacgctggattgatgaaggacgactggcaggcgtacagccgcagcatctgatctttatgctgtgggccaccacgcagcattacgccgattttggcactcaggttgaggccgttaccggccagacgctcagcgatccggcgtttttcgatcaggctgttgataacgtgcagcgcatgatcatcgaagggattcgcgtacgctaattcaggatacatccacggttcaggtacggagttaatcaatggattctgtttcgcaactggtgctgggtgcctcagtcagtgtcgcagtgatgggacgtcgggtgccggtctggcaggccgcgctggtgggcggcgtctgcggcaccttacccgatctcgatgtctttcttgatcatggcgatgcgatacgcaacatgaccctgcatcgcacggaaacgcatgcgctgctctggctcacgctgctctcgccactgattgcatggctggtggcgggtctgtttcgccagcgggtgaagtgggcagcatggtggcctgccatctggctggcgctgattacccatccgctgctcgatttgatgacggtgtatggcacccagcttggcctgccgatcaccgattatccttatgccatcggcagtatctacatcgtcgatccactctataccctgccgctgctggcaggcctgggcgtcgcgctctggcggcgcagtgataaagggctgcgcggaaaccggctcgggctgatgctgagtaccctttatctggtctggagtgtggtgattcagggcgtcgcaggctggcagatcagagcgtcgctggcggagcagggtattccggacaataaagtgctggtgacgcccacggcctttaatacgctggtatggcgcagcgtgattatgacgccggatcgctatggcgaagtttactggtcgctgttgtcgccctcacggccactgcaggtggcgtggtatccgcgtcatcctgaactgttcgacgcttttcggggcagctggtatgcagaacgtgtcgcctggttcagccacggcttctacgcgctgcgggagcaggacgggcagacgacgattgccgacctgcgcatgggcgaaggcgataagtataccttcacctttggtctgggcacgcctcagcagcccgatccccggccgcagcgcttaccttatgaacgcccctctttatccgccattttctctgcgctgggcgatcgcctgtaaaaaaaagcccggtcatctgaccgggctttgttcatgatattaccgattagcggctacgacgattacgcagcatccagccgacacccagcagggcaaaccagagtggcgtaaccatcagcgcctggcgcgtatcttcctgcagcgtcagcagcaccagcacaaatgcgaagaatgccatgcagacccagcacatgaatttgcccagcggcatcttaaatgccgactccgcatggcgctgcggatgctttttacggtaggccagatagctgcacagaatgatggtccagacgaacataaacagaatggccgagacggtggtcaccagcgtgaagaccttcattacatccgggatcaggtagatcaacgccacaccaatcagcaggcacaggcaggagaaaaacaggccggtagtcggcaccgcacgggcagagagtcggccaaaggcgcggctggccacaccctgctgcgacaggccatagagcatacggctggtggagaagatgccgctgttggctgaggaggcggcagaagtcagcaccacaaagttaacgatactcgcagccgcaggcagaccaatcagaacgaacatctcaacaaacggactgcgatcggccatcacctgggtccagggcgttaccgccataatcaccatcagcgccagcacgtaaaacataatgacccgcaacggaatcgcattaatcgcgcgcggtaacactttatgcggattgtgggtttcagccgctgccgtgcccaccagttcaatgccgacaaaggcaaacaccgcaatctggaagccggcaaagaagccgctgaggcctttcgggaacatgccgccgtgatcccagatgttgctgagtgacgctgtgccgccgcccggtgaggggtagtgaatcgataccagcacaatcccggttacgatcagtgccacaatggcgacgattttaatgatcgcaaaccagaactccatctcgccaaacagcttgacggtggcaatattgagcgccagaaaaaccaccacgcaaagcagggcgctcatccagatcgagaagcccggaaaccagagctggaaataggcgctgattgccaccacgtcggcaatgccggttaccacccaacagaaccagtaggtccagccggtaaagtagcccgcccacgggccaagcagatccgcggcaaaatcgctaaaggatttgtactcaaggttggagagcagtagctcccccatggcgcgcatcacaaagaacagcataaaaccgatgatcatatagacaaaaatgatcgaggggccagccaggctgatggttttacctgagcccataaacaggccggtaccgatagcgccaccaatggcgatcagctggatgtgacgattgtgcagattgcgctggagtttatcgggcgtttcgtgggtgcttgcggtttctttagattgatcaaccatagaattgtctttcctgtcgtgatgttgtgttcagctctgctggctgttagtcaaggcgtctgcctgagggcaagtcggcataagatagaggaagagagccggaatcgggtaacgcttttttaccaattgtgatgcctgccgtcccggaagcggcaataaagcgcgattttgttcaaaccttcgtcagcctgggtaattattcatcacgttatgtcagtcaggcggcgtgaagggcgatgcgcttctacactttttgtttgctaatcatcatgctgcgagagggactatgcgcacgcttatcctgtttttgctattgcttgcgctgggatgggtcagcttaccctggcttaagcagcatctgccgccgcagtttaatccctttacgccactctctgttaccgatccgccgggctggatgacgcagattaagatgaaaaggctggccagcgatcctgacgcatgtctggcggtgatgcgccgcgctcaacaggcgggctgggtcagcttcagcgagcgtccggacgtcacgggtcactgtccgctcagtcatccgctgcgggttcagaaatttggcccggtcagcctcagcagcagctttctggccagctgtcctatggccgtcgccagcaccatgtatgctctgcgcagtcgtgaaacagaccgccagagagatgcacagtccactggtacgaattacgcatgtcggcagttacgcctgccgtaatatttatcatcgtgcccaggggcggctcagtgaacatgccaccgccgatgcctgggatgtgacaggctttcagctggctgatggtcagcggcttgaggtcagtcgtcactggcaacagccggaagaaaaagcggcaatgcttcatacgctgtggcgtggcggctgtgaggtattcggcaatgcgctggggccggactataacgccgctcacgcctcacattttcatctgggtatgcgaggtgcaggctactgccgataaatcatcagacaggattaataccgtgtttgattaagaaatgttcttatggtgccagtaaaacccatccagttatcattgcggaacctgatcccttactgaaatagtctgacaacaggtcaggatgcgcataaaaaagccgatttcagggccatctgtaagaataaaacgatgcctgcgggataaaacccttgtgcagattctcagcctcatttgctcagcgcctgctggtggcatgatgaaattatttcacggttgcgctggcagaaataagggaaaggtatcgcataaataaagcgtgcgtgattgagaaaagaatggatttttcctgcaaatttattttcatatgatttagttgcgtgactatcgggaaagtgatttaactgattaaaatagagtcagtgttgagcattacgccataaatagtgatctccgccacgtattgcggtcagtcagcagagtaagtaaaggagacttttacgaacgtgctgtcctggatcaggtatttgcagtcagataagtcgataaaccacagcaggatgtgaatcgacgggcacagagcatggtcgggtagaggagaccagaaaaggtttattaaacagcacatcgttacgcttacagggctgccacggaaaaccgggacaggtctttcaccggcaagcgcgtggcgcgggcagcaagccggttagctgcctcaacagacgccacaggggctgcggggacttctgacgaaaccggtcctgatgctgcaaagagagagccgggcttatttcctgataaaaaatatgtcagaaatttgtcactgccgcttcgcttataacggagtaattaacgccttgtttactcgttatttacccaacaatcagcatcgcgattcaatattttcagcagacgtttcgggtctgagataaaattgcactggaggtcagggattgaaatcctatcagaaaaatcttattctcctggggtgattgaaattgctgtgatcggcctcaccttgtaaaggcaggaacactttttcactccgctccaacggtgaaaggttaaatgcgctgtagatcgcgacagattcgtcctgaaagataaattaattttcttctgcaaatttattttatccgatgaatctgaatgaatattaccggaagggcgagtgaaattaacgctgaggcaatatgagtactgaaaattatttcgcctggcgagctgaggcgaaagaaaaatttcaggcattaacggtttcttctgaattgaagccgttattgcaacaatttattgaatcattaggcttcgattattttgcctttttgattcagcacccggtgccttttacccgaccgcgcattcatttacatagcacctatcccagattatgggttaaacgctatgagaagcagaattattacgctgtcgatccggtgctcaggttgtgtcagcgaccgggcagaggcatggcgtggacggaggaaactgttcgctgacgccggcaatttgtggcatgaggcgagagaatatgggctgcagagcggattttcttgctctgcaatggcaccaaatcgcgtcattggtatattatctatatcgtcgcaacagcccatttctgtccagctctgccatgctgagctggaggtgaaactacaccttttagcggaactaagtctggatacgctggaacgctttagcgatgatgcaatgatggtactaaaaaaagagtttagtcagcgcgagctggaaattttgaaatggacagccgaaggaaaaacggcggtcgaaatttcacttattttatccatctctgaacataccgttaactttcaccaaaaaaatatgcaaaagcgtttcaatgtttccaataaaacgcagattgcctgctatgcagcggcaatcggactgatctgaacataaagcaacggctacatttcgccgttactttgcacaggtctgttgtctaccctgcgccgggactttgccaggctggcgcaaagaaatcattgcaaacatggggatgtcagaggcgcatgatgaaaatagtgcaaacgcaattaaaggatatgccatcctctttgcttgccgaactcggcagctaccgatacagcgtctttgcgcgcggcgaagggtggtcaattccgccacgcctgagcacgccaggacaggaatatgatcgctatgatcgttcagatgtcacctggctgatcgcatggaatgcgcgggagggcatcagcggctgtgcgcgtctgatgccctggttcgaacctgaactgagtgaaggcatcgtactgcctttcagccatgagaaagtgtgggaaatgtcgcgcttctcggcacggctggatgtggacgctgaactgccactgaatattctctggcacgccgtgcagctggcagaattgaacggtatggaatacatcatcagttcggcaacgccgatgctggagaagatgtttgaagagcatcaggtggtgtatgagccgctgacgccgggacttattctgtcagaagataatctgtttgcgatccgtattccggtggttcagccagcgctggctgaaaagtatcggggaaacgcggcgctttagtccggaagaggtgctgcctacgctgggcgtttcggttaactggcaggcgcacagttaattaatttgcccccgcggctgtgggggcaagcaagcttactgacggtaggctgttttgatctgcttaatggtattgctgaatacttccgcctgaggcttgtcgcccagcgtctgtacatagcgttccatgttgataatcactttgccggcatcagcctggcccatacctttcaggatcagggtgatcatcatcttcagacccgcgatttcatccgctaatttccgggcttcctgcgaagttgcaaaatcttcatcgctcatgcgtttctccttggtgaatgacaatgtgtcggcaatctgtccgaacagcagtgcgtgagtatatcacagggtcagtaagttgctggagcagccggttcgcttcgctataaacagctggtttgtccagtacaactaatcaatcgctgaaagtaattacaggtgttgccgggccagatatcacaagggcctgcagcgataaggcacagcaaagtctggtgttaataccatgaaatagtaagagtttaaggattattcagtacgcctgtcggttgtaagaaatctctgttattgctggctgcacggggctggaaatcgttatgcgaagcgtcgactgttttgctttgttgatgtgcttttgaggtaaaagcgggtatgattatcgcctgtattcgttaattgattcctctttttttagcctctggagtttccccgttgatcagtgtgcttcttgttgatgaccatgaacttgtccgtgccggaatccgtcgcatcctggaggatgtcaaaggtctggccgtggtcggagaggtcaactgtggcgaggatgccgctaagtggtgccgtgccaatcaggttgatgtgatcctcatggatatgaacatgccgggcatcggtggactggaggcgacgcggaaaatcgtgcgttacaatcccgatatcaaaatcatcatgctgaccattcacacggaaaatccgctgcctgcgaaagtgatgcaggcgggggctgcaggctacctcagtaaaggggctgcgccgcaggaggtgatcaatgcgattcgctcggtcaatgccggacagcgctacatcgcttcagatatcgctcagcagatggcgctgagccagattgagccacaaaaagcggaatcccccttcagctgtttgtcggaaagggaattgcagattatgctgatgatcacccgtggacaaaaggtgacggaaatttccgagcagttaaatctcagtcctaaaaccgttaacagttaccgctaccggatgttcagcaagctgaatatcagtggcgatgtagagttaacgcatctggccattcgacatggcctctataatgcggagccgttaatcagtagtgaatgacgtttttgattccaaagcctttctgagtacggtaaccagcaagcccggtgtttaccgcatgtatgacgcctcaggcaccgtcatctatgtgggcaaagccaaagacctgaagaagcgtttgaccagctacttccgcactcaggtcggcagccgcaaaaccgaagcgttggttagtaatatccagcacatcgatgtcaccgtaacccacaccgaaaccgaagcgctgctgcttgagcataactacatcaagctctaccagccgcgctacaacgtgctgctgcgcgacgataaatcttacccctacatctttcttagcagcgatacccatccgcgactggcgatgcaccgtggtgcaaagcatgccaaaggcgaatactttggcccgttccccaacggctatgcggtgcgtgaaacgctggggctgctgcaaaaagttttccctatccgccagtgcgaaaacagcgtctaccgcaatcgctcccggccctgtctgcaatatcagattggccgctgtctgggtccctgtgtcgcgggactggtcagtgaggaggagtatgcacagcagaccgattacgtgcgcttgttcctggcgggtaaagacgatcaggttcttaaccagctggtcaaacggatggaagaggcgagcacgggcctgcgctttgaagaggcggcacgcctgcgcgatcagattcaggctgtgcgacggatcaccgaaaagcagtttgtctcgaatcagggtgatgaccttgatgtgatgggtgtggcttatgaagcgggcatggcctgtctccacgtgctgtttatccgtcagggcaaagtgttaggcagccgcagctacttcccgaaagtgcccgtcgataccgatctggctgaggtcgttcagacctttgtcgggcagttctacctgcagggcagcgaggcacgtacgctgcctggcgatattttgctggacttcaccttgccagagcgtgaactgctggctgagtcgctcagtgagctggccggacgtcgggtgagtattcagagcaagccgcgcggggatcgcgcccgttatctcaaactggcgcgcaccaacgccgcgacggcgttaaccacgcggctgtcacagcactccacaattcatcagcggctgatggcgctggcggagtttcttgagctggacaaaattaaacgcatggagtgtttcgatatcagtcataccatgggtgagcagaccatcgcctcctgcgtagtgttcgaccagaatggtccgctgcgtgccgattatcgtcgctacaacatcagcggcattacgccgggtgatgactacgccgccatgaatcaggtgctacgccgccgttatggtaaagccattgaagaagataagatcccggatgtgattctgatcgatggcggtaaaggccagctgtctcaggcgaagcaggtcttcgcggaactggatgtgccctgggacaaaagccggccgattttactcggcgtagcgaaaggcagcgatcgtaaagccggactggagacgctgttctttgaagcggaaggtgagggcgtttcgctgccacccgatgcgccagcgctgcatgtgatccagcatattcgtgatgacgctcacaatcatgccatttcaggccaccgtaaaaaacgggccaaagtaaagaacaccagcgcactggaaagcatcgaaggggtggggccgaaacggcgtcagcaactgcttaagtacatggggggcctgcaaccgctgatgaacgcgtcggtggaggagatcgccaatgtacccggtatctcacatgctctggcagaaaaaatatactactcgttgaaacactagcattgaaacggggggggcaatgtaggaacataggctaaattctacctatatccagacagttaccggcatatgcaattaaacattccgacgtgtctcaccctgtttcgagtcgtgctcatcccgtttctttgtgctggctttctatctgccgttcacctgggcgccgctggcgactgcactgatttttgtttttgctgccatcaccgactggtttgatggctttctggcgcgccgctggaagcagacgacacgctttggtgcgtttctcgatccggtagcggataaagtgatggtggccattgcgctggtgctggtggcggaatatttccacgcctggtggattacgctgcccgccgccaccatgattgctcgcgagatcattatctctgcgctgcgtgaatggatggcggagattggtaaacgcagcagcgtgtcggtttcctggattggtaaagtgaaaaccactgcccagatgttctcactgtttgccttgctgtggcgtcctgatgcgaccgtcgtggcgattggtgtggtggcgttatacattgctgccgtgctgactttctggtctatgttccagtatttaagcgccgcgcgcggcgatctgctcgaaccgtgatcgatacgatttaaaaagcagcaaacggacgcgctgtgaggataattttattgactcattgcgtcatctaagtagaatgcatcgcatcgaacggcagccaggctgccataagataaataaaatcagcaggttcgacgaaattgctgaattgcgggaatagctcagttggtagagcacgaccttgccaaggtcggggtcgcgagttcgagtctcgtttcccgctccagattcgcaggtcaggttaacctgacggcacatcagtttaaggcgcgttggcagagtggctatgcagcggattgcaaatccgtgtacctcggttcgactccgggacgcgcctccagttacaccctgcccgggtggtgaaatcggtagacacaagggatttaaaatccctcggctgtaaggctgtgcgggttcaagtcccgccccgggcaccatatttctgccgaagaaaatctaataaaataaaagcaatatgcagtaatgtcgtaaccgcccaagggcggtttttttgtgcctgctatctggcggatatggcgactgcaacctccgtttagcggtataagccggcatcagccccgggagctgaataccagctcatcatcagtgtcactcaccagcaccatccgttgcgcctcaccactggaagagacaaaggtcacttcatggccgatgctgatatcatcaaaggcgtcggtcggctgtgactgcttccggatctccagtaccatccgcgaggggtagggtttatcattaaccgtatcaatatgataattggcggtaaaattcagttcgggttgatcaaccacgtaaaattgtcctgacggcatagtcttgacctctgcaaaatgttggccataagtcccggtcggaacaggctgcctgaaacttaaggttagctgaataatcaatgcctacaggcagcagcacctcttttttgatttcatacgacggttgcaaaaatacctgccgcttgcgcttgcctggtcagaaagtcgtactacgcttcttgttcacatagcgcggcttttccaggcacgccattcgggcatggtataaaggtattactgcaactcttaacgggttgacgatgcgggttcaactcctgctgcccggtccctctcctgcatttacgttcatctacgttaacgccagccttatcccttttgggtttctgccgatctatcccaattacatccgatttcactcatttttgcggcctgtgtcgaactctgtaacctgttgaaacgttgtggtttaccgtattgtggtggctattgtttgccgtcgcagagaattaatgccaatgattacacctttcacacctgacttaactgaaccggcggcccccccggttatcggtgttgtcgccagccagttgctcaatccgtatcaacaaaaaatgctggacgaagtgatgcgccagcttaacgcgcgcggtcttatctcggtgctactgagtgccgaaaccgacgtcacactgaccgcactcatccggcaggctacaccactcgggctgcgtggtttgctgttactccccggtaaccgcgttactgatgcctgcaatttgccagtgcttcagattgacgctgagcctgaactgcaggcggatgcactgcgggcgggtgaggtgacagcggaattattgcttaaacaggggcatcagcggtttggctttatgcaggctcagccaggcgaaactggcgcaaaaacagggctatcgcgcctctctgctggcggcgggcatggcgctgaacgccgaactgactgtggggagtgatgatcgtgactgcgcttatcaggcgatgatgtcttacctgaaaaagacacgtgctgctgagcgtatccaggcactcttctgtgaaagcgatctgatggcctttggtgcaatgcaggcgattcgggattttggtcagggtatccatctggcagtggcaggttttggcgatagtgaagaagcccgcagctcaacctggcatcttaccagctggtcacctgacatccggaagatcgctggtcgcgcgctggatcgctggctgggacagcaggcaggcaacagcagtgctgaagagcaggagcaattacagcggcgtcactctcacgcaggcaaagtgctgccgggtgagatgtcagcctgcggctgcgccttccggcattaaccagcccgcaacgcaggctggcagaataatgtcaggcctgcggttgtcctgccgggccgctgccgccgggtgcgcccaccggctgctgcccgccaggtggtggcggggcatctctgcccggttgcggcggtgcacaggccgtaagcgtggcgaggatagccagtgtggataacagataagcagtacgtttcatcgtaattccccgatcaggtaagcggaacgttgagtatagagaattgcaacaaaaccgcccggacagggctaaatcatcaatacgcatggcaaattgtcgacgattatttgagacgcctcgcaactcgcgcatgctggcaatgcgtttcaggccggagcgcgctaaggtagcgcttcatttaagaggagtcgttatgaatggcatgatgaagttcgtccgcgggtggctggtgttctctgtactgtggggcgtattcatgtggtttatgtcatggcatcagcagggcaaagagcctggtctggcgattctgacaagtctctacgccggtttaatctaccaggcgctgattacgatggttggacgctaccgcgcgcggcggcaacaggctgagtgagttctgctgccggagaggcagcagaactgggtttttagccgaaattaccggtcaggcgctgatggaagtccgtgctgcgtggatccagcccctcaatggtcacctctgcaccataacgctgatagcgatactcaatgccgtccagcgccgcgacgctggacgcatcccagatttgcgcgtgcgttaaatcgatagtgacctttttagggtcatgggcataatcgaaatgctcgaacaggtcgttgctgctggcgaaaaacagcgggccgcgcaccacatagcgcaccgactcgccatcttcgctcagctgacgctccgcatgaataacgtgcgcaatacggcgggcaaacagcagcatagccaggattaccccagccagaacgcccagtgccagattacctgtccagacagtcaccgctaccgtcagcaccataatcagcgtctctgaccacggcatacgtttcagggtagcgggttgcaggctatgccagttaacggttttcacggccaccaccatcatgatcccggccagtaccaccatcgggatttgcgccataatccggctcagtgcggtcaccagtaacagcagcaccagaccggcggtcacggtggaaacccggctgcgcgcccggcccagttcaacattgacgatggtctgacctatcatcgcgcacccggcgataccaccataaaaacccgccagaatattcgccacgcccaggccccaggattcccgacgcttactggagggggtatcggtcaggtcatcgaccagtttggcggtcagcagcgactccatcagcccgacaaaggcgatgctcagggccgtgggccagataatctgcagggtctgcaggttaagtggcaccagcaggctgttaaaaccgggcagaccgggactcatcggcccttcatcgcccacgttcggcatgcgatagcccattaacagcgcgacggcagtcactaccacaatggcaaccagcggtgaaggaacactttttatcagacgcggcaacaacagcacgatagccagtgtgacggcaaagaagatccacaccagtgatgactgtccccagacgtgcggcacctgagcaaagaaaatcagcaccccgagcgcattcacaaatcccagcatcaccgagcgggggatataccgcatcatgcgcgccaggccggccacaccaaacagaatctgaatgacgccgcccatcaccaccgcgggcagaatatattcaacgccatgcagatggaccatcggcccgataaccagcgccactgaacccgcagccgctgttaccatcgccggacgtccgcccagtatcgacagggtcaggcagagcaccaccgaggcgacgaggctgactttagggtctacaccggcaataacggaaaaggagatcacttcagggatcagcgccagcgcggtaatcaccccggccaggcattcgcgggtcagcagcgcaggcgaaacgcagaacgcgccctacactgatatcgcccgccacaacgtcggttgcggcaatatcattggtttgagtcataaaagattgcaggctctttagttattttgctcccgcgcgaggggcgggaagatcaggataaacagtgaggggcagatagtaccgggcgactggcgaagataccagaaaaaggcggatgactccttccgtggagtcgatgctacagtgaaaaatcgtccggggttttatggaccaccagttcaagcagctgtcggtagatatccagtaattccctgtcgctttccagctccagccgatgaataagctttgagataatcgctttattgttcactggcatgcctgactgcaaaatttctgcaaccaggatacccagcatctccatctcgctggcgggtttattggcggcaggattaaaataatcagcaatttcctgattggtccggggaagaatatattgcatgtgtaagcccttcagaacagcccgattccggttcggatgtcaggacaaaagcgatcaaaaaaaccaccgcatggacagatgcgatggtaccagtgtcacaaattgaacagaaaaaataacctctgaaggtggaaatccactgacaccttcagaggcgacgcaagtgcatcattcgttacagagtcgcatgacaactcgtggcagtaaacttatacaatgaagcccaatctgtacaatcgtattctttaacaaagtgtgctatttgacacttatcagcagcttataaggactattccgaaacgaaagctgtacaagtaacctgtacaaacggcggggccgaggggcgggaggggaaaaacaggaagccatgaccagcttcccgcaaaaagattagctgaatagcgccagttttgccgtcagctttcgcagggcttttttatcgccgacgatggcgacgcccagcaggcgccactgctgacgcggttgctgtcgcaggacggcgctcagcgcctgataatcggtagtggtctggccctcttccggaaacagcaccagatcgtattcagcctgttcgcactgttcccgcaatgcactgagctgctcgtcagtcgcggccagcaccggaatgccggtggtgatcaaaccgggagaagggcgcctctcagcatcctccagggtatcgccaaccagcgccggatgtcgctgtcccagggttaatgccatcacggcggcagcattggtggctttgccaggcggcagagcggcattgagtatcattacacagcgtgggtcttgcattgcgcttctcctgactaaaaaaacgcattgtggcaagtggcttaacccaggtctggaagatttgtgcaggcgtgctgataacgggaaggggtaagctggcaggcgcgtttgaaccagcggcccaggtgactctgatcggcgaaacccagcgcggctgccacatcggcgacgggctggccctgcgccagctgacgacgcgcctggctcagccgccactgcaccagccaggcgtggggcggcaaaccccagtgagcctggaacagacgcgataaccggaagcgatccacctgcagatgctgcgccatctgctccagaccgggattatccgcatgatgggcaatcagccagtcacgcgactgcagtgccagccgggcatctttatccgggggctgagcgggcagtgaccactgccggtgcgggatgagctgcccaaacatccggtccagcgccgcctctttgatgatgtcgggatggttgtgccacaaggcatcaaacgcatgccagacggcataagccagtggacgctcgtcgcgcagcgtggcggcaaaacgtagctcacgcagtgagggtttatcagccagcatcggagccaggtgctgcgaaatctgctgcggcgaaagatagagcatccggtaggtaaaaccgctgtcgttgatggcatcaccgtcatgcagctcctccggctccagcataaagaccgtgcctggtcggctctgatgctgtttgcgccgcgaatgaaactgctgtacaccttgctcggtcacgccaatcagataactgtcgtgccagtgaggatcataggcgtgtccggtaaaatgggcgcgtagcgcctcaataccgctgacggcgtcacggcgcagatcgacccagtttgctgatgcctgtttcatgttatccggctcccggttgcggcctctggacattctgccgcgatccactaatttttaacagaccggacgcttttcattggcgtttcgctttgcgtataataacgccatcactcaattagaactcttactattaggctgctaacatttgtctcagcacacgcgtacctttacccacttattgcatctgaccgcacatgcctggcgcctggcggtggatcgtcaccttaaagatagcggcttaagcatgagcagctggatggccatcgggctgattgccagtgagccgcaacgcatgacccagaccgagctggcacagctgctggggctggaagatgccagcatggtaccgctggtggatcggctggtgaaacagtcactgctgatgcgggtacagccgccagaagatcgacgtaagcgtcacctggtgctgactgataagggtaacgaagcgttcgccaaagtgaaaaccgaggctgacgcactccgtactgaaatgctggccgatattgaccctcaggatctggccgtgaccgagcgcgtattgcaacaactcctgagccgcatgggaagtatgtagcagtggcaaagcgaaatccctacgctgcacgcgagtggttgccgcacgaaaaaccgatgctgccgggatcgccctcgacgccgctgcatccgatgccaaaacgcctggcgtttggcctgatcggtttacttatttcgctgaccggtgcgctgagtaacgcgctggtcacggcgaatctggtcaacctgcaggggacttttggtgcctggtcgaatgagattgcctggctgcctgcggtctatgtgatgggcaacatctctattaacctgctgctggtgaaattccgccagcagtttggcctgcgtgtctttaccgaggcgtttctggtgctgtatgtactggtggcgtttttccatctcttcgccaacgatctcagttcggcaatcattgtgcgcaccgctcacggtatggtggcggcggcgctcagctctctgggcatctactatcaggtacaggcctggcctgcgaaacatcgcctgaaagcgctggtgattggcctgacggtatcgcaactggctatcccgctggcccgcttattctcttcggaattgctgcagctcaacgagtggcgcggtctctatctgtttgaactcggtctggcgctgattgcgctgggcggggtactgctggtgaaactgccaccgggcgatcgcatcaaaacctttgaaaagatggatttcgtcacctttatcctgctggcacccggtatggcgctgctgtgcggcgtactgacgctgggccgtattgagtggtggtttaccacgccctggctcggtatctgtaccgcgatcgccctgacgctgattgtcgctgcgattgtcattgagcataaccggcgcaacccgttgatcaatacccgctggctcagcagcggcatgatggtgcggcttggcattgtgatgatcatgatccgtatcgtactggcggaacagaacaccggcgcaatcggctttctgcagcagattggcttgcagaacgatcagatgcgcggtctggcgctggcgatcatggccggggttattgcgggcatcgccgccagtgcgctgaccatcaagcccaatcatctcaactggccgattgtcacctcgctggtggtgatgattatcgcctcgctgatggatgcgcaatccagtccgctgacccgcgccagcaatatgtatttcagtcagtttctgctgggcttcagcagcgcctttttcatggcacccgcgatgctaatgggcattggcagcgtggtgactcagccgaaaaatctggtgagcttcgtggtgctgtttggcatgagtcagaaccttggcgggctgatcggctcggctattcttggcacgtttcaggtctggcgggaaaaatatcactccagcctgctgggcgatcagctctcactgctcgatcccaacgtcaccgaacggctcagccagtataatgcgctgtttaattcgctggtgggtgacgacgttctgcgcggcgcgcagagcaccagccagttacaggtaatcgccacgctgcaggccaacgtgctcgcttataacgacacctacctgttaaccgctgcgctggcactggtcaccctgatgtgggtgatctggcgtttgacccgtcgtcgttatcttgactggcgccaggcgcaatttaacctgcgtgagcagcaacagctggccgcattacaggaatcaacggagaaacaatgagtcagcaggatgagcttcatgcggcggaaacgcgaacgcgcgaatcgccgccgtattctttctatcgccgcaggcagcggcattgtggtgattggtgtactggttattctttatgcctggcaactctggcccttcaccagcgcaatacaaagcaccgagaatgcctatgtgcgcggtcaggtgacctttatcagcccgcaggttaatggctatctcacctcagtcgaggtgatcgatctgcagccagtgaaaaaagggcagttgctgatgacgattgacgaccgtatctatcgccagcgggtgcatcaggcgcaggcgcagctggcgatgaagcaggcggcgctgaacaataacctgcagcagcgtcgcagcgcagaagcgaccatccagagcaataaagcggcactggagaatgccaaagcacaggcgctgaaaagcggcttcgatctgaagcgtgtcgaaaatctcacggcggatggatccctgtcagtgcgtgagcgcgacgccgcccgggccgcagacgcccaggcgcaggcacaggttcgtcaggctgcggcgcagatcgccgtcgcccagcagaatctgcaaaccgtcatcgttaaccgtgacgcactgaaaggcgatgtcgacagcgcccgcgccgcgctggagctggcggaaatcgatctggcgaatacccggattaccgcgcccgatgatggccagctcggccagctggcggtgcgcaccggcgcctatgtcacggcaggtacgcgcctgacctcagtagtgcctaatcacaaatggattatcgcgaatctgaaagagacccagctggcaaatattcgtcctggcctgccggtgacgattcgggtcgatgcgctggatggcaaacgctttacgggtcaggttgaatttatctctccggccgcaggctcagagttcagcgcgatttcgcccgacaacgccaccggtaacttcgttaaaattgcgcagcgcattccggttcgcatccgcatcaatgaccaggatatgcatcagttacgcccgggtatgtcggtcgaagtcaacatcgacaccgccgcacaacccgctggtgagggtgcgccatgatgcggcgcggcttaatggtaagcgcactggcactccttctgaccggctgtgccacgcaggttgaaaaggcaccggcctctctgccgatccctgacgcctggcgcaatagtgtcgggccatctgctgcgccggaggcggagtggtggcgcgcttttcatgatgaaaatctcaaccggctggtgacgcaggcgctgcgcaataaccccgatatcctcacggcgcgatcccgggttgatcagtatcgcgcccagctgcgcgccacgcagggcgataactttccgaccctgagcgccggtgtggccgcgacccgggagcgtacgctctcgtcagtgaccggccagccctatgaaaccgatatttttcagggcttattacaggcgaactacgaggtcgatctctggggagcacgcagcagcagcatcacagcatcgcaggcgagtctagcggcgcagcaggccgctgcgtctgccgccgagctgaccatcgccagttcggtggcgtcaggttatctcaacctgtgcgcgctggatgagcagttacgggtcacggaggcaacgctggcgacccgcaacaattcgctgaagctggcacagcgtcagtttgaaaccggctacacctccaggctggagtggatgcaggccgcctcggaatatcagtcggccaaagcgcagatgcctcagttgcagcaccagatcacccagcaggagaatgcgctgagccttctggtgggtatgaacccgcgcagcatcgcccgtcgtcagcagtttgaccagatttcacctcagcggatgccatcactgctgccatccgagctgctcaatcgccgtccggatattgtgcaggctcagcgccagttactggccgcagatgccagcctggcatcgtcgcgcgctaagctgctgcctgggcttaacctcaccgcgaccggcaccctgcagagttcggtgctgcaccagctcgcggatgatccgttccggctgtggagcgtgggcggcagcatcctggcaccgctgctgaaccgtgaagcgctgacggcgcaggtggatgtctcaatggcgacgcgaaatcaggcactttatggctatgaaaaagtggtgcgcaacgccttctcggaagttaacgatgcaatagacgctatcaggcagcgtgaggcacaacttcaggagctgcaaaagcaggaagcctatgtgacggaagcgctgcgcattgcccgcaatcgctatcagaaacggctacgcctcctatctggatgaactggatgcgcagcgcaccctgttttcaacgcagctgaatcgggtgactgtcaaaaataacctgctgctggcgcagatcgatctctaccgcgcgctgggcggtggctggacacccgcctccacacagtaatccccagaccgatccagccgcagccagagtttctgcggccgggatcggcctctgcgctgtcgcggcgactgcgtatattccccgctttaatcccccaaataaccccctaaaacccatgcatacttctgcttacctgtctttacattcggtggtatcatgcgcgggttttaagccagccagatggaaaagcgcactgaaagcttagcctgcgcgagacggattatccgtttaacttactgatataaaaataaaagaagggattcatcatgaataaaaaaactatttgcacgctggccgtggtcgctgcgttattaaccggctgcgcgcgcactgcaccgattcataacgtgaatcaaacgctcactcagcgttacagcgataaccagatgaaactggcgatcattgaagcgggtattggccggaaatgggtgatgactcccgtttcgcctggcgtgatcaatggtcgtctggcccagcgtgatttcgtggcgactattcgcatcacgtataccagccagaaactaccgcatcgattatgtcagcagtgagaacctgaaagcggggcagggcgagatccacaataactacaaccgctggattgccaatctcgatcaggatattcagttacgactctctgctcttgccgctcagtaatgcgtgcgctgtcgcaatgatgtgtcgacagccgatcaaagcataaagatctccggcagccggccgacaaatcagatgagctgctattgctgaaccactgagtaaccctctaccgtgaaggcctgatgcggaatcggcagagggtttcccggacgcactttttttgcagagggccgggatgacgccccgataaacgccgacgccacacatatgacaaaaagagtgttgagatgagactcgcttactcactggtcgactggcaggctctggctccgggattacacgggggcgagggctggcagcactgggcgcaacagggcaacgtcatagaccctaaagaggcgatggcaaagccgcaatttttaccgatgatgacagcacgtcgtctgagcggcggcagtcgtgcggcggtagagtgtgggctggcgctgcttgcgcgtcagcaggttgacgctatcgtgttcaccagtcgtcacggtgaactggaacgtaatctgcgtatcctcacaaccctggccgatcagcagtcaatgtcacccacggattttgccatgtcggttcacaattcggcggtcggcagcctgaccattgcagccaaagcaccactggtctccacctcaatcgccgccggagtcgactcgtttcagcagggattgatcgaagtcagcgcgctgcatcaggcgggttatcagcaggtactgctggtcgatttcgacggcatcgtgcctgactactatctgccgtggctgccggaacagcgtgtgaactttccctatgcggtggcgctgctgctgcgcccgggcgaccagctgtactgcactggccgtgctggcagagatgagagggcagaaacagggttaccgcagagcctgcgctttctgcagcagtggctggcggaatcgcccaccttcagcctgccgggcgaaacgcctgacatggcactgggagagacatcatggctgattgttcacaaccggcgcactacaccggcagccgtatgaactattgctggcggctggtgatgacggcggtgagttttacgctgtttggcataggcgggctgctgctgtcgctgattggcttcaacctgctgctgctggtacagcgcgattcgctgcgccgccgcctcctggcccgacgcgctatcgcctttagcttccgttgctttctgcgattctgccggatgaccggggtctatgactaccggattgaaggcgcagagctgctgcaacaggatcgcggatgcctgattgtcgccaatcatccatcactgatcgactacgtgatgatcgcttcggtactgccagagatggattgtctggttaaagccgatctgcaaaagaacccctttatgcgtggggtgatccgcgccgcggactatctgatcaacagtgaagcggagacgctgttgccggacagccagcagcgactggcgcgcggcgacaatatcctgatctttccggaaggcacccgcacccgctacggtcatccactgactctgcagcgcggggcagccaatattgcggtgcgcgccggatgcgatctgcgtgtggttcacatcacctgtagccagcgtatgctcgataaacagagccgctggtatcagattccgccggttaaaccgctgtttaccgtgcgtgtacaaacgcgaatcgacagtcagtcgttttgtgaaagtaatcccgatgcgcagccgctggccgcgcgtcgcctgacccgccatttacagcaggcgctggtcccccagaacaggtaagacgaaaaccggtatggattcattaattaacgatatcaaacagatgattatcgacacgctgaaccttgaagatctcagtcccgatgatatagagaccgacgctgcactgtttggcgacggactggggctggactcgattgatgcactggaacttggcctggcagtgaaaaatcgctacggcgtggcgctgtccgctgagagtgaaaccctgcgcgcccactttttctctgttgcgacgctggctgcgtttcgtcaaccaacagcgcggctgaaagcggagacaaccttatgatgaacaaagaacagatctatcaggaagtggcttcgctgctgaccagcctgtttgaaattgcgcctgaggatatccatcccaaggcacgtctgtatgaagatctcgaactcgacagcattgatgccgtcgatatggtggttcatctgcaaaaacgtaccggccgtaaaattaaaccggaaaccttccgcgcagtgcgcaccgtgcaggatgtggtggatgccgtggaacaactgatgcgcgaagacgcctgatcccgccgtgcctgctgctacgcttcgcctgctgaatctgcttacgctgctggcctggccactgctggtctggctggcgctgacccagccgcgctggcaggggcttttctggctgctggcgctgctgtttggcctgcgctggctgcagctgcgtcgtcagcaaaacgccatgggcgcggtcatgggctggctggcgctgctcggtgcactgctctgtgtcagcagccagctattacgcactcagcatctgctgctgtggtatccggtggcggtcaatctggcgatgctgctggtgtttggcgcctcactctggagtgcgatgccgctggtggaacgcatcgcccggctgcgtgagcccgtgcttccccctgcggcagtgcgctatacccgccgcgtcacccaaatctggtgcctgttttttatcggcaacggcagcatggcgatctatacctgtttgctgggcgatctgcggctctggacgctgtggaatggcggcataagttatctgctaatcgcagtgctgatgagcgctgaatggctggtacgtcagcgcgtgaggcgaaaagcatgagagtggccgactggctgacgggagacgatcgcgaggttgcctggcgcggcgatcaacgtttgatgctcagcgtgatgcatcgtcaggtcgtggcgctccgccagcgattagcggtacaaccgggcagccactgggcgctctgttttgatgacagttaccgtttttgtgtggcgctgctggcatgctggtatgccagcaaaacgccggtgatgccgggtcactgccgcgccgcgctgctggatgagaggcaggatcggctggatggcgtgctgtgcgacatgccgctggcggtcagcctgccgctgctggcgtgggacgacgcagaagcgcaggggccgctgccgccgctgccggagagtgcagaactggtgctcttcacctcgggatccaccggcgcaccgcgtcaggtagtgaagtcgctggcggtgatggagcaggagagtcgctggctcagcagcctgtgggccgaacagttgcgggggtgccgggtcatcgcctcggtcagccatcagcatctctacggtttatcgtttcgacttttcctgccgatgatgctcaggctgccgtttgccgcccagccgctgttttacggtgaacaactggcccagcttccgcgcgacgttcgctatgcctttatcagcagcccggcctttttatcgcggctggacagcacgctgaaagcgcccgcctgtgaactgattgtctctgccggtggcgcactgcgcgactctgatgcggagcaggtctggcagcgatttggctgtcaggtcagtgaaatctacggcagcaccgaaaccggcattctggcctggcgtcagtgcgtttcgggcggaggcgccgtggcgctgcttcccccaggtcaggctggaacagatgacccccgatcgctggcaggtctggtcgccgctgattactggtgacagcgggctgcagctcgacgatcgactgactatgcagccggacggcggatttcagctggcaggacgccacgatcgcatcgtaaaaatcggtgacaagcgcatctcattaagcgagatagagcgccgtctgaccgacctgccggaaatcgaggatgccgtagcgctggtggtcacgcgtcatgagcgtcaggcgattggcgtcgtgctgtcgctgaacagcgcactggatgaggcggctctgcatcagcacaggcagcagtggaaacgccagctgcagcgctggctggaaccgctggcgatgccgcgctactggcggattgtggccactattccggtgaccacccaaagcaaacgcgcctggccgcaaatagaggaactttttcatgttgccgattgaacgcagccgggagctgcgggctgacagcgtcacgctgaccctgcagatagatgccggactcttctggtttcagggccactttccgcatctgcccattctgccgggtgtggctcagctcgactgggtgatgcactacggcgtatcactgcttgcgcccggtaaacagtttgccgccgttgataacattaaatttcagcagccggtattacccgactcgctattgcaactgcatctggactgggacgctgaaaaatcccgcctgagtttccgttacagcctgctgaagaacgacggcgagcagattgccagcagcgggaagatcgcgctgtgttaagcgccccgttttcaccctgcgtggtgatcccctgctacaaccacggcgcgatgatggcgtcagtgctggcacggctggcaccctttaatctgccggtaatcgtggtggatgatggcagcgatgcggccactcagcttcagctggcgacgctgcacgccccgcagctcagcctgctgcgactcgacagcaatcagggtaaaggcgcggcggtgatccacggtctgcgggctgcggcggcacgcggcttcacccatgcggtgcagctcgacgcggacggccagcatcaggcggaagatctgccgctgatgctggcggaagcggagcgttatcccgacgcgctgatctccggtcagccgctctatgacgactcgatccccaaatcacgcctttacggtcgctacatcacccacttctgggtctggattgaaacgctgtcgctgtcgatccgcgacagcatgtgcggcttccgcgtctatcccctggccgcgacgctggcgctgtgcgatcgccgggccatcggtcagcgcatggattttgacaccgagatcatggtgcggctctactggcagggaacccgcagtcgctttatcccgacccgcgtcacctatccggccagcgggctgtcacacttcgatgcgctctacgacaacctgcgcatctcctggatgcatacccggctgtttttcggcatgctgccgcgcattcctcgtctgctggcgatgcgtaaaccgccaacgcactggtctgcggaaacggagcggcgcggacagtggggattacgttttatgctggcggtctatcgctacggcgggcggctgccctttacgctgctactctggccggtagtggcggtctactggctgagcggtcagcgcgcgcgacgcgcttcccgtcagtggctggcgcaggtcactaccgccgcgcagcagcagcagattgcgttaccgccacggcttaacagctaccgccatttcctgcggtttcgccggggcaatgctggataaagtggccagctggcgcggcgatctgcgctggggacgtgatatcgattttgcgccaggcgcagaagcggtgatccgcacacccacgccgcagggcaagctgattctcgcttcccatcttggtgacattgaagcctgtcgcgcgatggcgcagcaggtcagcgggctggtgattaatgcgctggtgtttaccgacaacgcccggcgttttcgggcggtgctggaaaccattgccccgcaggcgggggtgaatctgatgccggtgagcgatatcgggccggagaccgctatcatgctgcaacagaagctggatgcgggcgaatgggtggcgattgtcggggatcgcaccgcggtcaatccgcagcgcggcggcgagcggcgggtgatctggagcgactttctgggccgcgaagcgccctttccacaggggccgtttgtactggcggccgcgttgcgctgtccggtgctgctgatgttcgccctgcagcaacagggtaaactgcgtattcactgtgagcccttcgccgatccgctgctgctgccgcgtgcgcaacgtcagcaggcactgcaacaggcggtcgatcgttacgcagcgcggctggcccattacgcactgctggcgccgctcgactggtttaactttttcgatttctggacgctgcctgatcaacaggcgcaccacaaggagtctgaccatgactgaacatcatgctgaagtcgtgctgaccgtctcattccacgactgcgatcccatgggcgtggtctggcacggcaactatttccgctttttcgaagtggcgcgtgaagccctgctgcgcagcattaactacagctatggcgagatggccgccagcggctacgtctggccggtggtcgatacccgggtcaaataccgccagccactgcgctgcgaagagacgattcgcgtcagcgcccggattacggaatatgagaaccgtctgcgcatcgactatgaagtgcgaaatgctgccggtcagatcaccaccaaagcgcatactctgcaggtggcggtggagcaggagagtcaggcgttgtgctttgtttcacccgatattttactggaacgtttaggagtgaaaggatgctgaaaattgtgcttaccagcctgctgctgtgggccagtgccgccagcgcggtcacgctggatcagctgcagcagcgttttgccagccagccggtgattcgggcagactttatccagacgcgtaccatttccggcatgcgtcagccgctggtctcgcacgggcagatgctgatcgctcgcgagcagggcttatggtggcatcagcagacaccctttgtgatgacgctgctgctggatgataaacgcatggtgcagagccttagcggccagaagcctcaggtgatcaccgccgacagtaacccgcagatgttccagttcaaccatctcttgcgggcgctgttccaggccgaccagaaagtgctgaacgagaacttcagcgtggccttcagcgatcgcggcaacggagcctggacgctggagctgacgcccaaagcggcgccgctcaacaaaatcttcaaccgtatctcgctggcgggcagcgcctacctggacagcatcaacctggatgataaacagggcgataaaacgcaaatagagctcagcaacacccgaattgaaccgccgcagttaagcgacgaggagcaggcgcgttttgccgggccgtaacgatcggctgctggccctcctgtggctggccctctgtctgctgctggcggctgcgctctcttttttgctgccgcgtagtcagctcaacagcagcgtgctggcgctgctgccgcagcagaatctgggggcggcaccgcctgcgctgcagcagggctttatgcagcggctggatcgccagctggtgtggctggtttcacccggtgagcaggacgatccccaggtcgccgcctggtggctggcccagctgcgcgcgctgcctgacctgaaacaggtgcagggtgatctcgacgggcaacagcagcagcagtggggccgctttgcctggcaacaccgtaacggcctgatcgatgaggtgacgcgcgaccgcttacagaacggcggcgaggcgcaggctgactggctgctggcgcagctcttttcggccttctctggcgtcagcagcaaagagttgcagggcgatcccatgatgctggtgcggggttcgcagctggcgctggcacaaaacgccgggcgcatgacgctgcatgatggctggctgacagtaaaagatgcacagggtcagcagtggtattttctgcatggcgaactggcgaacaacgccttcagtatgcagcaaagtcattcgctggttacccgactcagcgcgctggagcaacagcttaaaagccgctggccgcaggcgaaactgctgacgcgtggcacggtgctgttcagcgacaacgccagccagcgtgcgcagcatgacgttaaaacgctgggcagtgtgacgctgggtggcgttgtcctgctggtgctgctggtcttccgctcactgcgcccgctgttgctgacggtcacgtctgtggccatcggcgcgatggcgggcacggtgatgacgctgctttgcttcggtgaactgcatctgatgacgctggtgatgagcctgagtattgtcggcatctctgcggattacacgctctattatctcaccgagcgcatggttcacggcgatcagcagacgccgtggcagagcctgcgaaaagtccgcggcacgctgctgctggcgctcgggaccaccgccatcgcctggctgctgatgctgctggcaccgttcccggggctgcggcagctggcggtgtttgccgccagcggattaacggcctcctgtctgacggtgattctcatctatccgtggctggtacgcggattaccggtgcgtccggtgccgctgatggtgccgctggcgcgctggcttgccgcctggcgtcgccagcgcgggctgcgcgtcggattaccggtggcgatggcgatcttcgcgctggccggtatcgcccagttaaaggtggatgatgacatcgctcatctgcaaagtgcgcctgcgcatctgctggagcaggatcgccagctggcaaccctgaccggacagcgcgccgatcagacctggtttgtggtctggggcgatgatgcacagcagacgctgcagcggctggaaaaactggcaccggatctgcaccaggcgcagcagcagggctggctgcagcactatcgtctgctgccgctgacgtcgctggcgcagcaacagcgggatcttcagctgttgaaacaggcagcaccggatattacggcccgcctgcagcaggcgggtatcacgctgccggcaccggatctgaccccgatgccggtaacaccagaggcgtggctgtcgagtccgctgagtgaaggctggcgactgctgtggctgacgctgccagacgggcgcagcggtgttttgatccccaccagcggcgtaaaaaacagcgctgcactcgcggagctgaccaaacagcatccgggcgtcagctggattgaccgcaaatcaggttacgattcgctgttcagcttctggcgcaccctgctgagcgggttactggcgctggcgctgctgctgatcaccctgagttttgtcctgcgactggggttaaaggcgggcttacgcagcgcgctgccgtcagtgctgtcgctggcgatggcgctggcaacgctgggctggatcggtgcgtcgctgaatctgtttgcgctgctggcactgattctggtgctgggcatcggcattaattacacgctctttttcagcaacccgcagggtacgccgctgacctcgttgctggcggtgtcgctggcgatgattaccaccttactgacgctgggtatgctggtattcagcagcaccagcgcgattgccagttttggcacagtgttatgcagcggcatcttcagcgctttcctgctgtcgccgctggcgatgcgacccacccgatcaaggagtaaacgatgattcgcgccgctcttattctgctgacggctctgctgctcagcgcctgtgccggacctgcacccgacagcagccgtcccaccgcctggctgaaaccgggcgtgaaggtgacgctgccaccgccgggcatccgtcccgccttccagcagcagcagttgctgaccggacaggtgaaaggccagagtcagtcactgctggtgctgctcagcgccgatgaacagcaaattgatctggccggactctcctcggtgggtattcgcctgttcagcctgcgctacgatgccagcggtattcacacccagcagctgatgccgctgccgcagatgccgcctgccagtcaggtgctggcggatattatgctcagctactggccacgggagctgtggcaaaaacagctgccaccaggctggacgttgcaggatcaggggttaaagcgacggctgatcgatgccgataaccagctggttaccgaaatcgattatctgcaacgcggtaatcagcgccagcccatcagcattcagcagcatgcgtttggctatcagatccgcattcaacatctggacggctcatgatttacatctctgccatcggcatgctgaatgccctggggaataacactcagcagattgcggccagtcttaccaggggtgaggcacccggcatgcagctgcgtcatggctggctgagcggcgaccgcgcctgctggcttggcagggttgaaggcgatttgccatcgattcctgctgccctgagcgcgcataacacccgtaataaccagctgctgctggccgcactggcgcaaatccgtccggcgctcgacgcggcgattgcgcactatggtgccagcagagtggcagttgtgctgggaaccagcacctcgggcgtggatgagggcgatcagcagattggcggcagtcagtccggttatcactatcagatgcaggagctgggcgatccctcccgtttcctggctcactatctgcgcctggatggcccggcctataccatttcaaccgcctgctcctccagcgcccgcgccattatcagtggtgagcggctgatcgcggcagggctggtggatgtggcgctggtgggcggtgcggactcgctgagccggatgccgatcaacggattcgacagcctggagtcgctctctgaacgtcgctgcgctcccttcagccgcgatcgcgacggtatctcgattggcgaaggggccgcactgatgctgctgacgcgggaaccgcagccgctggcgctactgggagctggcgaatcgtctgacgcctggcacatgtccgctccccatccgcagggcgagggcgctgaacgggcgatgcgtatggcgctgcaacaggcgaatctgttgccagagcaggtgggttatatcaatctgcacggcactgcaacgccgcttaacgaccagatggaagccgccgtgattcagcgcctgtttggcaatgcagtgccgtgcagctcgaccaaacatctgaccggccatacgctcggcgcggcgggagtgtgtgaagccgccctcagtgcgctgatcctgcaaaacaatctgccgctgcccgcgcaggatttcagtgagatggcggcggatgagacgctgccggattgcggattgttattacagccgcaggcgctgcaacggccggtcatcgcctctaactcttttgcctttggcggcaataacacctgtctgattctgggacgccaacatggttattaattctcccgcggcacgctggctgccgcacgctgcgccgatgctgctgcttgatcagctgatcgccgtggatgatgagcaggtccactgtcaggtgtcgacctgcgccggtggcgtactgacaccgtttctgacgcctcagggtgaactgcccgcctggtttggcgtcgagatgatggcgcaaaccgtgggcgtctggtcgggctggcatgcaaagcagggcggcgccacccttatcccgcccggcatgctgctgggcggacgcggctggcgggcagagcgatccctctttcccgccagtgttacgctggatatcagaatgacgctgctgatgcgcgatgaccgcatgggcagctttgagggcgacattcattacggcacccagcggcttgccagcggtcgtctgaatacgtatcaacccaatgaagcagaattacagcaattgatgtcacaaggaaatcagccatgacagattcggtattagtgacgggcgccagtaaagggattggccgcgcgattgcgttgcgtctcgcccaggatggctatcaggttatcgtccacttcaaccgtgaccgcgcaggcgctgagcagtgcctgcagcagatcgaaaccgcaggcggcagcggccgtatgctgggatttgatgtggccgatcgggcggcaacccgcgctgcgctggaggcggatattgagcaatatggcgcctattatggtgtggtgagcaacgccggtatcacccgcgatgcggcgtttcccgccctgacggatcaggagtgggacagcgtcatccacaccaatctcgacagtttttacaatgtgatccagccctgcgtgatgccgatgatcggtctgcggcgcggcggccgcattatcacgctctcgtcggtgtcggggataatgggtaatcgcggtcaggtgaactacagcgcggcgaaagcgggcattattggtgccactaaggcgctggcgattgagctggcgaaacgcaaaatcaccgttaactgcattgcgccaggcctgattgataccggtatggaggggctggaacctcaggtgattgaggaagcgatgaagatcgtgccgatgaagcgcatgggcgcggctgaagaggtcgccggactggcgagctatctgatgtccgatatcgcaggctacgtgacgcgtcaggtcatttctattaacggaggcatgctgtgatccagcgggtagtcgtaaccggcatgggcggcgtaaccgcctttggtgagtcctgggctgaggtttcggcacggatccgtgcgggccgcaatgcggtgcgctttatgccggagtggcagatctacgacgggctgcatacgctgctcggcgcaccggtggatgactttgtgctgccggcgcactacacccgcaagcgcatccgcgccatgggccgcgtttcgctgctggcaacgcgcgcgaccgagctggcgctgacccaggcgggcctgattgaccatccggtgctgaccagcggagaaacgggtatcgcctacggttcttccaccggcagcaccgggccggtcagcgagtttcgccaccatgctgaccgaaaagcacaccaacaatatcaccggcaccacctatgtgcagatgatgccgcataccacggccgtcaatgccggactctttttcggcctgcgcggccgggtgatcccgacctccagcgcctgtacctctggcagccaggcgattggctatgcctgggaagcgattcgtcacgggtatcagacggtgatggtggctggcggcgcagaagagctctgtccgtcggaagccgcggtgttcgacaccctgtttgccaccagccagcgtaatgacgcgccgcacaccacacctgcaccttttgatcagcagcgcgatggtctggtaattggcgaaggggcgggcacgctgatccttgagtcgctggaacatgccctggcacgcggtgtaacgatctacgcagagatcaccggttttcataccaactgcgacgccgcccatattactcagccgcagcgagaaaccatgcagatttgcatcgagcgggcgttgcaaagcgccggtatcacggccgcagacgttggttatgtgaatgcgcacggcaccgccactgaacggggtgatatggccgaaagtctggcgacggcggcggtgtttggcgaaacgacgccgatctcttcgctgaagtcctattttggccatacgctgggtgcctgtggggcgctggaagcctggatgagcattgagatgatgcgggaagggtggtttgcgccaaccctgaacctgacgcaaccggcagcagatggcggccagctggattacatcatgggtgagccgcgtgagattgaaaccgactatatccagagcaacaactttgcctttggtggcattaacacttcattgatcttcaaacgctggcgcggcgtctgatctcaggcccgtgccgcgctggcacgggccagtttatttttcggacgaaagaaccggacgataatcagcctttcatctacactgtcactcaccgcatcactcccggcggcccatgtttttcacaggatagttatgtctttacccttgccacccgacgatcacgatgagccaattcgccagtcacttgacgatgcgcactttgcgatagtggtgcttgcggtgacctcggtaacgcttataatctttgtcctgatgattacgctctggatgagctgacacgcacagggattcaacggattgaataaggagaaggcgatggactccggagatgacaaattaatcgcaattatcggtttgctggcggcctgcctgatcggggtgaccttcctgtttaccatggtctggctgaccgacgtacgtcatcctgccgatccctctctcgacgttcgctcctgttaccctaaaaagccaccttctcagcacgtctgatttcgtgtcgcaaacttaatctgctgactgcgcaataccagcgccagcggctcatgcagattacggttgccattgggatcggctaatcccagcagcgggccaggggaacgccggtcatcggcccaggccggatactccaccaccggatagagcgaaatcccctccaccgcaatgccctgatccagcgccaccgccacattttcactgatctcctgcagccagggggcgcgcgcttcaccctcagcgccagtttcagcaatcagcatcggacgctggtagcgctgccagcactgcgccagcagaatatgcagcggcacacgctccggatcctccagcgacatcggctggtcggggaaaaaccagtggttatcgggatagtagttcaggccgaggatatccaggcaatcttcactgccgcctagctccttatcgacgcgaccggccagcatgtcccaggcttcgaaactgcgcctgatgctgcgcatcggcatagggtttgctgtccggattatcaggatgatgagcgatctgcaccagcgggtcagtcagcacaaagcgcgcctccggatagacctcgcgaatggcatgtatcgccgccagcgaggcgcgaaccagctggcgcttcagctctttaccacgctgcgccgcatgaggattaaaccaggccacatccgccccggcccatgaccagaatgagatttgattaaccggtgtaaagaaggggcgttcgatgccctgatcgcgcatcagttgtgccatcgcgcgagcgaaacgactaaaatggtcaacaaattcggctttccagatattaagatgatcgggataaccgaaatgagccagctcccagatgatctccatctgctgacgtcgcgcggcgtcgaccatcggcagaaagctctgccagtcatactggccagggatcttttcgatcagatgccagcgcgcaccgtcgcgggcggtgagcagatgctgctcagccagggcggcataatctttttccagcagcatatcgtgtccgctgctgatcaccatatccagccgtttaccgggcgtacggcaggcagtggaacaggggaaactgccctggaaaaagctgcgaaacaggctgggatgatagcgctggcgggcatctgtaagggattgatgagacatattcctctcctgccgggataataccggtcacagatcgtccggttaagtctagactaaaaaacgcccgtgacccctaactaactcagaacagaggaatagcatcagaggtcggaccggggaataataaaaataactgcattttacagggaaatgtcatgaccgaagcgtttgagctctcccagccattggaacggtccagctggctggaaacacagctggagccagagtgtctgcgccatccgggtctgagcggcgtccatcagctgagcgacgggctggatgcttttgctgcccgctatctgctgatgcaaaaagcggagcgttcactcgatatccagtattacatctggcaaaacgatctctctggccggttgctgttcagcgccgtgctggaagctgcccgacgcggggtgaaagtgcggctgctgctggatgacaacaatacgcctggcctggacgacacgctggcccagctcaaccgccatcccaacattgaggtgcggctgtttaatccattctcgtttcgcaccctgcgcgcgctgggttatctcaccgactttgcccgtctgaaccgccgcatgcacaacaaaagctttacggtggatggcgtcacgaccgtggtcggtgggcgcaatatcggcgacgaatatttcggcactggcaatgaaccgctgtttgccgatctcgacgtcatggcaataggcccggtggttaaagaagtcgcagaggattttgagcgctactggcgcagcaagccggtctctccgctgcagcaggtgctggatgaagaggagccggaagaggacagtgtgagtctgccagcagagtggcgtcacagtgaaccggtgcagcgctatcttcagcggctggaaaattcttcgctgctgcaggagctggaagagggcacgctggctctgacctgggcaaaagcgcgcctgctgagcgatgatccgcgtaaagggctgggcaaagcgcgtgccagaagcctgctgccgcagcgaatgctggaggtgataggcacgccgcaaaagcagttcgacatcatctcggcctatttcgtgccgacccgcgcaggggtcgctcagctgctgtcgctgaagcgcaaaggggtaaaaattgccattctgaccaattcgctggcggctaacgatgtgtcgattgtccatgccggctacgctaagtggcgcaaaaaactgctgcgtcatggtattgcgctctatgagctgaaaccgcaggcgggcgtgcctgatgccccgcacgaccggggattaaccggtaactccggctccagcctgcatgccaaaaccttctcagtggatcaacagacgctgtttatcggctcgtttaacttcgatccccgttcagcggtgctgaatacggaaatgggactggtgattgagagtgcggcgctcgccggagagacgcatcagcgtttcagccagtcaatgcgcgatcgggcatggacgctgcggctggataagtggggcagggtaaactggctggagtatccgggtgagccgcagcagattgtgcataaacacgagccgggctgctcctggtggcaacggctgcaggtgcggttagtgtggcggttgccgattgagtggctgctttaagctggaccttgcctgggtacaggcgctggctcaggaagcatacgccctccgcaaagacgcaaaacccgccatccctggcgggctcagcgcgggcgattacgcacctcatccctgaggtgcgcccgttgccgggccaacgcgttgctttgttcaaaaacgctcccggcgtttttgtccctggcccgctatgctttgctactggcgtatgctcccatcgctttaaactcttaagctgtctgtgagacacatcatttatagcctgacctcacttatggcccgaggtcactgatcgcctgtcattgtgcttgtttacgctcaaatttccccgagaaacaggaaccgcagcagcggaatgcgcaggtgaatctcatacagcagaaacgcgatgccaaacaccatcagcaggccaacgaagaagcccagcgtgttattttcaatccgtggcgtcacgtaaatgccatacagcagcgtcagcggatggtgcaccagatagataaacagtgacgcattgaccagatacataatgcgcggcgaatgtgaattcagcagcttatgaccaaagcagaagcagacgttcagcatgcaaatgcccatcagcgtcgagataatcgcatccagctcatacaaccagccctcaccgctgctcagtcgctggttggcgcaataggccgcaaacatcagcagcgcaccgacccacatcaccagattgaagcggacaaacagctgcttcagcgggggatgtttccacgccagcgctcccagcataaagaacggcagatagaagagtgtctgcatcactatgatgctaaacaaaccatccatcagccacgcaggctggaaaataaacaccagacgccggaacacacaccagagcagcgcccacgccagtacgcccgccgtcagcgatccccagccaacccgcgaataatcaatggtgcgatgctgatcgcgcagccagcggaaggtcaccatccccagcgtggtcagcatcaccagcaccaccaggaaccacaggtgtgaaatcagctcccacatcaggttattaaacttctgatagggcgtgaaacggggccagtcagccagcttatccgtccactctttcagcataaaaaattgcggcagcgtcagcagcggaatggcggtcagcattgggatacctacccgttccagacgcaccttcaggaagcgacgtggctgatagcgcagataaagcatgtaggagaaatagcccgaaatgacgaaaaacacctgcatacgaaacgcatgaataaaatcattcagcagcgtcagccacaacgacgcttcatgactgtttactgcccatttctgcgcggagtagatgagggaaacgtgaaacggcacccccagtaacatcagataggcgcggatggagtcgaggaagtattcacgttcaggttttacagtactcataaagttccagttcgttagtacgtttaaccggtttcaccctgaaaccggattatgctctgtgaaaattctacctgggataaaccaggtatactatcagtggaatccgtagtgtctaattgtcctaaaagcagggttaagcctgacgaaatgcgggaacaatgttgcgcataagctgtcggaaaaccgaataatcctttaagataaacgggtttgatttaagcacacgaaagggggggatgtgctgactaaagaaaaaaataaagccggactgatgaaggtacgctggattggtactgcagttctgctggcgttgtacgccaataacagttgggcgtttaacatcgacgatgttgccaaacaagccaaagcgttggcagggaaaagcttcgaagcgcctaaaagcaatttaccctctcaatttcgtgaaatgaaatttgctgattatcagcagatccagtttaaccacgataaagcgtattggggcaaactgcgcacgccgttcaagctggagttttatcatcagggaatgtatttcgataccccggtgcagatcaacgaagtgaccgccagcgcggtgcgcgagattaaatacaaccccgattattttaatttcggtaatgtaaaacatgacgcagatgcggtaaaaaacctcggttttgccggtttcaaagtactttacccactcaacaacaagggtaaaaacgatgagatcgccagcttcctgggcgcgagctatttccgtgtcatcggtgccggtcaggtttatggcctgtcggcgcgtggacttgccatcgatacggcgctgccgtccggtgaagagttcccgcgctttaaagagttctggattcagcgtcctaaaccacaggacaaacagctggtgatctacgcactgctcgattcgccgcgtgcggcgggtgcgtatcgctttgtgctgcatccgggtgacgcttcaacggttgatgtgcagtcaaaagtttacctgcgtgataacgtcggcaaactgggtgttgcaccgctgaccagtatgttcctgtttggtcagaaccagccatcgacggtgaacaacttccgtccggcactgcacgactctgacggtctctctatccacaatggcaacggggagtggatttggcgtccgctgaacaacccgcgtcatctggcagtgagcaccttcaccatcgagaatccgaaagggtttggtctgctgcagcgtgggcgtgactttaacaactatcaggatcttgatgaccgctatgatcttcgtccaagcggctgggttgagccaataggcgactggggtaaaggccgggttgaactggttgaaatcccgacggcagatgaaaccaacgacaacatcgttgcgtttctggacgccggagacactgccagagcctggcaaagagatgaacttcaaatatcgtctgcacttctcgcgcgacgaaaaccagctgcactccgatgataccgcctgggtcaaaaataccctgcgttcagcgggtgacgtgaagcagtctaatctggtgcgtcagccggatggcaccgtggctttcaccatcgacttcgtgggtaaagacatgagcaagatggcggaaaacagtcaggtggcaccgcaggtcagcgtgggtaaaaatgctgatgtggttgagcagagcgtacgttataacccggtcaccaaaggctggcgtctggtgttgcgtctgcgtgtgaaagatgccaagcagtccaccgaaatgcgtgcggccttggttagcggcgacaagacattgacggaaacctggagctatcagttacctgccaatgaataaatcgacttttacacctcaacgttatgtggaatctctgccgctggatgcggcagggaaggcccgactgagcgtctcattgcagaatgccagcgagttccacttcatccatgatgtgctgggcagggatgtcgcagccagtgaccgtcccgacgatgcgccgttaaaatcggtctcatcgcgggttgaaatggcctggcccgattcgctggccgaaggtcagcagttgggtaaagattacctcgaccgcaccacgctgaaggcgatgccaaaggtcaaacgctcactgatgttcccggaagcctggcgtaccaacccggtcgcccgtgcctgggactcactgcgtggacacaaatcggtgccgcgttatagcaatgcggaggagcggcgtgccgaggagaagtggcgtcatgtcggttcgattcgacgctacattctgctgatcctgaccattttccagaccgtggtcgccacctggtacatgaagagtattctgccgtatcagggctggacgcttctggatccgatggagatgatcaatcagaaactggcagcagtcagtgatgcagatcctgccttatttgttgcagaccggcatcctgttcctgttcgccatactcttctgctgggtctctgccggtttctggacggccctgatgggcttcctgcagctgcttattggacgtgataaatacagtatctcttactcaacggtcggagatgaaccgcttaacccggaacatcgtaccgcgctgattatgccgatctgtaacgaagacgttgagcgtgtttacgccggtctgcgtgcgacctgggagtcggtggttcgtaccggtaacgctgaacacttcgacgtctacatcctcagcgacagttacgatgcggatatcgcgattgccgaacagaaagcctggatggaactggtgcgggatgttggcggggcaggcaagattttctatcgccgtcgtcgtcgtcgcgtgaagcgtaaaagcggaaacatcgatgacttctgccgtcgctggggcagcaactacagctacatggtggtgctggatgccgatagcgtcatgagcggagagtgtctcaccggtctggtacgcatgatggatgccaacccgaatgccgggatcatccagtcgtcgccgaaagcatcgggtatggatacgctttatgcgcgctgtcagcagtttgcgacccgcgtctacggtccgttatttaccgccggtctgcacttctggcagctgggcgagtctcactactggggtcacaacgccattatccgcgtgaaaccctttattgagcactgtgccctggcaccgttaccgggagagggctcctttgcgggttcaatcatgtcgcatgacttcgtagaagctgcgctgatgcgtcgtgccggttggggcgtctggattgcctatgacctgccgggatcctatgaagaactgccaccgaacctgctggatgagctgaaacgtgaccgccgctggtgtcacggcaacctgatgaacttccgcctgttcctggtgaaagggatgcacccggtacaccgtgcggtgttcctgacgggtgtgatgtcctacctctcggctccgctatggtttatgttcctggcgctctccactgccctgcaggtagtgcatacgctgatggaaccgacctacttcctgcaaccgcggcagctcttcccggtctggccgcagtggcgtccggagctggcgatagcgctgttctcgaccaccatggtgctgctgttcctgccgaaaatgctgagtgtcgtgttgatctggtttaaaggatcgaaggcctacggcggacctctgcggctgctggcttcactggtgctggaaacgctgttctcggtgctgctggcaccagtgcgtatgctgttccatacggtgtttgtggtcagcgccttcctcggctgggaagtggtgtggaactcaccgcagcgtgatgacgatgcaacaccgtggagcgaggcgtttaaacgtcacggtttcgcagatggcattgggtctggtgtgggcgattggtatgggactgctggatcttaacttcctgtggtggctggcaccgatcgtgttctcactgattctgtcgccgtttgtctcggtcatgtcgagccgcgcaacgctgggcattaagagcaagaaagcgaagctgttcctgatcccggaagagtactcgccgccgcaggagctggtggataccgatcgctatgtggtgctgaaccgtgagcgcgcgctggaaaatggctttatgcatgccttattccatcctgctttcaacgcgctggcaacggcactggccacatcgcgccacaagcagagtcagttactggactatgcgcgtgaccgtcgggttgatcaggcgctgagcgatgcgccggataaactgggccgcgaacagcgtctgcagttgatcagcgatccggtggtgctggcccgtgttcatacccgactgtgggaagatgcggacaagtatcatcagtgggttgagagttatcaaaaactcacgctcaaccccaacgcgctggcaaacaacgcgtaatctgaaaaagcggcagcgatgccgctttttttatcggattaaaacagcgattcgctgataaatttattgctggcagtcaccgcgagcagcgcgtgacgatctcaatggctgtttcttcatggcggatatgtgtggtgaaagggtgcttaaaggcgggtgttatcgtcgcggctgtgctctgcttaagcggatgcggcagtattatcagccgtaccattccagggcaggggcacggtaatcagtactatcccggcgtacagtgggatgttcgcgacagcggatggcgggtcctgacgatcctcgacctgccgctgtcgctggtggttgataccctgttgttaccggtggatgccagccacggtccttacgagtaactgcgatcggaatcgctgttatcatcttcccactcttgcgcggcggcttcaccctcttcggtgtccagcggcggctccagctggaactcgccgtcatcccactcgtgcagggtattttctgctaaccactcctgacgtagttcaacttcgtcaaaatctgcatcaaaaatggcctgtgccgcttcaccgctacggtaaggcagacattcgcctgcttcaccttcttctgccatgaattcagcctgccacatgatatcgccatcctgcatcacatacttttgcagaccaaactggctgattgatgcatccccttcctcgagctccgggtggttagcgaggaaactcttcacgtgcagcatcgatggcttcctctaaggtactgtacatgctcatcgctcttctccttcacgggtctttgactatggatttatttgatttcagtgaaggatagacgaaatctgaaggagggaaaggtcaggccggtgcaactggcgggaaataagccatttcccgccagtcagggtcagatcatcttttgcgggaaatgcaaaacaggttgaacggactcatgaatcacgggggctgagtagcggatacaacattttatacatggcttaactttcttaaaattaattctggcgatggagagggcctgactcagattatataacgtgccgataaatatgacctcttctttatcaggcatacgcttgcaccctttacgatgaagaaagtgataattttcctgatcggtaccgattgtaacgtaatagtagagacctttgttcatattaactgtcccattagaggtttgctgtgttgtcttttttataattctggccagagccgttaaaggcctgactgttacaaaagaaactaccgataagcattaatgagttcaaattccataatggtctatcggggtgttaaaaaaatgtaaaatggaatataagctaaatcagcaaggcaatcgcttgtaaaataagttaatttttatcgattcataagcggtgagacaccgttaagaccggctaaataggattaggcctggcgtgcagaataatcagcgccataacagatttaatagcactcgctgcaatattaattaataaatagcgaaacaggctgaatgccgcctgccgtcctgttaattgattagcttttttaaatttaaacagagacaaattatattatgaatataggtgtttattaattactggacctgcggtttcgcttacaggctgagtcagccatgagtgatttatttagcaggggagtaaaacgcgctaaatgcctgacagacatttagcgcgaacagattaataacgggagggtttcgccctcggggcgcgttttaaagcggcggtggagccacatatactgttcaggtgccagcagcacaccctcttcaacaacctgattcattctggttgcggttgcgacatcactttccagcgtaaattcgccgctgatgtcaggcagtatcatcagttcatagccacgacccccaggcagacgacgcggtacgaaagggatgacagccggtttaccggtgcggatcagcagatgagtgcccaccgttgtggctgctttttccacgccaaagaaggggacaaagacgctgctgcgcgggccataatcgtggtcgggcgcataccagataatgtcaccctgtttcagtgcgcggatcattcctttgagatctttacgatcgagcatgcttttattcgaccgcattcgacctttgacctgaagccagtcgatcagtttgttgtcattcgggcgatagacgccaatgccagggttatggataccaaacatgcgtgcaccaatctccagcgtcagaaagtgcatgccgataagcagcacgccgcgctggctatcgcgcgcctgctgaatatgctccagccctgaaggcgtatgccatttattgatgcgccagtcaggccagaaccacgccataccggtctcaattaatcccatgccgaccgattcgaaattgtgtttaaccatcgcttcgcgttcatttaccggcatatccggaaaacttaattccagattacgccgggaaatactgacgcggtgtttcataaaacgcatcccaatgcggccaatattacagccgagaacataaagcaggggataaggaagtagcaccaaaagataaagagaagcgacacccagccaggtcagccaatagcgcgggtgaagcagttctcgtgaaaactgaggcaactgagtcatgtgaaggttaattttcctgcgtcgcgcaccgtgcggtgctgatatctcgttgatttacaccattgtgccagtttttgacgtgcgcttaaatatcactatcggaacgtgccatcaatgaacaaaggttaatagtccaatgttgctggaaaaaacggcaacaggcgatcaatctggtcactggcctttgcatcccggtgaaatcaggtatcatgtgcgcgctaaatttcttctattgataacaggacgaacaccatgccagtgttacataacctcgtttccaataaagagctgaaggcgcgcatgctggctgaaaccgagccgcgcaccactgtctctttttataaatatttccagattgccgatcccaaagcattccgtgacgcgctctatcttggcctgacagctcttaaggtctttggtcgcgtctacgtggcccacgaaggcatcaatgcgcagatcagcgtgccagccagccagtatgaaaagatgaaagaatggctgtatggctttgatccggcgctgaacaacctgcggatgaatattgcgctggatgatgatggtaaatcgttctgggtgctgcgtctgaaagtgcgcgaccgcattgtcgcggacggtattgaagacgacagttttgatgccagcgatgtgggtcagtatcttaaagcggcggacgtaaacgccatgctggacgatcctgacgccctgtttcgtggatatgcgtaaccactacgaatatgaagtgggtcgctttgataatgcgctggaagtgcctgctgacaccttccgcgatcagctgccgatggcggttgagatgctgcaggatcagaaagacaaaaagatcgtgatgtactgcaccggcgggatccgctgtgaaaaggccagcgcctggatgcgccacaacggctttgaggatgtctatcacattgagggcggtatcatcgagtatgcccgacgcgcccgtgagcagggattaccggtacgctttaaaggcaaaaactttgtttttgatgagcggatgggtgagcggatctctgacgatgtgttgtcgaactgtcatcagtgcggcgaaccctgtgatacccacgttaattgtgtcaatgacggttgtcatctgctgtttattcagtgcaaaagctgcgcggagaagtttgagaactgctgtagcccgatctgccaggaagaggcgaagctctcaccggaagagcagcgcgcgcgtcgggcaggacgtgaaaatggcaacaagatctttaacaagtcgcgtggcctgttaaacatgaccattccctcgccgctgaagaaataagcgtggccgcctgaagtcagcttcaggcggcttgctgttttactggcgtacaccctcaaccgagatcatcagctgaaccttctgcgaagctggccccagatctttagtgatgttgaaatctttcagtgcaatttccccttcagcctcaaagccagcgcggtagccgccccaaggatctttaccttcacccagcattttcgcctcgagcgttaccggtttggtcacgccattcagcgtaagatcgccagtaatcttcagctcatcaccctcttttttcaccgctgtggatttgaacgtggcctgcgggtttttgctggtgttcaggaagtccgcactgcgcaggtgcttgtcacgttcagcatggttagtatcgatgctgctggtgttaatggtgacgtcgactttatctgcggcaggattcttctcatcaaaggtgaagcggccatcaaaatccttaaaggtgccgtagagccagctgtaacccagatgctggatacggaactgaataaaggcgtgctggccctctttatcgattttgtagtcagcggcagaggcggtgagtgagccgagtagcagactggcaccggtcatcgccagcagggtctttttaaacatattatttatccttttcagagggagaggtgaaacgcaaacccgacatccgttttaaagtgatatcgcgatcgataaagtgatgttttaccgcagccagcccatgcagcagtgacaggaccacaaccgtccaggccagccagaggtgaatgtcgcctgcaagatcagcctgtttcgccagcaccgttgaacagcgcgggcagggtaaaccagctgaatactgagatgggtttgccatcggcggtggagatcagatagccgctgatcagaatcgccagcagcagggtatacagtaacaggtgggccaccaccgaactgatgcgtaccagcggggaataactgctaagcggttttggcggcggtgaaataatgcgccacagcaggcgaacgatcagcgttagcaacaggatcacgccgatgcttttatggatctcaggcgcgtcgtgataccagctgtcgtaatagccgaggccgaccatccataatcccagcgcaaacatggcgtaaatcgccagcgccatcgaccagtgcagcagcacggcaaccaggccaaactgatgagatgaattacgtaataacataatggggttttcatgaagtaataatctgaaataagcatccacattatgaaatataaaagcaatcatccttacgcttctataactttaattttatattgtgaaaaggttgaataaatcaggtgcgaaatgcgcaatattactgaatgagttatttctgaggcgctggtcgtcaactaaaaagagccggaatttaccaaaagggcgaaatatattctgactttatgtcagtaatagtcaattttcgtcaaagtctgtcaatcgggcggcatcaggctgataccaccctttatcagagtcagaaacgtgagaggcggaagggtgtcagatcaaaagagaacggtttttgctgggcaaattctgcagccagttcgcccaatacgctggcgaatttaaacccgtgtccactgagcccggtaattaacaagcggtctggttcacccggcagggtatcaattataaagtcctcatccgggctaaaatcgtagctgcaggcttcgccatgcaggcagacaccgacgccaggtaaaaactgacgcaggaatccaaaagcttcactgccatcggccgccaccgcgccaaaaggtttacgatcctcaggctgctgcatcaactgaccgccatcatgacgacccactttcagggcgtagttatccgccgggaagccataaaactggctgccatcgcccatttccaccgtaaaaccgggaaacttattgttctcactgtagcggccatctgcctgataccaggcaaacaccttgcgggtgggggcgaccggcaggtcaggaactaatttgccaacccaggtgcccgcactgatcaacattttgcggccccgatagacgccatccagggtagtgacctgctgcagatcgccatcgcgacccagctctgaaaccgggcagttaaacagctgcgcgcagcccgcctgctccgccagctggatccagctgcgtaccgcctgttcacatttcagatagccggactgcggctcaaatacgcccagatagccctcaggcacattgatttgtggccagcgcttgcgcacctcatctggctgcatcacctcaatattgagctgccagcgggtcgcgctgtcgatgacgtttctgaataaacggcgactgattcggggcgaggttaagtacgccgctgcgatgcatgatgcgctcaccggcacgctgttccagctcatcccacagcgtttgcgcccgcaggaccaggggaacatagcgttcaccttcaccataggcgtgacgaatcagccggctctcgccatgatgtgtgccctgattatggggaggatgggcgctgtcgatcattaacaccgataaacccgcctgggtggcatagtagcctgccgccgcgcccacggaaccgctgccaacgacgataagatcataaatcatggtaactacgctctaagagacagataatcaaaagcataccagaaacagaaacgaaaaaggcacccctgagggcgcctctttgatgcggcagaaattaatgctttttgaggagtcgttctatctgctcggctgattctatcttggcgatgcctgcttcgaggatcgagataaattgccttgccacatccgttgtcagccagtatgtcgggccaacatccgcttcttcttctttttgatcctgcgacgacaacgagtgcaggcggatcatcatggcgtcatagctgtcaacggtactgatatcccagcccaccagtgggtgagtctgtataacatcttttcttctgtccattataacctccttattactcgttaaacgaagtgcatgatgaggttcaatgcggcttttttattccaatagcgaaacaattataacagtaaacgagggtatcactgtttaaaaaatgccgtgagtcagcttctcacagaatatttgcgtttgaaaggcgggcgtaaaaaaataaaatgcctgacgggcaggcatttttatcagcagtcaaaagacaggcaaaaagcgggcttagccgcgtgagcggactcagagagccggcgtttctggcactacgccgccgccgcgtttttgcagtgtttctgccagacgggcaaagtgctgctgaagctgctcatcatggttttgattttgggcttccagcgacagattgtgtaccagtagctgactggcacgatcgtcaagacagaaaatcagactggaaaaggcattttccagcaccgttaaacgacgcttctgatcaccaatcagtgctaacaactcaccaaaggtcatcgcctcttccggtttatcagtagtcatggtgtcgcacctcctgttatgcgtgacgagcgcaaggatagggcattgatcattaagagtctagatgcaggacggggtaagtgcgagaggggagaaaagataaaaaaaccgggtggcgacacccggaaaaaaagcacagtggcggttaatcagtattgaaccagtcgtcagcgctttcccacgtctgctgcaggatctcgctgatctggtcgcgcgtctcttttccaccgcccagcacgctgagattattggcactggcataacgtaccttgacgtgattggtcgagtcagggaactgttcatcaatgcggcgcgataattcatcgctcaacgcttctatcgcgccagcaggaagaggtcgggtatttgatacggtaatttcaacgcgcataacagcctccgtttaagatactgtatatatttacagtatcggcaggccggaggcaagtaaaattatgcgatgcgccagttcagtgtttcacccgccaggaacggcaccagtgaatggctgccgagcgcgatggactctggcacctgccaggactcacgcaccaaagtaatcgtcccttcattcagcggcaggccgtaaaaacgcgggccattctccgaacagaacgcttcaaaatgttccagcgcgttcagctcttcaaaaacggtggcgtaagcgggtaacgacactggcgcattaaatacccccgcgcagccgcaactggcctctttgagatgacgcagatgcggtgctgtgtcggtgccgaggaagacgcgcggatgaccactcgcaactaatttgcgcaatgcttcctgatgcacgttgcgtttaagaatcggcaggcaatagaggtgcggacgaataccgcccaccagcatgtgattgcggttaaacatcaaatgctgcggggtaatggtcgcgcccagcgtctcatcggcggcggcaacatattctgcggcgtcctgagtggtaatgtgctccatcactactttcagtgccggaaactggctgcgcagcggcaccataaccgtttcgataaaccgggcttcgcggtcaaaaatgtcgacatgcgcatcggtgacttcgccgtggatcagcagtggcataccgagcttctgcatccgctccagcacgcgggcaatggaggcgatatcggtaacgccatggctggagtttcgtcgtagcgtgcgccggatagagcttagccgcggtaaacagaccggaggtgaaaccgcgctcaagctcatcaggatcaagcgagtcggtcagatagcaggtcatcagcggcgtaaaggcgtgatcggcgggcagcgccgccaggatgcgatcgcggtacgcttcacctgctgccacgctggtcaccggtggcaccaggttaggcatcacaatggcacgaccattcaccgcgctggtatagggcaggaccgtgttgagcatctcatcgtcgcgcagatgaatatgccagtcgtcagggcgacgcagggtaagttgctgaggttgtgctgtcatcagtgaagctccggcagaagggaaacaaaaggcgtgttttggccggggtctaagcataaggattcaggcaaccgtttgcacctgctttttatgctgataaagaaaatccgctgcccaacagggtaatgctggtcagttaagattagatttgtaaaggctgtcacggtcaaacgtggcagcttttttccgggcgagcgagccgcagtgcgggccagagcacctctgctgctgccgggccgtcctcgcgccgctcacgcggtaccttcggctttgacgtcgtgccgacgaaccgttcggggatgggccctccctggccggccccgaactgtccacgcttcccggcgtggacttctggcccaccgtcacgcctcagcgctgcggatagccctttcagcagcagaggcgcgaggaccgccagcccctgagcggcaccagactgcgttgtcacctgtcgcttaactgactggcattactgcgtaaagggaataaccagttcgccaggtttcacttctagtcctttggcaaatttcttcgccagcgactcgcctttgctgcggtcggcgctgagcacgtaagccggcttttgatcaaagtagtttttcagcgactgattcagataaggcgtcagcgttttcataatggaggccattttttccggagcaacctgcgcatcaacaatttccagatcgcgcagatagattgcaccctgctgctggtcatagaccggctgagcacgcatcttcagttgcatatcggcctgctgcggaccaaacagtgacgtcacattgattttagcattgccagagagcgtcactttacctggctcttcacggccaatctgactggtcaggttgttcaggacgatgtgcgcattaaccagccccgaaacgccaatatctttctcatagttgttgtgcttctgcagcgcctggtttacttcctgttcgctgatggtgtattgcgtcagttgattacagccgctcaccagcagcgcgatcaacagggcagtcagcccgaaaaaagcctttttcatcgatctttatcctgaatatcagagccaataaacaggccatagcctgcctgaatgcgtagcgggtgtcatcaggaaagagatgagaaacgccgcagcgtctctcatcgggaggggttagtgagctatcgaggagagcagattcacctgggtctgtttagcaatgttatcgcggtagtcagcgacccggctcggccagtcgattcctgccaccagcgtcagagagcgcagcagcgggaagagattaaaatcatcttcggacagctcgccattcaccgcattgggctggacgattaatttgtccagcttgcgcagatcgtcgctgacgtttttaatcaggccggcagaatgacttttcagcgtgtcgaaatcaccgatgctcgcctgctttttgttgcggaaatagtcacgcgcctcaggcgtcgcgaattcggcaaacgccgcctctgcaatgcgcggcagcagcagtttattgacatagctgttcatgtgacgcagccagtcgccgatcgccggatttagcgcgccgatgatcagcggttcgccatcctgctgatcgacatagtgtacgatctccatactttcaggcatcgcgctgccatcctgcttctgcagaatgggcgccattttctgtccgatcagtcgtttcggcgtctcttcatcgtcgttgagcattaccaccagctcaaccggtttgtttttcaggccaaaaatcattcgcgctttaacgcagaaagggcagtggtcgtagatatagagcttcatcctgatctcccggattttacaggtttagtgtttaacagagtgaatcaattcatcctgctttcgggctcgtaaaaagtatggaagagattaccccacagggcaaacctgcctgtcaggcgcgctgcaggatccgctggtgatgccgcctgcagcaggggttatccgcggtgcgacccgagcaaaatcatcctctttatcgctaaaccgctgtaacgttttaccgcagcccaggcggcggttatagtgaaagccgggtaatgacggctcatctctatcagccattgatttcaggagtcaggatgtttggctatcgttctgccgcgcccagggtgcgattaaccaccgatcggctggtggtccgtctggttcacgagcgtgatgcctggcgaatggcagattactacgcggaaaaccgcctgtttttaaaaccgtgggagccggtgcgtgatgacagccactgctacccttcgggctggcaggcgcggcttgggctgatttccgacatgcataagcagggttcggccttctatttcattttaatggacagcgatgaaaccgaagtgaggggagtggcgaacttcagcaacgtgttacgcggatcctttcatgcctgttatctcggctattcactgggtgaaaagtggcaggggcaggggttcatgttcgaagcgttgcaggtggcaatccgctatatgcagcgccagcagcatattcaccgcatcatggctaactacatgccgcacaaccagcgcagcggcgatctgctggcgcgactcggttttgagaaagagggttacgcgaaagattatctcctgatcgacggacgctggcaggatcacgtgctgacagccttaaccctgcgggaatggacgcctgaccggcgtggataataatgaggatgcgagcatgaagatgactttatcggcgcaggcgatgcgcgtgctgggctgcctgctggagaagcaggtcaccacgccggaacagtatccgctgtcactgaatggcgtggtggtggcctgtaaccagaaatcgaaccgcgagccggtgatggagctgagcgaaagtgaggtgcaggatcagctcgatcagctggaaaaacggcatctgatcaccgccagcagcgcagccgggcagcgggtcgtgaaatatgagcagcgtttctgcaactccgcgtttggcacgctaaagcttaacagcgcagaagtcgctctgttgacgctgctgttactgcgcgggccccagacgccaggcgaactgcgtacccgcagcggccgtctgcacgagttcagtgatgtcagcgaagttgagcaaacgctggaaggattgatgcagcgcgacgacagtgctcaggtgatccgtctgtcgcgtgaacctggcaagcgcgaaagccgctttatgcatctgctgggcgatgagcctgaccagccgcaggccgcagacgcgtcggaagagcagggcgaactggcggcgcgcgtcgcaacgctggaacagcaggttgcagcgcttcaggcacaactcacccaactgctgcaaccggagagctgagatgaccttacgtattggcatggtgggattaggcggtatcgcgcagaaagcctggctgccggtgctgtcggcggcgacggactggaccctggcaggggcgttttccccgaaccaggccaaagcccggccggtctgtgacagctatcgcatgccatattttggttcgctgaatgaattagccgctgcctgcgacgcggtctttgtccacagcagcaccgccacgcactatgaagtggtcagggcgctgctgctggcaggaaaggatgtctgcgtcgataagccgctggctgaaaccctggaacaggctgaggcgctggtggcgctggcggaaaaacggcagcgtaaactgatggtggcgtttaaccggcggtttgccccgcgctatcagcagctgcgggcggagatggcggacgccgcttctctgcggattgaaaagcaccgtagcgacagcgtcgggccacaggatctccgctttaccctgctcgatgactatctgcatgtggtggataccgccctctggctgggcgggaaaccctttcgccaggttcagggacgcatcgacaccaacgaacaggggcagatgctctatgccgagcaccatttcgctgttgagggattgtcgattaccaccagcatgcaccggcgcgcaggcagtcagcgcgagcgggtcagcgcagtgtgtgacggtaaatgcatcgacattagtgagatgcgcgactggcaggaagaacggcgtgacgggctgctgattacgccaccgcccgcctggcagagtcatctgacccagcgcggcttcagcggtgcggctcgccatttcatcgactgcgtacaaaatcagacgaagcctgaaaccagcggtgagcaggcgctgatggcgcagcgtgtggtggaaaaattgtggcgtgaggcgacgcaggaataacgccttgtaacactccgtgctggtcatttccctccgtggcagtagactgtcgccgggcatcttctgggtgcccgcgctaattctccttttttgccgattcttttcaggatgcgccgtcaattatgaatttgttgaaatcgctggcagcggtcagttctatgaccctgttttcccgcgtactgggctttgcccgtgatgccatcgtggcgcgggtgtttggcgccggaatggcgaccgatgcgttctttgttgcgtttaaacttcccaatctgctgcggcgtatttttgctgaaggcgccttttctcaggccttcgtgcccattctggctgaatataaaagcaagcagggcgaagaggcaacgaaactgttcctggcttacgtctcgggcctgctgacgctggcgctggcgctggtcacggtggcgggcatgattgctgcgccctgggtcatcatggtgacggcacccggctttgccgacagtcccgataagtttgcgctcaccagctcgctgctgcgggtgacctttccctacattatgctgatttcgctggcgtcactggcgggtgcggtgctgaacacctggaaccgcttctcggtaccggcctttgcaccgaccctgctgaacgtcagcatgattggctttgcgctgtttgccgcgccgcacttccacccaccggtaatggcgctggcctgggccgtcgtggctggcggcgtgctgcaactcggctatcagctgccacacctgaagaaactcgggatgctggtgctgccacgcctgaatctgcgtgatgcgggcgtctggcgggtcatgcgtcagatgggacctgccattctgggcgtttctgtcagtcagatctcgctgatcatcaataccatcttcgcctcgtttctggtctcaggttcggtctcctggatgtactacgcggaccgcctgatggagttcccctcgggtgtgctgggcgtggcgctgggcaccattctgctgccgtcgctggccaaaagttttgccagcggcaaccatgatgaatattcccggctgatggactggggtctgcgcctctgttttctgctggcgcttcccagcgcggtggcgctgggcatgctctccggcccgctgaccgtggcgctgttccagtacggcaaattcactgcctttgatgctctgatgacgcagcgcgccctgatcgcctactccgtcggactgatggggctgatcgtggtcaaggtgctggctccgggcttctattcccgtcaggacatcaaaacgccggttaaaatcgcgattatcactctgatcatgacgcaggtaatgaacctggcgtttattggtccgctgaaacacgccggtctgtcactgtcgattgggctggcagcctgtctgaatgcgtctttgctctactggcagctgcgtaagaagaatatctttatgccgcagccaggctggagcagcttcctgatccgcctgctgatagccgtagtggtgatggcaggcgcgctgtttgccatgctgcagtggatgccagcctgggagcagggatcgatgctgtggcggctgctgcgtctggccgcagtctgtggtgtgggcggcggggcttacttcctggcgctgggaatgctgggcttccggctgcgcgactatgcgcgtcgcaccgctgtgtaaagcttgccgcaataaataaattcaacgcgcagggaacaggggcagaggaggaaagcgtcccgcgccatggacaaaaacgccgggagcgtttttgaacaacgcaacgcgttggcccggcaacgggcgcacctcagggatgaggtgcgtaatcgcgcgggccgagcggccagggattggctttagcgtctttccgatctgcccctgttccctgtgcaggctcaattttaaagctcatcatggtgaaggaaaaaacgcaccaataaaaaatcccgcaccaggcgggattttttttcgctaatttccggttcaggctttgcgacttaacgtcgcctggcctttacccatcccatccgggccgtaaaaggcctgggtctgatgcggcttcagcacgtcaagcgcatcctgggtgtagcggatctggtgttgcagcagcaggccgttatgaacattggcatcctgcagacgacggctatgctgctggatagtgtcccagcggcgcgccatgtcgttctgaccacgataaggtgccgatgtcgcctgactctgctcagcggtgcggcgcatctcatccagatagttcagcgtactgagcagcgcgcttttatcttcggtaatacgctgcaacagattactgttaatgtttccggctgccagttgctgctgctcttcttccagcacggctgagagcgacgccagcacgtcctgcatcttatctaaggtggtctgcaaattactcatgggaactaattaccctctaaatacgccttggtgtcggcaatcagcgcatcggcgattttgccggtatccatcttcagttcgccattacgaatggcggttttcagttgttcaacgcgctcgacgttaatatctttgctgctcggctgcatcagctgcgactgcgcgctgctcaggctgacctgggctgctgcaggggtcgtggctgctgccaccgggctggcgctctggcgcactttgctgctgccggactcactgctatcgcggctctgtacggtgctggcgggtttcagaggttgcgttctgtcaatgctcatgttcgggctcctgtacggtcaggggaagtctgccacctgaatcagaatagcgttatcgcttcgttgattcttctatcggcagcactactggcttctttaacactttacagcgttataagaatattcccatcctcgcgtaccttaccgctgacaatctggccatttcccatcctgacccggaccgactgcgatcgggcggcgttattcagcgccttgccctcaccgctggcgtcaaagccgtcaccgctggcaatcaccatcacattctgacccgccttcacacgccacggctgacgcagcgtggagggattaatcggctgtcctggctggatatcgcgcagcaccacggcgtctgcgaccgagtccgcattcagcagggcgcgggcaggcagagtatcaaggcggccggtctgcagagtgaaatcactctcgctcacgctactgccctggctcagcagccggttcgccaccagataggaaccggtgacctgcacctgtacctgaatataacggcggttctcaccacagtttgccgccacgctcatattgccccacaaccggctgttgccgggcagggtgaactgtggtgcctcacaggctggccactgttcctgcggtgtgcgtaccaccacgaccatgccatcagcatgctgggcgtcacgcgctttaaaaaattgattcagttgtgcattgagatccccggcggaaaccggcagggcgatcgcgaccagcaggctggtcagcagggtcagatatcgacgcattgtgcatttcctcactgatgatggcgacgagtgtaccccttaagaaaaatccttaattgtcaaaatagcggtcatttgaggccttattcagacgatgaccccttgcattttcaaattaagctgcgagctcgaaattctcatacgcggaggaaacatgctcgacaaactggatgcggcgctgaaatttggtacggaggccctcaacctgcgtgctcaacgtcaggagatcctggcgtcaaatattgccaacgccgatacccctggttatcaggcccgggatatcgactttgccagcgagctgagtcgggtgatgtccaatggtcgtgcggaaggcagcagcatggcgttaaaagtcacgtcagctcgccacattgaagcacagacaaacggcgtgccatcgatggatatgctttatcgcattcctgaccagccttctgccgacggcaacaccgtagatatggaccgtgagcgtacgcagttcgcggataacagcctgaaatatcaaaccgacctcaccctcatcagtagccagatcaaaggcatgatgagcgtgttacaaggacaataattatggccttgctgaatatttttgacattgccggttcagcgatgaccgcgcaatcacagcgattaaacgtcagtgccagtaacctggcgaaacgccgacagcgtcaccggccccgatggcaagccttacgtggcaaagcaggtggttttccagaccgatgcggcgccaggctcagccaccggcggcgtgaaagtggcaagagtcgtggatgaccctacacctgccaagctggtctatgacccgggcaatccgatggcagatgccaaaggctacgtgaagatgccgaacgtggatgtggtctctgaaagcgtcaacaccatgtcggcgtcacgcagttaccaggccaacgtcgaagtgctcaacaccgtgaagtcgatgatgatgaaaaccctgacgatcgggcaataacggagaaaaattatggctatcgcggtaggcgttaacgaaagactggaccccacggtccttagctcctctaacaccagtggcaccggcaacaatgcgcaggatctgcagaatcagttcctgaccatgctggtgacgcagttaaagaaccaggatcccaccaatccaatggataacagccagctcaccacgcagctggcacagatcaataccctgagcggcattgaaaaactgaataccacgctgggatcgatctccggccagatcagcaccagccagtcgctgcagagctccacgctgattgggcatggcgtgatggtcaatggcggacaggttctggtaggcaacggcaccacaacgccatttggcgttgagctggcctccgcctcaaccggcacatcggccaccattaaagatgccagtggcacggtgatcgacaccgtcgatctgggcgcgctgagcgctggcgtgcacaccttctcgtgggacggcaagctgacagatggctctgtcgctccggatggtaaatacagcgttgcgattgccgcaagcaatggcaacacacaactggtggcacaaccgcttaactacgcctacgtcaatggggtgagtactgcgaacaacaccacaaaactggatctcggcaccatgggctccgccacccttgacgacgtacgtcagattctctgattaacctgtagacaggaaacaaacacatgtcattttcccaagcggtcagcggccttggtgctgcttcaagtaaccttgatgtcatcggtaacaacattgccaactccgccactgcgggctttaaatcgagcaccatcgcgtttgccgatatgtttgccggttctaacgtcggcctcggtaccaaagttgctgcggtaatccagaactttaacgacggcgccaccaccacgaccagccgtggcctggacgttgcgctgagcggtaacggtttcttccgtatgaccgacagcagcggcggcgtcttctattcacgcaatggtcagttaacgctggatgccaaccgtaacctggtcaacacccagggtctgaacgtgaccggctatccggccagcggttcaccggccactatccaggcaggtgctaacccggtggcgctgcgtattcctaccgagcagatgtcagcccgtgcgaccactaccgccggtctggttgccaacctgaactcaacggacaaaacgccatctgtggccaccttctcgacggcgaaacgcagacagctacaacaagaaaaccacggcaaccgtgttcgactcgcagggtaatgaccacgcgctcgacatgtatttcgtgaaagacaccaccagcaacagctggaccgtgcgtaccattgatggcaacaccggcagttcagcgggtgacttcagaatggcgtttgacaccagcggtaagctgaccagcgtctctaagctggatgccaccggcgctgtcgtcagcacgacgaccgatggcaccgtcggcctgacgctgaacgtgggcggagcgaatggcgcagtcgccaatcagccaatcaacctgagcatgctgggcagcctgcagcagaacaccggcagcaccacctttggcagcccgacccaggatggttatgcacctggcgatctgaccagctacgcgatcaatgatgacggcaccatcaccggcagctattcaaaccagaaaacccagctgctgggtcagattgtcctggcgagcttctctaacccggaaggtctgcagtctcagggcgacaacgtctggtctgcgtcaagtgcatccggtcaggcagcaatcggtctggcgaataccggcacctttggttcactgacggctggcgcactggaatcttccaacgtcgacatgagtaaagagctggtgaacatgatcgtcgcgcaacgtaactatcaggcgaatgcgcagaccatcaaaactcaggaccagattctcaacacgctggttaacttacgttaattcgctaacaggattgccatatggatcacgcgatatataccgcgatgggcgcggccagccagacgctggatcagcaggcggttaccgccagcaacctcgccaacgcctctacaccgggttttcgtgcgcagctgaatgcgctgcgcgccgtgccggtgagtggctggtcgctgccaacccgtacgctggtcgccgcctcgacaccgggcgccgacatgagtcagggcgcgatggattacaccgagcgtccgctcgatgtggcggtgcagcaggatggctggctggcggtgcgtaccgctgacggcagcgaagcctatacccgcaacggcaatatgcaaatcagtccgaccggtacgctgacggttcagggcaatcctgtgatgggcgatggcggtccgattgtgatcccgcagggcactgaaatcaccattgcagccgacggctcgatcaccgggctgaatgccggtgattcaccgaacgccacggttcagctgggcaagctgaagctggtcagggcaaccgggcaggagctgcagcgcagtgatgacggcatgttccggcctactgcgtcggcgcaggcgacccgcggtgccgcgctgcaggctgatgccaccatgcaggtgatgcctggcgtgctggaaggcagcaacgtcaaaccggtagaaaccatggttgatatgatcgccaacgcccgacgttttgagatgcagatgaaagtcatcaccaacgtcgacgaaaatgaacaaaaagccaaccagctcctgagcatgggttaaggcacgaggataacaacatgattcgttctttatggatcgctaagaccggtcttgatgcgcagcagatgaacatggacgtcattgccaacaacctggcaaacgtcagcaccaacggctttaagcgttcacgtgccgtgttcgaagatctgatgtaccagactatgcgccagccgggcacccagtcatctgaacagacaacgctgccatcgggtttgcagatcggtaccggtgtacgtccggtgaccactgaacgtctgcatacgcagggcaacctgtcgcagaccagcaactcaaaagatatcgccattaacggccagggttattttcagattcagatgccggatggcacctctgcttatacccgtgacggcgcgttccaggttgatcagaacggccagctggtgaccaactccggtttcccggtacagccaggcattaccattccggctaacgccaccagcattacggtgtcgcgtgacggtgtggtcagcgtaacgcagcagggacaggcccaggccgcgcaggtcggtcagttaaccctgagcacctttatgaatgacgccggtctcgatagcgtgggtgaaaacctctacaaggaaacgcaggcatcgggcgctccgacagacagcacgccaggccagaacggcgcgggcctgctctatcagggctataccgaaacctcgaacgttaacgtggcggaagagctggtcaccatgatccagacgcagcgcgcttacgaaatcaacagcaaggcgatcagtacctctgatcagatgctggcgaaattaactcagctttaatcccgaacagggccagcccgtgctggcctgaatgacagacattaataaggtcgtgacgccgtggcgaagcaacagattctcaagcctggacattggttagtcgcctcgttgctgctaactctcaacggatgtgccctggtcccgcgtaccccgctggtcgaaggtgcaactacagcgcaaccaatgccgtccgcgccaccggtggtcaacggctctatattccagggcgtcgcgccgcttaactacggctatcagccgctgtttgaggatcgccgtccacgcaacattggcgataccctgaccattacgctgcaggaaaacgtcagcgccagcaagagctcctcagccaatgccagccgcgatggcagcaacagctttggtgtgagcgctgtgccgaccggtctggcaggcctggtgggtgcaggtggtgaaaaagccaacctcagcgccgaaggcaaaaacgatttcgcaggtaaaggcggcgcatccgccaataacacctttaccggcaccattaccgtcaccgtggatcaggtgttgtcaaacggcaacctgcacgtggtcggtgaaaaacagatcgccattaatcagggcacggagttcattcgcttctcgggcgtggtcaacccacgcaccatcagcgccagtaacgccgtgttatctaccgctgtcgccgatgcacgtattgagtacgtcggaaatggttacatcaatgaggcgcagaccatgggttggttccagcgtttcttcctgaacatctcgccgatgtaagaggtttcaatgaaaaagttaacgctgttacgcgccgggctggcgctgctgctgggcgtcagcctgctggcaaaagccgatttgattcgtgatttaaccacggtacagggcgttcgtgataaccagctgctgggctacggcctggtcgtgggcctggatggcaccggtgaccagaccacccagacgccatttactacccagacagtgagcaacatgctgtcgcagcttggtattaccgttcccaccggaaccaacatgcagctgaagaacgtggcggccgtgatggtcaccgctaaactgccctcgtttgcccgtcagggacagaacctggatgtggtggtctcgtcgctgggtaacgccaaaagcctgcgcggcggcacgctgttaatgacgccgatgaaaggggtcgataaccaggtttatgcgctggcgcagggtaatatcctggtcggtggcgcgggtgcgtcagcgggcggcagcagtgttcaggttaaccagctgaacggaggccgtattaccggcggtgcaaccgttgagcgtgaactgcagagcaactttggtacgcagaacaccattaacctgcagcttaacagcgaagatttctcaatggcgcagcggattgctgatgccattaacgcccgtggcggttacggcgcagcgcagccgctggatgcccgtaccgtgcagatccgcgtatcgcctaataatggtgcgcaggtgcgtctgctggctgagatccagaacattaatgtgtctatcccggttgaagatgccaaagtcatcatcaactcccgtaccggttcggtggtaatgaaccgtgaagtgacgctgaatcagtgtgcggtcgcgcagggcaatctgtcggtgacggttaaccagcagcagaaacgtcagtcagcctgatactccacttgccggtggtcagacggtggcgactacgcagactcagatcgatctgcgccagaccggcggtgcgctgcaacgcgtcaacgccagcgccaacctgaacaacgtggtgcgtgcgctgaatgcgctgggtgcgtcacctatcgaactgatgtcgattctgcagtcgatgcagagtgccggctgtctgcgtgccaaactggaaattatctgatggctgatatgcaatctctgacgagttcggctttcgacagccgttccctgaatgaactgaaacgccaggccagcaacgatccgaaaggacaagcgttgcaggtggcgcgtcaggtcgaagggatgtttgtacagatgatgctgaagagtatgcgcgaggcgttgccgcaggacggcattatgggcaacgagcagaccaaactctttacctctatgtatgatcagcagattgcacaggagatggggaagcgcggcctgggcctggcggaaaccatcgtcaaacagatgcagcccgccaccgcgccggatgaaaaagccggtacggtgccgatgaagctggataacagctttattctcagcaccagcggggcaacaccactgccggcgcagcagctggagcagattgtgcgtaaggcaatgccgcgtctgccgccggtcgcttcaccgacgggtctgcccagtgacagccgcgagtttatcgcccagctgacgcaaccggcgcaggctgccagccagcagagtggcattcctcatcacctgattctggcgcaggctgcgctggagtcgggctggggccagcgtcagatcctgacccgcgacggcaaaccgagctacaacgtgttcgggattaaagccagcggcgactggaaaggtgacaccaccgatatcatgaccaccgaatatgagcagggcgaagcgaagaaagtgcgtgccagcttccgcgtctataactcctatttcgaggcgctgaccgactacgtcaaactcctgaccaaaaacccacgctatgcggcggtgacgaacgcctcaagcgcagagcagggtgcgcaggccttacaggcggccggttatgccaccgatccaaaatatgcgcaaaagctggtgggaatgattcagcaattcaaaagtatgggcgacaaagtcgtcaaagcttacagtcaggatatgggcgacctgttctgatcattgcgcctcaagtttcactttagcaagccgataacatccctatagccagaagcgttttcgcctgctggcgcccactttgatgtctgccagcccggttgacggggaacgtaaggaaccgagatgtccagcataattaactccgcgatgagcggattgagtgccgcgcaggccgctctgagcaccacgagtaacaacatttccaattacaccgtggcgggctattcacgtcagaccacggtactggcgcaggcgaacagtaccctgcagggcaatagctattatggtaacggcgtgaatatcaccggtgtacaacgtgaatatgatgcgtttattgctacgcagctgcgcggttccagcgcgaaactacagcgcggtaagcacccagcatagccagatttctaacattgacgatctgctgtcgacttcgactaccagcctgtcgacctcgctgcagggcttctttactaacctgcagaacgtggtcagcaacgccaacgatccgtcggcgcgtcagtcgatgctcagcaatgcgcaggggctggtcagccagttccagacatcagcgcaatacctgaacaatatgcagaacagcgtcaatgccgatgtcgattccagcatcaagcaggtcaataccctcaccagccagattgccgatctgaacaaacagattggcaaactgagcacggcaaacggtgccgcaccaaacgatctgctcgataagcgcgatcagctggtgaataccctgaataacgtggttggtgtgacggtatcgcagcaggatggcggctatacggttgcgatggccaatggcctgacgctggtgaacggcgacaaatctcacgatctggtggcgatgccttccagcagcgatccgacacgcaccaccatcggctatgtcgataaacaggcgggcaacgtcgagatcccggaaaagctgatcaccaccggttcgctgggcggtctgctggcgttccgtactcaggatctggatctggcacagaaccagctgggtcagttagcggcggcgtttaccaccagcttcaacgatgtccacaagcagggatttgatagcaaaggcaatcagggcgtcgatttctttaatatcggcagcccgatcgtggtgggcaacagtaaaaacagcaccgccgcgtccgtcaccgctgagtggaccgataccagtgcactgaaagcatccaattacaccgtgagttatgacggcaataactggaccgcaacccgagcctcagacagtgcggctgttaccatcacgccaggtaccgatgccagtggcaacaccacgctgagctttgacggtctgaaactgaccgtcgccggcacgcctgcacctgctgccaaagacagtttcctggtgaagccggtccagaaacgccatcaacgatatgtcagtcgcgatcaccagtgaatcgcaggtggccgccgcgggtgccgtaggcggggagagtgataaccgtaatgcgcaaaaactgctgaatctgcaggatgtgaaactggtcggcggcaacgccacgctgtctcaggcctacgccaccatcgtcagtagtgtgggtaacaaaaccagttcactggaaaccaccagcaccactcagaaaagcgtggtcagtcagctgacccagcgccagcaatcggtctctggggtaaacctcgatgaggagtacgccaacctgaccaaatatcagcaatattacatggccaatgcgcaggtgctgcagactgccagcaccgtgtttaatgcattgatcaatattcgctaagggcaggagataacatgcgaatcagtacaaatatgatttttgagcagcaggtgcgcggcatcactgactcacaggcctcctggctgaaatcaggccaggagctttccagcggccgccgtgtgaataatccttcggacgatccgattgccgcgtctcgtgctgtcgtgttgtcacaaacccagcagcagggcaagcagtatgcgctggcgcgtacctttgccgagcagggtctctcactggaagagaatacgctgaaaggcgtcaccgatgggatcattgctgcccaagggctgatcgtcaacggttcaaccggtacgctgagcgacgatgaccgtggttcgattgctacccagctggagggtatccgcgcccagttgctgaaccaggcaaacagccaggatgccaatggccgctatatttttgccggttataaaactgacagtgcgccatttgtggatgcggcaggcaccggcgtcggctacgcaggcggcaccgaggcaatcactcagaaggtcgataccagccgtaccatgactgtgggccataccggtgacaatatctttatggcgatctccggcaatgccaccaaagagccggatggcagcgccagtgaaacgaatgtgtttaagatgctggatagcgccattgctgcgctgaaagtgccgcaggatgatgctgacgccgcaaccaaacagaccttccaggcggcgatggataaaaccaaccgtggcctgggtaactcgctgaataatgtcttaaccgtgcgttctgagattggtacccagcttggtgagatcgatacgctgaatgcccagggcgatgaccgtagtgtgatttacagctcgcagatgagtgacctggttaacgtggatttaaccgaagcggcttcaaactacaccatgcagcagacggcattacaggcgtcctataagacctttaccgacatgtctaagatgtcgctgttccagatgaactcgtagtcttacctgaaattttgagcgtactttaaccggatgcgcttacttttcccaccctcccgctaaaggagggtgggatttttttgcctgcgattcagccggtggcgggaaccatagaaattaaaccgggttgatttacagcgacagtcagctcgcatgtcagtcttgctttcacgctttcacgcacacacgcacacacgcacacacgcacacacgcacacacgcactttcctgattcctgataaacgaggaggggaggttaattatcctctgtccgctggcgggcagaatcgcaggcataaaaaaaccccggcttgcaggccggggtttagttcacaacagcttatgcgttacggcttggtcgccggggcagtggcatgatgtgtggcgctatgaccacccgcagaaaccgcgaccgtcgaactcataaggtgcacgcacccagtcactgtgcggtgccggttctgactgccagactggcgcaggtgctttagtcatcggcgcagaggcaaaatgcttccagcgcgtaccgtcattcggcactgatgccgttgcaggctcggatgccgttgcaggcactgatgcaacaggttcggccgtagtgacctgtgctgcaggggcgacatcgcgtgcggccaccggagcatgaggttcacgaactggcgctgtttcagcttcagcagcgaccggcgcattcagaacttcctcaacttctgctgcgatcgcttcgctgacgtcggtagccgattgctcagcaacctctgaaggctgtgcttcttctgcaactgctgcaggctgtgcagtctcaaccgcaggtgtcacaaccggcgcttcggtgacaggctcagcaggcacggcttcggctgctaccgcttccgcttttgcttcatctgccgccggaacaacggaaggctgctcgtcaaccggcgcgtcgatagcacgggtatcgtcagtgttcacgaccggcactggcgtttctgcctgcggctcggcctgttgcacaggcgcttcctgagcaacagattcaacagcggcagcaacgggctgcgcactggcggcgtctgctgtctcttcgcggttgtacgctggcgtctcgtgagtcacattctgaacctgctcttcgctggcctggctcaccgggtaacggatccagactttaccggatgccatctctggtgatgcagctgcagcggccagcggcattgctgactgagtcggataacgctcatcacggtaacgacgacgacgctgtccgctgacgcgaagatgacgaggcgaacgacgtgaacgacgcggcatattggcgttatcacggttgtcgttgtcatcctgctcttcaccctgcggtgcctggaactcaggctgcggctgagccacgtctgtctgctgaggctgacgcacttcagccggctgggcaaagtcgctggcttcggctggcataggtggacggttatcatcaacacgcaccttctggttcagctgacgcggcttgcgacgcggcataacctgtacgcgctcatcatcctgcggctcggtcacgtccggaaacgtcggctaccactaccggctgctcagccactttggcggcttcttcaccggcacgtttctcttcctgacgacgacgctgacgctcagcacgctgttcacggcgctgttgctgctgctcatcacgctgctggcgcgcttcttcgctcagtgctggacgctcttcacgcacttcaccagcctgggactgacgcttgttacggcgattatcgttaccctcgcgcggctcgcgattttcacgtggctcgcgactttcgcgcggttcacgactttcacgaggttcgcggttttcacgaggctcacggttttcgcgtggttcacggccttcacgcgactgcgcgttatctccgttgcgcggcgtacgctcacgacgattattgttacgacggttgttattgttgttgcggcgctcgccacggccgttgccgttttcctgctcgctttcaggcgctttctgcggctctgcaacctcagtggccacgggggcagcggcaggggtttcttcgcctgcgaacatttttttcaggccaccaagcagacggccaaagaagccggtgctgacggtagcaggcgcagccacagcaggtgctgcttttgcggctggctgggcttcagcgcgctgcgcttctggctcaacttctaccggtgccggaggcgcatcaggcatcacaaacgcggccagagcaggctgctcaggacgacgacgttcagcatgttcctcttccgacggcatcgccatttcggcttcatgcagcttcggcagatgatagctcagggtctgcgtctcttcgcctttgcgcacgcgcagcacggagtagtgtggggtctgcatcttgtcatcaggaacgatgatagcccgcacgccaccctggcgtgtttcaatagcgttaaccgcttcacgtttttcattcagcaggtaagaggccacctgaaccggaacaatggcgtgaacttctttggtgttgtctttcagcgcttcttcttcaatcagacgcaggatcgacagcgccagtgactcgttatcacggatggtgccggtgccgctacagcgtgggcagacgtgatggctggattcacctaatgacgggctcagacgctgacgggacatctccagcaggccgaaacgtgaaatgtggctgatctgaatgcgggcgcggtcctgacgaacagcttcacgcagacgattctcaaccgcgcgctgatggcgaaactggcgtcatatcgatgtaatcgataacgatcaggccgcccaggtcacgcagacgcagctgacgagcaatctcatcggccgcttcaaggttggtgttgaacgccgtctcttcgatatcaccgccgcgcgttgcacgtgctgagttgatatcgatagcggtcagcgcttcggtactgtcgattacaatcgagccaccggaaggcaggcggacttcacgctggaaagcggattcgatttgcgattcgatctgatagtggctgaacagcgggatttcaccggtgtagagcttaattttgctgctgaagtccggacggcccagcgcagcgatatgctgacgcgccagttccagtactttcgggttatcgataaggatttcaccgatgtcctgacgcagatagtcgcggaaggcacgcacaatcacgttactttcctgatggatcaggaacggagcagggcggttttcagcggctttcttgatcgcttcccagtgtttaagacggaagcttaaatcccactgcagcgattcggctgatttaccgacgcccgcagtacggacaatcaggcccatgccttccggcagttccagcgccgacagggcttctttcagctcggtacgatcgtcaccttcgatacggcgagagatgccgcctgcacgtgggttgttcggcatcagtaccagatagctgcccgccagagagataaaggtggtcagcgcagcacctttattgccgcgttcttctttatcgatctgaacaatgacttcctgaccttcacgcagcacgtctttaatattcggacgaccatgcgcgttgtagctggaggggaagtattcgcgggagatttcttttaacgggaggaaaccgtgacgctctgcgccgtaatcgacaaacgcagcttcaaggctgggttcaatgcgagtgattttacctttgtaaatgttggcttttttctgctcgtgtccaggactttcaatatccagatcgtacagacgctgaccgtcaaccagggcaacgcgcaactcctcctgctgagttgcgtttattaacattcttttcatcgtgacttactcgttattctttcatgagtgattacagctgcgggcatagttaccctggacgagtatcaaccgatggccccgtgacttagtgcaatgtcgtcaacctcacggctgtcgaccgcgcgaggggcgcaaataacgtcggtggcctgtttttcataagggaaaacagcaccagatagtggaaatgcctgagagaataaagaaaacccgtgcatcccatactgttgtccaggccgcaacccgcagcccgctaagtgcctgatttcgcattacgtcttacgccattgctgcgtgtctgctcaatccggcaaaatgacaatttcgctctttttctgccctgaaatggttcaggtaagaaactcaagcattattccattgctaaccttcatatagcaaggcgactttagccagcttgtgaagtttctttacatttaaatcgctaatgtgtcggacaaaacagcgctttgctgaaaaagccagcagagaggcgacctgccgtcacatcaactccagagttaagcacagaaaaaggggtggcgctatcaggggacactatttagaatcgccgccatgaaaacagagaatcccggcgtacattttgtcgccatcacggctgaaaatgccggacaacgcattgataactttttgcgcacccagctcaagggtgtgcccaaaagcatgatttatcgcatcgttcgcaaaggcgaggtgcgggtgaataaaaagcgcgtcaagccagaatataagctggaggagggcgatgaggtgcgcattccgccggttcgggtagcggaacgcgatgaagatgccgtttcccccaaactggcgaaagtggcgtcactggccgatgccatcctgtttgaggatgagtcgctgctggtgatgaacaagccttccggcacagccgtgcatggcggtagcggactcagcttcggggtaattgaagggttacgtgccctgcgaccggaagcacgctttctggagctgatgcatcgcctggatcgtgacacctccggcattctgctggtcgctaaaaagcgttcggcgctgcgttccctccatgagcaactgcgtgaaaaggggatgcagaaagattatctggccctggtgcgcggcaactggccgtcacacctgaaggtggttcaggcgccgctgctgaaaaacatcctgcagagcggtgagcgcgtggtgcgcgtcagcagcgaaggcaaagcctcggaaacccgctttaaagtagaagagcggttcgaatttgccacgcttgtgaaagcgagcccggtcaccggtcgtacccatcagattcgcgtccatacgctgcatgccgggcatcccattgccttcgacgatcgctacggagaaacgtgagtttgacagtcagctggcggcaaccggtttaaaacgccttttcctgcatgctgcggcgctgacctttacgcatcccggcaccggcgaagtgatgcgggtcgaggcgccactggatgatggcctgaagcaatgcctgcttaagctgcgtcagcggaaagcgtaatctctccggcatcagttcgttaaaggattgatgccggcctgctgcaacatctcattgagcgcgatcaacggcagcccgaccagcgtattaggatcgcgtccctccagccgatcaaacagacaaatccccagaccttcacttttaaaactgcccgcacactgaagcggctgctccttttccacatagccgctgatttcagcgtcagttaacgtgcggaaatgaaccacaaagggctcacagcagtgcagcagcgtgccactgaccggatgaaatagcgccagaccggtataaaaggtaatggcttttccgctggcggcacgcagttgcgcccgcgcattctcagccgtgtgaggcttaccggcgatagcgccatccagcacgcaaacctggtcggagccgattatccagtgtctgggatacgtttttgccagtgcctgcgctttagctacggcaagacgggttaccagcgcttcagcggtttcatccggctggggggactcatcaacctcaggcgcggcggtaataaaaggcaggcccagtttatgcagtaatgcctgccgaaagggcgaggttgaagctaaaagaatcgatggcgtcattttttttcaatagtgatagcgaattggtgacagtcattttaaactgtgcgccgcactggatgcgaatagtggttgaaagatgctgtttaacggcctttttctttgactctatgacattacaaagttaatatgcgcgccctatgcaaaaggtaaaattacccctaacgctggaccctgtccgcactgctcagaagcgccttgattatcagggtgtctacacatctgtacaggtggagcgtgtggccgagtcggtcgttagtgtggacagtgatgtggattgtgccatgtcgtttgcggttgataaccaacgtctggcagtactgacgggtactgctgaagtacaagtgacgttgcgttgccagcgctgcaaccagacctttcctcatcacgtaaaagtgagttactgcttcagccctgtctcttctgaagagcaggccgaggcattgccggaagcgtacgagccggtcgatgtcaacgagtttggtgagatcgatctgctggcggttgtcgaggatgaaattattctcgcgctgccggtcgttccggtgcacgattctgaacactgtgaagtgtccgaggcggacatggtctttggtaaactgcctgcagaggtggagaaaccaaatccatttgccgtattagccagtttaaagcgtaagtaataggagtaaggtccatggccgtacaacagaataaacccacccgttctaagcgtggtatgcgtcgtttcgcacgatgcgctgaccactgctgctctgtcagtagataaagtttctggcgaaactcatctgcgtcaccacatcactgcggacggttactaccgcggtcgcaaggttatcgttaagtaagtttcttgcttagcaaggcgataccttgacacgtttgaccctggcgattgatgccatgggcggggacttcggtccctgcgtgacagtgcctgcagcattgcaggcactggcctctcattcggaactattccttcttctggtcggacatcccgacaccctcatgccattgcttgccaaagcggattcctccctgatggggcgtttgcaggtcatccctgccgaatcggttattgcaagtgatgcgcggcccgctcaggccatccgcaacagtcgcggcagctcaatgcgtgtggcactggagatggttaaagagggacgtgcgcaggcctgcatcagcgccgggaataccggtgcgctgatggggctgtcgacgctcttattaaaaccgctggatggcattaaacgtccggcgctgatgtccgttttaccgcaccagcaacagggtaaaaccgtggtgctggatctgggcgcaaatgtgggctcagacagtgcgatgctggtgcagtttgctgtaatggggtcggtaatggctgagcatgtgcttggtattgcacggccccgtgtcgcgttgctcaatattggtcatgaagagaccaaagggctggaaacgatccgcgacgccgcggcagtgctgcgagaatcaccgcaaatcaactatattggttaccttgaaggtaacgaactgctcaccggtaaaacggatgtgatggtctgtgacggttttgtcggaaacgtcacgctgaagactatggaaggcgtggtaagaatgtttctttctctgctgaagtcatcaggggaaggtaaaaaacggtcatggtggcttcagttgctggggcgctggattcagaaacgtctgacgaagcgcttcgggcatctcaaccctgaccagtacaatggcgcttgtctgttaggattgcgcggaacagtgatcaagagtcacggtgcggcaaatcaacacgccttcgctgtggcgatagaacaggcagagcaggcggtgaggcagcaaattcccgagcgaattgctgcgcgccttgatgctgtattagccaggagtgacaaagcctagatgtataccaaaattatcggtacgggcagttatctgccaagccagatccgcactaatgccgatctggaaaaaatggtggagacgtcggacgagtggattgttacccgtacaggcatccgcgagcgtcgtattgctgcgcctgacgaaaccgtcgccaccatgggattcagcgcggcgcaacgcgcccttgaaatggcaggcattgaagcgaacgatgttgggctgattattgtcgccacaacctcttccagccatgccttccccagctctgcctgcatgatccagcaaatgctggaaatcaaagactgcgcggcgtttgacctcgctgccgcctgtgcaggtttcacctatgcactgagcgtggccgatcaatacatcaaaaatggcgcagtgaaacatgctctggtgattggtgctgatgtcctggcacgcgcacttgatccggaagatcgcggcaccatcatcctgtttggcgatggtgcaggcgcggtcgtgctgggtcagagcgaagagcaggggatcatctctacccatcttcatgctgatggtcgctattcacagctgctgacgctgccttatcaggatcgtgcgcatcaggatcagcccgcttatgtcaccatgtcaggcaacgaagtcttcaaggttgccgtcaccgagctggctcacatcgttgatgaaacgctgcaggccaataatctcgatcgtgaaatgctggactggctggtgccgcatcaggcgaacctgcgcattatcagcgccaccgcgaaaaaactcggcatgaccatggataaagtggtcgtcacactggatcgtcatggcaatacctctgccgcatcggtgccaagcgcactggatgaagcggtccgtgatggccgcatcaaacccggacaccttattctgctggaagcctttggtggtggattcacctggggtttctgcgctggttcgcttttgattgacaggaacgaaaaatgacgcaatttgcatttgttttccccggtcagggttcacagaccgtgggcatgctgactgaattagcggcaacgtatccgctggtagaagagaccttccgtgaagcctctgacgcgctgggatatgatctgtggcaattagtaagtcagggtccggctgaagagctgaacaaaacctggcagactcagcctgcactgttagccgcctccgtggcaatctaccgtgtctggcagcagcagggcggtgaacagccagccctgatggctggtcacagcctgggtgaatattcagcgctggtttgcgcgggtgtgcttaactttgcggatgcagtcaagctggttgaactgcgcggcaaactgatgcaggaagcggtgcctgaaggcactggcgcgatgcaggcgattattggcctggatgacgcggctatccgcaaagcctgtgaagagagcgcgcagggtcaggttgtctcaccggttaactttaactcgccgggccaggtggttattgcgggtaacaaagaagccgttgaacgtgcgggtgccgcctgtaaagcagcgggcgctaagcgtgccttgccactgccggtcagcgttccttctcactgcgcactgatgaagcctgcggccgataaactggcggtggcgctggagagcatcacctttaacgcgcctgcggtaccggtgatcaacaacgtcgatgtgaaagctgaaaccgatgctgcggccatccgccatgcgctggtccgtcagctctacagcccggtttcgctggaccgagagcgtggaagcgatggcagcacagggcgtgacgcagctcctggagatggggccaggtaaagtcctgaccggactgacgaaacgtattgtcgatagcctgacagcggctgccgttaacgatactgcatccctgacggctgcactcggtaaggaataagaggaaaatcatgagctttgaaggtaaagttgcgctggttaccggcgcgagtcgcggcattggtcgtgcgattgcagaaacactggcggcacgcggtgctaaagtggtaggaactgcaaccagccagagtggcgccgatgccatcagtgcttaccttggcgacaagggcaaaggcctgttactgaatgtgactgacgctgactcaatcagcactgttttagagaatattcgtgctgaatttggcgaagtggatattttagtcaataatgcaggcattacgcgtgataatcttctcatgcgcatgaaggacgatgagtgggaggatatcctggataccaacctcacatcggtattccgcctttccaaggcggtcctgcgtgccatgatgaaaaagcgcgtgggccgtatcatcaccattggttccgttgttggaactatgggtaatgcgggccaggcaaactatgcggcagcaaaagcgggtttgattggctttagcaaatcactggcgcgcgaaatcgcgtcacgtggcattaccgtcaacgtcgtggctccaggctttattgagactgacatgacgcgggcactgaacgaagatcaacgttccggtattttggcggaagtttcctgcgggtcgcttaggcgatgctcaggaaatcgccaatgctgtggcatttttagcctctgacgaagcagcctacatcacaggtgaaacgctgcacgtcaacggcggaatgtacatggtctgataaatcacgaaatgatttgctttatttgcggttagaaccgcaaaataacgcaaaatcgtggttcgaccagccgggattttgttgcatctttttcaccattttatacactacgaaaaccatcgcgaaagcgagttttgataggaaattaaatagtatgagcgatatcgaacaacgcgttaagaaaatcatcagtgagcagctgggtgtgaaagaggaagaagtcaccaactctgcatctttcgtagaagacctgggtgccgattctcttgataccgttgagctggtgatggctctggaagaagagtttgatactgagattccagacgaagaagctgagaaaatcactaccgttcaggcagcgatcgactatatcaatagccataaaggctaatgaatatcttcaggcggtcgctcgaccgcctgatttttttgtttgtcccacatagttccctatttcccctccctggaggacgaacgtgtctaagcgtcgtgtagttgtgactggtcttggcatgttgtctcctgtcggcaataccgtagagtctacctggagtgctctccttgccggtcagagcggcattaccctgatcgaccattttgataccagtgcttatgcaacacgttttgcaggtctggtaagagattttaattgtgatgactacatctcgcgcaaagatcagcgcaagatggatgccttcatccagtacggcattgtggccggtatgcaggccatgcaggacagtggtctggttgttaccgacgaaaatgcaagccgtatgggcgcagcaattggctccggcatcggtggtttaggtctgattgaagagaatcatacttcactggtcaacggcggcccgcgcaaaatcagcccattttttgtgccttcaaccatcgttaacatggtggcgggtcatctcagcatcatgtatggcctgaaaggtccaagcatctctatcgcgacagcctgtacctctggtgtgcataacatcggtcatgccgcacgcatcatcgcctataacgatgctgatgtgatgctggcgggtggcacagagaaagccagtacgccattaggcgtcggtggctttggtgcagcacgtgctctctcaacccgtaatgaaaacccgcaagcggccagccgcccgtgggataaagatcgtgacggttttgtgctgggtgacggcgctggcattgtggtactcgaagagtatgaacatgcgaagaaacgtggtgcgaaaatctacgcggaaatcgtaggttttggtatgagcagcgatgcctatcacatgacttcaccaccagaagatgggtcaggcgccgcagcggcaatgatcaacgcattgcgcgatgctcagcttacgccagagcagatcggctatgtcaacgcgcacggcacctccacgccagcgggtgataaagcggaagcgcgggcggtgaaatcggtctttggggcagcagccagcagcgtgatggtgagctcgaccaaatcaatgaccgggcacttactgggtgcggcaggcgcggttgaatcgatctactcgattctggcgctgcgcgaccaggccattccaccgaccattaacctcgacaatccggatgagggctgcgatctcgacttcgtgccccacaccgcgcgtcaggtttcccggtctggagtacaccctgtgtaactccttcggtttcggcggaaccaacggttcattgatcttccgtaaaatgtaatcgttgttgattgctataaaggcccgcgatgcgggcctttttttatcctgcagaatgcgctgaaatcacgagtcacgctcaggggagaaccatgtggattaacgggttaaaacaatcgatgctggccgccagtgaccgcggcctgcagtttggggatggctgttttactaccgccgcggtgcgtcagggtaaaatcgtgctgctggagagccacattcagcgcctcaaagagggctgtgagcgattatggattgatggcgtcgactggcttcagcttgagactgaaatgcgacaggccgcgcaccaacaaacccaggcggtgctgaaagtgattatcagcgccggcagcggcggacggggctacagccggcgcggctgtggtgaacccacgcgaatcgtctcgctggcgccctggccgcaacattacgccgatatacagcagcgtggcgcgtcactcaggctcagcccggtccgtctggcacgtaatccacagtttgccggtatcaagcaccttaatcgtctggagcaggtgatgatcagagctcatcttgaccagacagacgccgacgaggcgctggtgcttgacactgaaggttgggtggtggaatgctgtgcggccaatttattctggcgtcagggctcgcaaattttcacgcctgatctgtcagcgtcgggtgtggatggcattatgcggcgaagtctgatggcgcaacttgcggccgaaggccaggcttgccaggtaataaaaagcgaaccggcgcagctgctggccgccgatgaagtggtgatatgtaatgcgctgatgccggtcctgccggtccgacagatagaagcggtagagtttactgagcgttcgctgtttaatcagttgcgcgcaagctgtgaaaagataatggatgcatcatgattcgaagcaaaaaaatcgtcgtcagcctgctggcgatcgtgggtctcgcggctgtgctgagttactggcaggttaagcggtttgcggccaccccgttaaccctgcagcaggaaacgatctacacgctgcctgccggcacgggccgggtcgcacttgaagcgcagctggaagagcagaagattattccgcacagtatctggtttggcgcgctgctgcgtctggaaccggaactggcgaccttcaaggcgggtacctatcgccttgagccaaccatgacggtgcgctcgctgttacagctgctggccagcggtaaagaggcgcagttcccggtgcggtttcgtggaaggccagcggctgaaagagtggctgagtgagctgcgcaaagcgccttatatccggcataccctgaaagatgatcagttcgccacccttgccagcgcactaaaagtggagcctgagcagctggagggcaacttcttcccggatacctggctttacacggctaacaccaccgatatggcgctgctacagcgcgctcatgatcggatgaaaaaaaccatcgctgaggtgtggcagggacgggcggataatctgccctataaaaccccacaggatctggtgaccatggcctcaatcattgagaaagagaccggcgtcagcgaagagcgcgcgcgcgtagcctcggtatttatcaatcgcctgcgcaccggtatgcggttacagaccgatcccaccgtcatctatggcatgggcgacagctataacgggacgctgacccgcaaagatcttgagacggccagcgcttacaatacctatatcattaacggtctgccgccgggtccgatcgccatgccgggtaaagcctctctgcaggcagcggctcatcccgagaaaaccaactatctctactttgttgcggacggcaagggcggccatacctttacgactaatcttgccagccataacaaggcggtgcaggtttaccggcagacgctaaaggaaaaaaatgaacagtaagtttatcgtcattgaaggcctggaaggcgccggtaaaaccaccgcgcgtgatgccatcgtcgccacgctgcgtgcccggggcattcacgatctggtctttacccgtgagcctggcggaacgccgctggcagaacaactgcggatgctggttaagcagggtattgagggcgagcaggttacagataaagcggaactgctgatgctctatgcggcgcgggttcagctggtggaaacggtcattaaaccggcgctggcgcgcggtgcctgggtgatcggcgaccgccatgatctctcttctcaggcttatcaggggggcggacgtggacttgacgccggtctgatgcagacgctgcgcgatgccgtgttaggcgatttccgccccgatctcacgctctatcttgatgtgacacccgacatcggtctgcagcgcgcccgtgcgcgcggtgagctggatcgcattgagcaggaatcattacgcttctttgaacgcacccgcgcgcgctatctggcgctggcagcggaggatcccaccatcatcaccattgatgccacacaatcactggatgatgtgacagcgtcacttcaggcggcgctggatggctggctggcggagcaggcgtgatgaactggtatccgtggctgaatcagccttatcgccaggtgattggccagcatcaggagaatcgcgctcaccatgcgttgttgatccaggcgatggcaggtatgggcgatgaggcgctggtctgggggatgagccgctggctgatgtgccagcagcgggatggcctgaaaagttgcgggcagtgtcacggttgccagctgatgcaggccaatacccatcctgactggtatcggcttgaagcggagaagggcaaaagtaccctgggcatcgatgcggtgcggcaggttacggaaaaaatgtaccactttggtcagcagggcggcgcgaaagtggtctggctgccggatgccgcgcagctttcggaagcggcggccaacgccttgctgaaaacgctggaagagccgccagccaacagctggttcttcctcagcagccgggatccctcgcgcctgctggccacgttgcgcagccgctgcatggcgctgcatctgacgccgccggacgaaggacaaagcctgctctggctgaagaagcacgctgcgcacgacgaacagatgctgctggcggctctgcgtctgagcgcaggtgcacccggtgcggcgctgagcctgctggaaaacggaccgtggcaggcccgacagaagctctgcgatgcgctgtccgctgcgttgcagcaggacatcctgcaactgctgcctgcgctgaaacgccgacgacgcggcagcacgtatcggctggctgctctctttgctgctggatgcaatgaagtggcagcaacatgcaggtcagtggctgagtaatatcgatcgtcaggatgtggtgcagttgctggccggatacttttctgccagcgcgctcaacagcagcatccaggactggatgcgctgtcgcgagcagctattgcatgtggcatcggtgaatcgcgaattattgctgaccgatcagcttctgagctgggcggacaaacagaaacccgcgcttgtcggctaaacctatctgagagtaattatgtttattgtggattcccattgccatcttgatggcctggactatgaaaagaaccatcgtgacctggatgatgtgatcgccaaagcggcggcgcgtgatgtgaaatttatgctggcaatcgccaccacgctgccgggttttcatacccttaaaagtctggtcggcgaacggaaaaatatagcgctctcctgcggtgtgcatccgctgaatcaggaagaggcctatgatgttgaggagtttcgtcggctctctgccgatcctcaggtggtggccctgggtgaaaccgggctggattatcactatcagccagaaacgaaagatcagcagcagcgctcgttccgggaacatatccgtaccggtattgcgctgaacaaaccgatcattgttcacacccgtgatgcccgcgaagatacgctggcgattctgcgtgaagagcaggttgaacgttgcggcggcgtgctgcactgcttcactgaggatcagcccaccgcaacaaaactgctggatatgggcttctacatctctttttccggcatcgtcacattccgcaatgccgagcagttacgtgaagccgcacgctatgtgccgctggatcggatgctggtggaaacggattcgccttatctggccccggtgcctttccgtggtaaagagaatcagcccgcttatacgcgcgatgttgccgaatatctggctgtactaaaaggggtggatttagaaacgctggcagctaccaccacccaaaacttctcaacgctgtttcatatcccgatgagccagctgggcgcctgatcagctattatttcagcctctgtaattaatctgtaacctgcgtatatgaccctgttttttcagacagggtcagctttttatcgccgattactggtgcggatcagtaagaaatttcgtaaagtgcgcccttgtgattgtcgaaacgtgatacccgtcaaagtaacaaatcgggaattattttacccttcgtaataaatcaaaaggcggtcaccgccagcccggcaaagaatcctccctctttgccacgcgcactgcgcaaatatgcactcttactcaggagcttcacgctatgttcaaaaatgcttttgccaaccttcaaaaggtcggtaaatcgctgatgctgccggtatcggttctgccgattgccggtattttgttaggggtcggttcagccaatttcagctggttacctgcagtggtttcgcatgtgatggcagaagcgggtggatcggtgttcgccaacatgccgctgattttcgctatcggtgtggcgctgggctttaccaataatgacggcgtttcggcgctggcagcggttgttgcctatggcatcatggtgaaaaccatggcggtggttgccccgctggtgctgcatctgcctgcggcggagatcgaggctaaacacctcgccgacaccggggtactgggcggtattatcgccggttccatcgccgcttacatgtttaatcgcttctaccgcatcaagctgccagaatatctgggcttctttgccggtaagcgttttgtgccgattatttccggtctggcagctatcattctcggcgtgctgctctcctttatctggccaccgataggttccgcgattcaggagttctcacagtgggctgcctatcaaaacccggttgtcgcctttggtatttatggcgtaattgaacgtgcgttggtgccctttggtctgcatcacatctggaacgttcctttccagatgcagatcggtgaatacaccaatgcggcaggtcaggtgttccacggtgatatcccgcgctatatggcgggtgacccgaccgcaggtaaactctctggcggcttcctgttcaaaatgtacggtctgccagcggcagcgattgctatctggcattcagcgaagcctgaaaatcgcgccaaagtgggcggtatcatgatctccgccgcgctgaccgcattcctgaccggtatcaccgaaccgattgaattctcattcatgttcgtggcaccgatcctgtatgtgatccatgcgctgctggcgggtctggcattcccaatctgtatcctgcttgggatgcgtgatggcaccagcttctctcacggtctgatcgactttatcgtcctgagcggcaacagcagtaaaatctggctgttcccgattgttggtatcatctatggtctggtttactacaccatattccgtgtactgatcgcgaagctggatctgaaaacacctggccgtgaagagagcagcagcagcgagcaatctaccgcgaccggtacagagatggcgggcaaactggtggcggcgtttggtggtaaagagaacatcaccaacctggatgcctgtatcacccgtttacgtgtcagcgtcgccgatgtggcgaaagtggatcagactgaactgaaaaacctcggcgcccgtggcgtggtggttgccggttccggtgtgcaggcgattttcgggactaaatccgataacctgaaaaccgatatggatgattacatccgcagcatgtaatgatttacagagatgaaaaagccccgcttagcggggcttttttttggccgggattcagaggtaaacgcgcagatactctgtcaggcagagcagggccatcgcctgaccgtagggcatagaggtcagaggaaccgtgcggtagtaatccagatccttgcccattgcggtaccaaaggaaacctgttttaactcgccatcgtcatcaatattggcaatcacgccgcgcaacgctttttctgccacctcgcgatactctgcgggcagataacgcttgcgaacccctttcagaatgccataggcaaacccggcggtggcggaggcttccgggtagctgtgcggatcatcaagcagggtgtgccacaatccgctgctgtgctgacactccctgagcgctttaacctgggtctccagcacctgctgcagaaaacggcgggtagcgtgatgctcaggccagttcatcatctccaggaagtcgggaatgacaatcgtcacccagctgttaccgcgcgcccagcgtgcatcagcaaagttatggcggccgtcaaagttccagccgtggaaccataagccggttttgcgatccatcagatactgggtgtgcagcaggaactgataacttgcttcttcaatccactcatcgcgcttcagcaactggccaattttagccagcgccatcacgctcatcatcagcgtatcgtcccagagctgctgtgggttttcgttgttatagacaatgtgctgcaggccgccctgttcggtacgcggcatctcatacataacccattctgcccagcgctccagcaccggcacccaggccggattcccggtctcttcgtaacggtaggccagcgtcagaaaaggacaaacggtattcacatttttggtcggcgtgccttccgccagacgctgcgtaaaccactcatcaataatggccagcgtctgctggtcaccggtctgctgatagtagtgcagcatgccatacagaccgatgccgtgtgtccattcccaacccgcccagcctttggtatcaatcacccggccatcgtccagccgtaataaaaattcgcctgtctcatcggtgatgttaaccagattctgtgtcagcttttgaatcagctgtaccagttcgctgcgtggcaacagatgctcgggctggcacaataatttgctgtgtttaacgggaaatacagtcatggtttattcctgtcgttttaaggtcgggtttaaagaagggtttaaagtgggatgtgcggacaatttttccggcgctggcttattacgattaaggaagccaatgttgttgttgccccaaagattttcgtaaggcatgccagccagcgtttctacaattccgcgtgcttccggcgtgatgttttccggcacgatgcggcccgcgtcgcgcatcttcagcgtctcctggcgcagcacagtgtgggtctggagattaagcttaaagcgcagtgacacgataaagccgcaggccagcacggccacagtgcctatgctgagaatcgccaggatagtgtggctgacgccgggtacctgggtcgcctgtccagagacaaagccggagagctgaagcacgataccgaccagcatgactgccccagcctgcgacgcttttcgcgtcagggtcatgatgccggcaaaaattccttcacggcgctgtccggtgatcacctcgtccacatcggcgatataggtataggtgttccatggcacaaagttgatgccgccacgtcccagacctgccagggcggagatcaccaacagcagtgacatgttgtcgttcattccggcataccacaatccagcgtaggagagcgccgccaggccaaacagcacagccaccagacggtaggcgggcgcgggtcccatgcggatgcagagcggaatcatcgccatcacggcaataaactgcagcaccgccatggtccccatcaggctggaggcgacctgagcgctctgcatcagcacaaataccacataccaggtaaagacggcgttaaacacatcctgggcgatatagccgccgaggtacatgccaaggtgctggcggaagatgcggatgcgtaaggttgaagccagctcgacatagagccgtttgagattctgcatcagcgtcagctgctgcttttcctgtttctgcacggcgtgactcggcggaaaagtcatcggggtgacgctcccaggtaaaacaccacaccagcgtcagcaccagcgcgcagattaccgaaaacaccaggctggcgtagaagaaggagagaggattatctttgcccagcatccccagcaaaataccgggtaaaaaggcagccagaatggccgacagctgtgccaggccgatgcgggcaccggagaagcgggttttctgtttgaaatcgtcggtcatttccggcaccagcgtttcatacggcaccaggatcatggtgtagacgatatcaaacagcagatacgtgcagagataccaccagaaactcatgtcgctgagccacatcaggctataactgaatacagagggtatgccgagcaggataaaaaatttgcggcggccaaagcgtttgcccagccaggtcgaaccgaagttatcggtcagaaagcccatcagcggactgactatcgcatccagcacgcgggcagcggcaaagatcagcgtggcctgaatcggggttaacccacaaaaggtggtgtaaaaatagagcaaccaggcggcggtcagcgccgtggtgcctgctccaagaaaatctccggaaccgtaggccagatagtggccaagaccaattttacgtgagcgcatgtctgatgctccttgatgtttatggcggtttatccctggtgacgccggtcatctcacccggactggttagcaaagtagaactgacgggtcggctaaaccttcgcaatttggcaagtgctggcgctgaagtggcagtcatacaaagaaaagggtggcgaaattctaatttataaaacagcgtttcattttatggtgtggcaggggcgttgccagcattctgaacagcgtgcgggtcacggagagagggggctgctgcaaaggcaggcgaacaatgcaagaaaagtggtcctgaggttgaaagaaaacaaatttctcccgcatactgattgattaagactcaggctaaaggaattgcaccatggcagaagaaaccatttttagtaaaattatccgccgcgaaatccccgctgatgtggtttatcaggatgagctggtcactgccttccgcgacatttcgcccaaagcgccaacccatattttaatcgtgccgaatgtgctgatcccaacggtcaacgaggcggaagcggcgcatgagcatgcgctgggacgtatgtttactaccgcggcgaaaatcgcccgtcaggaaggtatcgatcaaaatggttatcgtctgattgtgaactgcaatcaacatggtggtcaggaggtttatcacattcatatgcatctgctgggcggtgaaccgctgggaccgatgctctctaactgacctgataacggaagcgtgctatgcgatcctggctgactggcctgccgatcctgctctgcctgacggcctgcagcagtgaaaaaccgatgatcaatacgtcacagtcgctggtgatggagtcctctgtgctgtcggcagggatcattaccgatgaaccgacgctggatgagaacgatggactaaagcgtgccaccagcgtgctctataatcagcgcgaaacaccggttgttgtgcactatcgttactactggtatgacgacaaagggctggaaatcaccccgcaggaaccggcgcagaccgttaccgttccggcgcagggcagcattatcgccacttcgcaactgggtaacctgacggccagcaaggttcgtctttatctctatctttaaggattttctacgtgatacgcagtgttaatcgtaccggagcgctcctgatggcgctcattctgaccggctgtgtggtgaaacagcagcagcctgcaccagttgaaccgactcagcctgtggagccggtgcagcccgttccacaacctgaaccggtgccgcaaccgcagcctgtgccgcagccaccgaaactggtcactatcaactgggatgccagcgttcagccgctggtggcgcagatgttacaggctgccagcgccgagccgggcagcgtgttgctggtggatcgcgttaaaaacagcaccaacggtgcgctgcaaagcgagaaagcgacggcagctatccagaatgcgctgaataacaacggcaaattcaccctggtttctgctgaccaactggcgcaggccaagcagacgctgggattatcgccggatgacagcctgaactcgcgcagtaaagcgattggcctggcgcgtaacgttaacgctcagtatgtgctttacagcaacgcgcgtggcgatgtcaaagcgccgacgctgcaaatgcaactgatgctggttcagaccggcgagatcatctggtccggcaacggcattgcacagaattaatcccgctttccagcggatgattcagcaggtcaccggcgaaccagaaaagacatcctttacctcgcttgccggtctgaccggacacagccagaagattgtcagcccgcgcggaacttttatcgcgcgggcggcaccgcaaccggctattccgtttgtggatcggcagcgcgaattccgtctgttacgcaaactgcaagccagcggagtggcaccgcagcccgtggcgggccatcatcaggggattatcctgacctggtgcgcaggcgaagcgctggatgaacaccgtttcagccagcagcgtccacagatcgtggcactgctacagcagctgcatcagcagccgctgaccggctatcgtctgcagttgttgccgctgttatggcgctactggcagctcactccacagcggcatcaccgctggttgcgggcgctcaggcgtctgacgcagcagggtgaaccccagccgcttcggctggctccgctgcacatggatctgcatgccggaaatgtcatacaaggtcccgaaggtctgcgtctgatcgactgggagtatgccgccgatggcgacgtggcgctggagctggcggctgtctgtgccagcgatccgcagcaccaggccgagtggctggctgagtatgccgcggcgatgcagctgccgctcaccgcgctggtgcagcaggtcagacgctggcagccctggctgcagttgctgatggccagctggtatcagctccgtgccggtcagcgtgacgacgacacattacaacagctggctcgacagagctgggaacagatttaatcgcgttacgcaggtgcgtttcgctacaggattcatgatatgagatcagatttacccggcccactgatgcttgacgtcgagggttatgaactggatggcgaagagcgcgacatcctgcagcatccgctggtgggcggtttaattttatttgcccgaaattatcatgatcccgctcagctggcagagctggtgcggcagatccgcgccgcctctcacacccggctggtagtggcggtggatcaggagggcggtcgcgtgcagcgtttccgtgacggcttcacccaactgcctgccatgcaatcttttgctgcgttgcacgacctggataccgccggtgaactggcgcaacaggcgggatggcaaatggcggccgagatgatcgccatggatatcgatatcagctttgcgccggtactcgatattggtcatatcagcgccgcgattggcgaccgttctttccatgccgatccggccatcgcccttgatgtcgcccgccgctttattgcggggatgcacgaggcgggcatgaagactacgggcaaacattttccgggtcacggtgcggtgagtgcggattcgcataaagagaccccacgcgatccgcgggacgaaaagacgctgcgtgagcatgacatggcaatcttcagcaagctgattaccgaacaggcactggacgccatcatgcccgcacacgtcatctactccgaagttgatccgctgcccgccagtggttcgccatactggcttaaaaccgtgctgcgtgagcaactgggctttgacggtattattttctccgacgatctgtcgatggagggcgctgcggtgatgggcagctatcctgagcgggcgcagcagtctctttccgcgggctgtgacatgattctggtctgcaatcagcgtcagggcgccatcagtgtactggataacctgatcccggtcgggtcagagcgggttacacagctgtatcatcagggcaggtttacccgcgatgaactgcggggaacgcatcgctggaaaaataatgctcagcaactgagtgcgcttcaggaaacgctggctggctcataaggcgtcgtggtaagcagtgactgcccggcgctatcactaccttgaggattatcatgatcatctatctgcacggttttgattccaacagtccgggcaatcacgaaaaagtgctgcaactgcaatttatcgatcctgacgtcaggttgatcagttacagcacccgccatcccaaacatgacatgcagtttctgctaaaagagaccgataagatgctgacgctttctgacgacgaccggccgctgatttgcggcgtcggactgggcggcttctggtcagagcgcattggatttctgtgcggcatccggcaggtgatttttaatcccaacctctcgccgcaggcgaacatggaagggaagatcgaccggccggaggagtatcaggatatcgcaacgaagtgcgtcagcgattttcgcgagcgtaatcgtgaccgctgcctggccattctctcccgtcacgatgaggcgctcgacagccagcacattgctgaccagctgcatctgttttatgaaattgtctgggatgagacggaagggcacaaattcaaaaatatatccccacatcttaagcggataaaagcttttaaaacattaggttaagcagcaaaggcaccgcaaggtgcctgtttttattacgtaattatctgagttttattttcccgctttgatgtatatcaatattcttatgttctcctcttcccgccatgctattctcccagcagattgcgattttaacttcgccaaccctatgtttcttaaggtttaatttaacctttggttaacttttggttcacaatttgagggggtctttgttgactacgtctgttaagaaaattgttattgtcggagggggagcgggcggcctggaaatggccacgcagctgggccataaactgggtcgtaaaaagaaggccgagattatcctggttgatcgtaaccacagtcacttgtggaagccgctgctgcacgaagtggcgaccggctcaatggacgaaggcattgatgcattgagctatctggctcatgcccgcaatcacggttttgagttccagctgggttcgctcaccgatatcgatcgcacccgaaaagtgatccgcctggccgaagtgctgaatgcgcagggcgaagtgctggtgccacagcgtgaagtggcctacgaccagctggtgatggcgctgggcagcacctcgaatgatttcggtacgccaggcgtcaaagatcactgcatcttcctggataatccgcatcaggcgcgtcgtttccataacgaaatgctcaacctgttcctgaaattctccgccagcgaaggcagggtcgagaaagttaacatcgccatcgtgggcggcggggcaacaggcgttgagctgtcagctgaattgcacaacgcggtgaaacagctgcacagctacggcttcaaaggcctgggacgcgaagcgctgaatgtgacgctggtggaagcgggtgaacgtatcctgccggcactgccaccacgcatctctgctgcggcacatcaggagctgaccaagctgggcgtttcgcgtgctgacgcagaccatggtcaccagcgccgagcgtaatggcctgaataccaaaggcggtgaatttatcgaagccgatctgatggtctgggcggctgggattaaagcacccgacttcctgaaagagattggcggactggaaaccaaccgcatcaatcagctggtggtcaaagagacgctgcaaaccacgctggacgatgacatctacgcgattggcgactgcgcctcctgcgccttgccgggcggcggttttgtaccaccgcgcgcccagtcagcgcatcagatggcctcacgcgccatggacaacattctggcgcagcgtgacggtaaaccgctaaaagcctatgtctataaagatcatggctcgctggtatcgctctcccgcttcagtacggtcggcagcctgatgggcaacctgatgcgcggctcaatgatggtggaagggcgcatcgcgcgctttgtctacatctcgctctatcgtatgcaccagatcgctctgcacggctactttaaaaccggtctgatgatgctggtcggcagtattaaccgggttattcgtccccggctgaagctgcactaagcaacagcaataacgctggctaattaatgttaagcctcctcggttcgattcagagggggctttttttatgtccttgagggtcacacattaagacaaattaaacatcagtttcctgtatgatgattaataagaaatcccggccttaatgccgggattttactttacaggtcagtcaattatccttcattcgctagccggataagcagctgtcccggcccggtgatcacctcgatcttctgcccggtcgtaaatcccagcgcttccagccagcggcctttaatggtgagctgcggcagtgggtttcggctggcccctattaggccggtatcccactctgtaataatgtgctcgcgattcaccagcggcggttgtggacgtgcgggtccctgacttatgatgcgtgtcagccataatcaactccttatcagttggtggtggtcagcgggctgttggtgttccaccaccttcagtccgcgctaaaaaatctctcgttatgtgcttcctgttctgtttttacctgtttaaatatacacctcctgccacgtaaactcgctgaaagctgagtaataaattgcgagctgtctctgaaaacagatagtttttctccggtctggctttcgttcattttttcttcgcagtcagcttgaaagtaacgcttcttggaaaaatgcaggtgttatctttccgaataccttcatttattcagagaggtttaaatagaactgtaacttaatcttttaatgggttatggatatacaggtcagttaataatctgcgttaatggattgtataaggcaggataattttctggatgtatgtgccgtaatggttttcaggggtttggcttttttatggcaactcggtcttgatacctctaattctttttggtctaatagtgccattaagaattgattgataactaaccgccaggatgagtcctgtggttaaattctttacttaacctaaattaaatggccgaagtgccatttaataaggctggcgtttaagtttcacattgactcaggccagcctgttttaaaaaatccgggtatgaatagatgctctccgaccgatctgaacatcaggcgcggagcgctacatgaaattcctgtccgatacaggcggatagataaaaaattatcctgtccgtcgggtattggtgattcagggaacgaagtcctgcgttaagcgcagggaaataatgttaaattatgaaaaggaattaattacatgacttctaaaatgacgatgctggcattactgtgtggcggtctgctcgtgggcagcaatgcactggctgataatcacacggtctcggttggttatgcgcaaagcaaagttgaagactttaaaaacatccgcggtgtcaatgttcagtatcgctatgaatggaattctcctctcagtgtgattggctcattcagctacatgaaaggcgatgacagttattccgagcagaatgattattttgacggtcttgagaaatataatgaaaaaattgaagcgaaatattattccctgatggcgggtccggcataccgtattaatgactatgtcagtttctacggcttaattggggtcgcgcgtaccaaagtagaagataaagccaattaccagtcacagtacgcacagtattcgggttcttacagcgaaagcaaaacatcctttgcctacggtgcgggtgtcgtggttaatcctatcagcaatctctctgtgagtgttggatatgaaggtactcgcgtaaaatataacgaagatgttgccatcaatggttttaacatcggcgttggctatcgtttctaagttgcctgaagcctgtaaccccggccgtctggctggggttatttattcctgcgccgggtaagtgaggggcagacggcgaatttgctttaaatgttttcatgtgcaaactgataacgtgactgccggctttacttccgattagttattattagctgattgattctactattattatccataattccctgaaactgtcagtgcggctttccagcctcagaactctcctaaaaactggtcctgatagcaaagtgaccaatttcctccatttatctgatgttgcattttcggtccatctgtaaaacttcatctcaacaaacacggcgcgtcgcgcacgtcggttatacctcagttaacgaggatgctttagcagcaggattgcgcggtaacacttttcaggaggaacttcctgtgaataaatcaatgttagcgggtatcggtattggtgtggcagcagctctgggtgttgcagccgtagcaggcatgaacgtgtttgatcgcggtcctcaatatgctcaggtactgtctgcaacgccaatcaaagagagcattaaacagcctcgtcaggagtgccgtaatgtcactctgacccaccgtcgggccgtgcaggatgaaaaccgtcttgctgggtctgtattaggtgcagtggcaggtggagtgctgggtcaccagtttggtggcggtcgcggcagagatgtggcgacagtagcaggtgcggtagcgggtggttatgccggtaatcaggtccagggcggactgcaggatcgggatacctacaccacaaccgaacagcgctgcaaaaccgtttacgacaaacaagagaaaaaactgggatatgatgtgacctataaaataggcgatcagcagggtaaaatccgtatggaaaatgaccccggcacgcgtattccactggatcgcaatggtcagctggttctcaacggcgatcaggcgtaattgggcaaagctttgccgctcacgcggccacacagcacaacgtaatacagcagtaattaaaaaggcgcatctcaggatgcgcctttttttgcggcaaactaaccggcgctttaccggttagatcaccaacgcacgggcagggtgttacgcctgccgttgagccagttgcgaaacgaatccctgcacccactcaagccgcacttttctttccgatagctcacgggtaaaccggagtcgcgtcggaccgtccagcttccactgctgaggctctttctgcagcaggcctatcagccatgccggatccacgttgttcttcggcgcaaaatcgaaataaccgcctttgtcgctggcttcgatcttacgcagacccacagcgcgggctttcagccggataatcgccacatccagcagattacgcgccggatcgggcagcaggccaaagcggtcgatcatctcaaccttcagctcctgcaactcctcttcagcctccgcgctggcgatgcgtttatagagtgaaagacgggtactgacatccgggataaaggtctcgggcagcagggcgggcatccgcagctccacctcggtctggttgctggtgagatcttccagtgacggctcgcgacccgctttcagcgcctcgaccgcattctccagcagctccatataaagcgtgaagcccagcgtctccatctgtccgctctgctcatcacccagcagtttcgccagcaccgcgaatctccaggtcatgcgttgccagggcaaaaccggctcccagatcttccagtgaagcgatcgcctccagccgcttatgcgcatcggcggtcattgacttcggatgcggtgttaacagccaggcataagcctgatgatgcgaacgcccgacgcgaccacgcaactgatgcaactgcgccaggccaaagtgatcggcccgctcaatgataatggtattggcggtcggaatgtcgataccggtttcgataatggtggtacagaccaggacgttgaaacgctgatggtggaaatcgttcatcacccgttccagatcacgctcacgcatctgaccatggccaatcgcgacacgcgcttccggcaccagttcgctgagacgctgagccgctttctcgatattttcaacgtcattgtagagatagtagacctgtccgccacgcagaacctcacgcaggatcgcttcgcggatcaccagatcgtcaaattcacggacaaaggttttcaccgctaaacggcgggcaggcggcgtggcgatgatcgagagatcgcgcatgccgctcatagccatattcagggtgcgagggattggcgttgcggtcagcgtcagaatgtccacatcggcgcgcatcgccttgatgcgctctttgtgacgcaccccgaaacggtgctcttcatcgacaatcagcagaccgagatcgtgccatttgagatcgctcatcagcagcttatgggtgccgattaagatgtcgatcttgccatcgctggcctgttccagcacctgcgcctgctctttggcagtacggaaacgggaaagcatctcaatgcgaaccggccagttggcgaagcgatcgcggaagttgtcgtaatgctgctgtgccagcagggtggtcggcaccagcacggccacctgtttatggttctcaatcgccagaaacgctgcgcgcatggccacttcggttttaccgaaaccaacgtcgccgcacaccagacggtccatcgccagcggctcgcacatatcactcagcaccgcgttgatcgcctgcgcctggtccggggtggtttcaaacgggaagctttcgcagaacagctgatactgctcgcgattatgcttaaaggcaaagccggttttggcggcgcgctgagcatagatatccagcagttcagccgccacatcacgcactttctcagccgctttctgccgtgcgcgtgaccaggcatcgctgcccagtttgtgcagtggtgcattatcgtcagcaccgcccgcgtagcggctgatcaggtgcagcgatgaaaccggcacataaagtttggcgtcgttggcgtaagagagcatcaggtattccgcctcaatgccgccggcttccagcgtggtgaggccgatataacgacccacaccgtgttccagatgcaccaccggctggccgggatgcagctccgccaggttacggatcagaatgtccggattgatagtgcgacgggtatcctgacggcgacggctgacgcgtttcgcccagcaaatcgctttcgcaaatcagcgcccggttgccctgggtatcaataaaaccgcgctcgctggcgccgatcatcagtcgaaaacgctcttcgccgacctcatcgaagcggtgcaccggctgaggacgcagtttaatccgggccagcagatcctgcaggctctcacggcggccttcactttcgaccgagaagaccacggtgccgctgaaggtctcaataaactgacgcagatgatccagcggcgcttttgcctgcgcctgaacggtcagatcaggcagcggggtataaccgaggttggtattcgcggctttggcgggcagcacctcattggtcatctggatgcgcggccaggctttcagctcccccattaatgcatccggacgcagccacagggtggccggttccagcagtggacgcatcggatcaacgcggcgattttcataacgcgcctcggcatcctgccagaagcggctggcgctgccttcaagatcgccgcagttcacaatcagggtattatccggcagatagctgaacagactgggtaacggctgctcaaaaaacagcggctgccagtattcgatgcccgctggcagcgtgcctttgctgacctgctgatagacatgctccgactcacggcgcacatcaaacgtttcacgccagcggctgcggaacagctcaatggcagctttgtcgctgggaaactcatgcgcaggcagcatgttaatttcggggaccgcttccagtgtgcgctgactgtcgacgtcgaacaggcgcaggctgtcgatctcatcatcgaaaaagtcgatgcggtagggctgatcgctgcccatcgggaacaggtcgagcagggcgccgcgcgtggcgtattcaccatgctccatcacctgatcgacatggcgataaccggcctgctcaagctggtcgcgcagccggtcgcgtgacagtttttgtccctgcttcatcaccagcgcatggccgtgcaggaaactgtgcgggcagacgcgctgcatcagggtgttgaccggcatgatcagcataccgcgctgcatcaccggcagctggtagagggtcgacaggcgggcggagataatatcctgatgcggcgaaaagctgtcgtagggcagcgtttcccagtcggcaaggtgcgccaccggcagatcggtaaactggcggatttcatccagcagacgcagagcggtttgggtatcaggtgtaatcatcaacaccggaccggcatgtcgttcggtaatgctggcacactccaccgcgtgcgccgcgcctatgagctggccgagctgacggtgatcgccggatttaacgggcagggtataacgagtctgttcgggcatgggatctcggggttgctccatttttccaggacgtaatcattccatattatgtcagggggatcacctctgcggcacaattttcctgccgcgccgcgctgaaccaggggatcggtcagccattaccgggcgtcagcggtaatcgtgcggataaagagaggatagacggagtctggcaagggatcagaaaaaaccgccgtcgccatgcagcgacggggttaaacgggcattttattttatggattgctgtgtgtaatgcatgcgtgggcggtcgatattcgcccaggataactcctgctcaggatgatagctgaggttaccgtcgtcccactttacgtagtagccggctggtgcgtttccctgctcaaagacgttgatgatttcgcctctgatctccccggatttatgtttaacgatgctgcctttgggaaatttcaacatggtcgctacctcatactgcccggcaataaatcacccgtgatcatggtactgattgtagtctacctccctggacgctgaataatcagccaataagcggcggctttatcggctattccgctgctttggcgcggaatgtgacgcatccggatgcaactttgctgccgactcagagggttagaggtttcataaagccagccgctcctttatcatcccactacctattttcaggcaacggcttactggattccatgtatcaacctgtcgcgctatttatcggtctgcgttatatgcgcggacgagcatcggatcgcttcggtcgctttgtctcctggctctcaacgattggcattacgctcggcgtgctggcgatggtcaccgtgttatcggtgatgaacggttttgagcgtgaactcgaaagcaatattcttggcctgatgcctcaggcgctgatcaccagcgacaaaggcagtctcaatccacaacagcaacccgccagctccctgaatctgcagggtgtcagccgtatcgcgccgctgaccaccgccaatgtggtgctgcaaagcccgcacagcgtctccgttggcgtgatgctgggcattgagccggctgaaaaagatccgcttacccctttcctggtcaatacccggcagagcgtgctgcaggccgggcagtataatgtcatcctaggcgaacagctggcatcccagcttggcgtaaaacgtggcgatcaactgcgtctgatggtgccgtcggtcagccagttcaccccgatgggacgcgtgccaagtcagcgtctgtttaccgtagtgggcacctatgccgctaacagcgaagtcgatggttatcagattctggtcaatcttcaggatgcgtcgcgcgtgatgcgctatccggccggtaatattaccggctggcgactgtggctggataaaccgctgtcggtcgacagtctgagtcagcagacgctgcctgcgggcctggtctggaaagactggcgtgagcgtaaaggcgatctcttccaggcagtgcgtatggagaagaacatgatgggcctgctgctgagcctgatcatcgccgtggctgcctttaacatcatcacttcgttaggcctgctgatcatggagaagcagggcgaagtggcgatcctgcaaacccagggcctgacgcgccggcaaatagtggcggtgtttatggtgcagggtgccagcgccggtattatcggcacgctgctcggcacgctgctcggtgtcttgctggccagccagctcaacaacttaatgccggtgattggcctgttccttgatggtgccgcattgccggttgatattaatgtgtggcaggtggtcaccatcgccctcagcgccatgattgtggcgctgttgtctacgctctatccttcgtggcgcgctgccgccgttcaacctgctgaggctttacgttatgagtaacactcctttgttgcagtgccgcgacctgtgcaaacgctatcaggaaggcagcgtgcagaccgatgtgctgcgcaatgtggctttcagcctccagcccggtgaactgacagcgattgtcggcagctccggttccggtaaaagtacgctgctgcatctgctcggcggcctggatgcaccgacatcgggcgacgtggtgtttgatggccagtcactgaatgcgatgtcctcgtcggccaaagcggagctgcgtaaccgcgagctgggctttatctatcagttccaccatctgctgccggacttcagcgcgctggagaacgtggcgatgccgctgctgattggcaaaacggctaaaacggaagcacaggatcgcgcccgtgagatgctggccgcggtcgggctggaccatcgcgccgcgcaccggccttcagaactgtcaggcggcgaacgccagcgcgtggcgattgcccgggcgctggttaaccgcccacggctggtgatggcggatgagccaaccggtaacctcgatgcacgcaacgccgacgccatttttgaattactgggcgaactgaacgtgcgtcagggcaccgcgtttctggtggtgactcacgatctgatgctggcaaaacgcatgacgcgtcagatggagatgcgtgatggtcagttaagcgatcagctcaccatggcaggagcggtgtaatgggttcgtcgttatccctgttgctgggcctgcgctttagccgtggccgccgtcgtggcggcatggtgtcgctgatttcggtgatctccaccatcggtattgcgctgggcgtggcggtgctgattatcggtctgagcgccatgaatggttttgagcgtgagctgaacaaccgcattctggcggtggtgccgcacggcgagatcgaggcggtcaatcagccgttccagcactggcagtcgatgattgccccgattgaaaaggtgcccggcattgcggcggcggcgccttatgtgaacttcaccggcctgattgagagcggcgcccggctggaagcgctgcaggtaaagggcgttgatccggcacaggagccgcgcctcagcgccctgccacagtttgtggcagataacggctggtcctcttttgccgccggtaagcagcagatcattctgggcggcggcattgctaaatcgctgaacgtgaagcagggcgactggatcaccatcatgatccccaacaacgatggtgataacaaactgcttcagcctaaacgtatccggcttcaggtcagcggtattctgcaactgagcggcatgctcgatcacagcctggcgctggtgcctctcgccgatgcgcagcactatctggagatgggtgacagcgtgtccggcatcgccctgaagatgaccgacccgttccaggcggtcaaactggtgcgggatgccggtgaagcgacccgttcctacgtctacatcaagagctggattggcacctacggctatatgtaccgcgacattcagatgatccgcgccatcatgtatctggcgatggtgctggtgattggcgtcgcctgctttaacattgtctcaacgctggtgatggcggtgaaggataagagcagtgacattgcggtgctccgtaccctcggtgctaaagaccggctgatccgcgccatcttcatctggtacggtttgctggcaggcctgctgggcagcgtcagcggcgtgatcgcgggcgtgctggtggcgctgaatctgacctcactggtgcgcgggctggagtcggttaccggtcatcatctgctggcgggtgatatctacttcattgatttcctgccgtcggaactgcactggattgatgtgttctcagtattgattaccgcgattctgctgagcctgctggcgagctggtatcccgccagacgcgccagccgcattgacccggctcgggtattaagcggtcagtgaaaaaatgcggcgcgaatcctttcgcgccgcatctgtttaagacctttgctgttgggcgcggccctcagcaaccgttactatcgggtgatgttaacccggaatctgtttagagcggctcgccgcagctgctacgccaggagattttatgcgtacaccacgtcgccgcatacgacttgcccgcctgaagaaaacccggagaaaagtgcatcagcgctttcgccagcgcatatttgagcgcgatcgtcaggccgaaactggccgcccatcctcagccgcatgttgtcgtgctgaccggcgcaggcatctcagcggagtccggcatccggaccttccgcgccgctgacggcctgtgggaagagcaccacgttgaagatgttgcgacgcccgaaggatttcagcgcgatcccgcgctggtgcagcgcttctacaatgcgcgccgccagcaattgcaggaggcagagattcagcctaatgcggcccatctggcactggcggagctggaacaggtattaggcgataactttttgctggtcacacaaaacatcgacaatctgcatgagcgtgccggaaacagccgggtgctgcatatgcacggtgaactgctaaaagtgcgctgtgtcaccagcggtcaggtcattgagtggaccggtgatattaccccggacgatcgctgcacctgctgccagttcccctcggcgctgcggccgcacgtagtgtggtttggtgagatgccgctgggcatggagcagatttatcaggcgctggaacaggccgattactttatcgctatcggcacctcaggccatgtctatccggccgcgggttttgtccatgaggccaaactgcagggcgcgcatactgttgagctgaacctggagccaagccaggtgggcaacgaatttgccgagcgacattacggcctggcgagcgaagtggtgccggagtttgtgcataagctgctgcgcgcgctttataagtaagcaggggcggctatggccgcctcgccgtttcttgcccgtcatgctgattccagccgcccggtatttatcagcattgcgaggtttgccgcaacaatctcgtaatcagccgtttttttcgggcttattgctttcccaaaggttatcgacagcgctaacctgtctgcgaatgattttacgcaacgttgtaaccggctggtctgttaataataccggatggcacttttaaaggatgggatatggaacagttacttgagcgctttttaagttatgtggccgttgagacccaggctaagccgcaggcgcgccaggtgcccagcagtgaagggcagtggacgctggcgcgtcagctgcaggaggagttgctggcactgggttttgtcgatgtctccttaagcgatcactgttgcgtcatgggcacgctgcccgccaatgttgactggccgacgccagtcatcggtttcatctctcacatggatacctcgccagactttacggcgaaacatgttaatccgcagatcattgaaaattatcgcggtggggacattgcgctgggtaacggcaacgaaattctctcgccggtgatgttcccggtgttgcacaagctgattgggcatacgctgattactaccgatggcaaaaccctgctgggcgcggatgataaagcgggtatcgctgagatcatgacggcgatggcgcaactggctgcgagcgatacgccgcacggtgcgatccgcgttgcctttacgcccgatgaagagattggtcgcggcacttctcactttgatgtggaaggctttgccgctgactgggcctacaccattgatggcagtgatctgggtgagttcgaatatgagaacttcaacgctgcttcggccaccgtcaaaatcatcggtaacaacgtgcaccctggctccgccaaaggggtgatggtcaatgcgctggatctggcaaaccagtttcatgccgcggtcccggccagcgaaaaaccgcagtatactgacggctatcagggcttctatcatctgcatcagatcaaaggcagcgttgaacacgccgagatgctctatatcattcgtgacttcgaaacggagagttttgaacagcgtaaacagacgctgctgcagattgccgcagagatcaacaaaaccctgcacccggactgttcggtcaccgtcgagatcaccaacagctatcgcaacatgcgtgaaaaggttgagccgtttcccgcacatcatcgaactggctttacaggcgatgcgtgactgcggcattgagccggtagtgaaaccgattcgcggcggtacggatggatcggcgctgtcctggaaagggctgccttgcccgaacatctttaccggtggctataactatcacggcaagcatgagtttgcttcgctgaatatcatggcgaaatcggtggaagtgattgtgcggctgtcagagctggcggcgcagaagaagaattagacccgcaggcacaaaaaaggctctctgccacggcggcaagagagcctgattcagtatcagctcagattattcgtcgccgaagtaccagtatccggcattgaccaggtcggcgatctgcgccagtaccgacgggtcatccagcgcatcgcccagatcgtccagtgtgatgcgatagtggcgcgccaataccgccatcacctcgggatgtgaacactcaacccgctcaccgttgacatagaccgcatcgccaatcgtcaggacacgcaggccacctaaccggctcagggtatcgccctgttgcagcgcatcataaatttcatcaggctggtaaggcggttccggtggcgcgacatcgagttcgtgacgtgactgggaaatgaattcgccaaaccactgagcgaactgctccggctgattgaccacatccagcatcaactgacgtacgccttcaatctcctgcggcagaatctgcgacgggcaatcacgtgcaggcacatccggatcgctgaagcgcaggctgcccagctcattagccagcgcgtaatccgcaaagccgctgattaactcgcgtccgctgggggcacggaaacccacggagtagttcagggcgttttccagcgagtagccttcatgcgggaaccccggcggaatatagagaatatcacccggctccatctcttcatcgatgatggcgtcgaatggctcaacctgcagcagatccggatgcggacagtgctgcttcagcggcaccttttcaccgacgcgccagcgacggcgaccggccccctgaataataaagacatcatactgatcaaaatggggaccgacgccgccgccagggacggcaaacgacaccatcaggtcatcaacacgccagtcaggcaggaaacggaaagggcgcatcagtgcggcagaggcttcatgccagtgattgaccgcctgtaccagcagcgaccagttgttttcacccagatgatcatagctctcgaacgggccgtggctgacctgccatttgccatcctgatggctgaccaggcggctatccacctcattttccatcgccagaccggccagttcatccggtgaaagaggatcgacaaagtttttaaaaccacgcttcagcactaccgggcgtttctgccagtaacgctgaataaaatcgggccagttaatatcgagctgatagtccataaaagggttccgcttagggctgtaaatgccagcaagtataacagccctgagggttttctactcgcggcgatgttcgacttcctggcgctgaaagaccacttccatgcgtgttccgccgagtgcgctaccggaggcgatgacgttgccctcatattgctcaagaatatcacgcaccaccgccagacccagtccctgaccgggacgcagggtgtcggcgcgctgaccccggacaaacactaaatcgcgcttactctcgggaatgcccggaccatcatcgtcaatatagagatggagtgcattttcgctctgaaaagcactgatttcgataaattccaggcagtacttgcaggcgttatcgagcacgttgcccagcacttccataaagtcattctggtcgccaacaaaggtcagctccggtgagatatccagcgaaatcgccacgcctttacgctgatagactttattcagggctgagcagagcttgtcgagcagaccggaaacggaatgcagatcgcgctgcagcgggttgtgatcggcctgcatactggcgcgatgcagataataaccgacctgctgcgagatacgactaatctgctccagcatcaccggctcagcctgttccaccgtcagtttccttgccgttgcgcagcgagcgcagggtgctctgcaacacggccagcggcgttttcaggctgtgggtcaggtctgaaagcgtggtgcgatagcgggtatagcgttgtcgctcattggtcagcaacagattgaggttacgcaccagactgcgcagttcctgcggcggattatccgccagattttcgcgctgactggtctccagttcgcgcacctgctgcgtcagcgcgccaatcggccgcagactccagtgcgccgccagccacagcaacggaatgatcagtatcaggttggccgccagcacatagctgaaccacgaccagaccacatcagaatgctgcaactcctgcgggatagagtcgaccaccacaatggtgagtgcgggcagattcgtggtggcatcgtaacggttaacggcgaccgaatgggtaaaggtatcgttgctgtcattgtcccagtcgttgagtcgttgctgagcattcaggttattgcccatcgccaccatgctggtacggttactggtatcaatctcgtagaagtcaggcttcagcaaccattcacggcggatcttcttgcggatctccggcacgtcgcgttgctgccacaacagcttgccgtgctcatcgtaaataaacaccagcgtcgggaagttgagcgtcatccgttccggctgggcgatggtgagtttgttgtcatgccattgcgccagcgtaaagaacaggttgctctcgccgcgcatcacgcggtaggtgtttttatcgaaactgaccacatagccaatcaccgccaccatgccgtaggagagtgagaggaagaggacgatcgctgcggaggccagcagaaagcgggcgcgcagcgaaatagggcgataacgattaaaccaggacatggtcagagatcaaagcggtagccctggccacgcacggtggcgatcacgtcagtaggatgcaacgccagaatttttttgcgcagacgtcccataagaacgtcgatggtgtggctttcacgcagttcagcgtcaggatagagctgcagcatcagcgagtctttgctcaccactttgcccgcgttacggatcagcgtctcgacaatggtgtattcaaaagcagtgagcttcaccggctgatcattgaccgtcagttcacggcgggagagatcaacctgaaacggggccatatcgatgatttgcgaggcatgtccgctgttacgacgcatcagcgcctgcaggcgtgccgcgacttcttcaatatgaaatggcttggtgacgtagtcatccgcaccggcttccagcgcctcaactttggcctgccagccttcacgggcggtcagcaccagaatcggctggcgcacggcatcgctgcgccagcggcgaatcagagacataccatcttcatccggcaggccgagatccaccagcgcgatatcgggcagatgttcccgaagaaaatagtcagcttctttggcgtcttcggcggcatcgacctggtggcccatgtcacgtaactggacggcgagatgatggcgcagcagggcattgtcttcaacaaccagaacacgcataggaattccttacactctgtttgagtcaacctgcagaaagtatacgcgaaatgtattaaacaagatgttaacgcagaccggactgggccggcctgcggcgggcattatttcagatcgtcaaccatctggatagcgcggccaatatagtttgcaggcgtcatctgcttcagacggactttttcctcttccggcagcgccaggctgtcgataaaggcctgcatgccggcggcatcgacgcgtttaccgcgtgtcagctccttcagcttctcataaggcttctcaatgccgtaacggcgcattaccgtctggatcggttctgccagcacttcccagttgtgatccagttcatccagcagacgatcgcggttcacttccagtttcgagatgcctttcagcgtcgcctgataggcgatcagcgcataaccgacgcccacaccgaggttacgcagcacggtggagtcggtcagatcgcgctgccagcgtgagaccggcagcttgctggccagatgctgcattaccgcgtttcgccaggcccagattgccttcggagttttcgaagtcgattgggttcactttgtgcggcatggtcgacgagccaatctcgcccgcaatggtcttctgtttgaaatggttcagcgctacataaccccagatatcgcgatcgaaatcgatcaggatggtgttaaagcgggcgatgcagtcgaacatttcggcaatatagtcgtgcggctcaatctgcgtggtgtaagggttccatgtgatccccagcgaggtgacgaagttctcgctcagcgcatgccagtccacttcgggataggcggcaatgtgggcgttgtaattccctacagcgccgttgattttgcccagcacctcaatctgtttcagctgacgtaactgacgctccagacggtaagcgacgttcgccatctctttacccatcgtcgacggtgtagccggctggccgtgggtgcgggagagcagcggaatgtcacgatattcgctggcaagatccttcacagcggtaatcagctgctgccagtaaggcaggataacgtcacgacgggctgtttccagcatcagggcgtgcgacaggttgttgatatcttcagaagtacaggcgaagtggataaattcagaaacagcatgcagggcagggacgtcggcaactttctctttcaggaaatactcaaccgctttgacgtcgtggttggtggtgcgctcaatggttttgatgcgcgcggcatcttcttcggaaaaaccggcgacaatcgcatcaaggaaagcgtttgcgtcggcatcaaatgcaggaacttccttgatctctgcggtcgcggccagtttttgtaaccagcgaacttcaacctcaacgcggaatttcagcaaaccgaattcgctgaaaatcgcacgcagcgggctgactttatcgccgtaacgaccatcgacaggtgagacggcggtcagagaggataattccatcagtgcaactcctgaatcatttagcagtgttttgccgcaccgacttagtaagtcagtggcagccgggataagagggttttcgcttcacgcagcaaacgctgacgcgagaacatcagttgcagtcggccaccaccgacctgctgccacaatacggcagcacggataccggctaacagggtggcgcgcactttactctgtacctgcgtattctgcagtaccgcaggcgaaaccggtgacctgaatacgcgggccaagcgggctgatcacatccacatagatggcagccatcgcgctgagaatggtgtctgattccagttcataatgcgccagctggcgatccagctgagtgatgcgctgggccagcgtcgccatggccgttttactggcgctgagcttgcgctccagcaccatcatgctcagggtgtaacgcgtcagctctgcacctgcgccctgacgactgctgctgttcagcaccgccatcagcgtttcaagtccgaggcgcaggttggcttcattgttgccaaacaccgccagcgttgagccaggattgaggtccagtacgctgcgcagcgacacggtcagcgcctccggctggcagtgaccctgctgagccagctgctgcaccagatgggccgactgacagatgcccgccagcgccagcgtaatttcctgataatttttcgccacggttactcctgtttacgcgtcatcaatgcgggctgagcccgcttactccgccactaacggcagacgctgttcgataataccgccaccgaggcagacctcaccaaggtaaaacaccgcagactgacccggcgtcactgctgcaaccggctcgtcgaaacgcacctcaatccgatcgtcgccgtgtgggataatctcacagggaatatcggtctgacgatagcgggttttcacggtgcagcgaagcggggcggtaatcggctggcgatcaacccagtgcagctgctgcgcaatcaggccgacggacatcagacgcggatgatcgccgccctgggcgacaatcaggcggttacgcgccacatctttgtcgaccacataccagggatcatctttgctctctttcaggccgccaatacccaggcctttacgctgtcccagagtatggtacatcagcccctgatgttcaccgacgatctggccttcggtggtttctatttcgccaggctgagccgggagatagcgcgccaggaagtcgcggaatttgcgctcaccgataaagcagatgccggtcgaatctttcttcttcgcggtgataaggtccagctgttcggcaatgcggcgcacttccggtttttccagctcgccaaccgggaacagactttgggcgatctgctggtggctcagggtatagaggaagtagctctgatctttgttgccatccagaccgcgcaacagctggctctggccagccacgtcctgacgacgcacgtagtgaccggtggcgataaaatctgcgccgagatcctcagccgcgaactccaggaacgctttgaatttgatctctttgttgcagaggatatctgggttgggcgtgcggcccgctttgtactcttcgaggaaatgctcaaagacgttatcccagtattcagcggcaaagttaactttgtgcagcttcatacccagcttgtcgcacaccgcttgcgcatccgccagatcgtccgcggcggtacaatactcctcgccatcgtcctcctcccagttcttcatgaacaggccttcaacctggtaaccctgctgttgcagtaaccaggcggaaacggaagaatcgacgccgccggacataccgacgatcacttttttctggctgttgtcagacatgacacgctcgcattacgataaaaaaacaggcggcgcattctatcatgcagaaggcaggcgcgcaccctcgtgaaacggccaccggaatgggctgaccagatgtagcgggtagcgcgtgccctgttgccacaggcgtacgctttccgcgaccagcggcgaacgcaggttagaggcagtgagaatctgcgctggcggcaaccaccagcagcaatcgatgtcgctgtcctgcggctgggttggcgctttttccgcaagatccacgccaaacagaaaacgcacaaaaggcgtactgtcgggcgcgatccactggtttatcgcgatgaaatagtgcatcggcgtggcgatgccggtctcttcatagagttctcgctctgcggcttccagcagagtttcatccgcttcaagatgcccggcgggctggttccaggtggggcgaccgttgatcgtctcttccaccaccagtaattcaccttctgcctgaaccagacaggcgacagtaacatgaggtttaaacatcacttctccgcaattgttaacctgaggttataaaaaaccggttttcagagcgcactttcactgagttcgcgccacgcgcccggagccagatcgtccagcgaataactccccatcgcgtaccgaatcaatcgcaatgtgggaaagccaatgtgggcggtcatccggcgaacctgtcgatttcggccttcatacagcgtgattttcagccactgcgtcgggatgtttttacgttcgcgtataggtggctgacgtggccagagccactcaggttcagccactgtttctaccccagcgggcagcgtcaacccatctttcagattaaccccatcccgcaaaggctgcagatccgtctcctgtggctcgccttccacctgcacataatagatcttacctgtgcgtttgccgggctgagtcagcgcagcctgcagcgcgccgtcgttggtcagcaccatcaatccttcgctgtcgcgatcgaggcgacctgcggcataaacctctgcgacgctgacaaaatccttcagggtacgtcggcccgcttcatcggtgaactgcggtaacacgtcgaacggtttgttaaacagaatcacgcggcgcggagccgcagggcgggcaggggaacgccgcgcatcacgcgtcgggcggctgaatcgtttatcctggtgaattcgttgagaagtttttcgcatgggctttgcagtcagaaacattcggcgcattataacgtgaaattgcggtgattggcgtggcggaaatattcaagtagtattgacgcgcatcttacaaatcattaacaaacgcccaggagaggttaatggaaagcaaagtagttgttccggcggaaggtcagaaaatcaccctgaatcagggcaagctcacagtgccaaacaatccggtcattccttacattgagggtgacggtatcggtgttgatgtttccccggtcatgctgaaagtcgtcaatgcggcggtgaagaaagcctacaacggcgagcgtaagatctcctggatggagatttacaccggtgagaagtcagttgaactctacggccaggatgtctggctgccacaggaaactctcgacttaatcaaagaatatcgcgtggccattaaaggcccactgaccaccccggtcggcggcggtattcgttcactgaacgtggccctgcgtcaggaaacttgacctctacgtctgcctgcgtccggtacgttactacaaaggcacgccaagcccggttaaacgtcctgaagagaccgacatggtgatcttccgtgaaaactccgaagatatctatgccggtatcgagtggaaagcgggctctgccgaagcggacaaagtgatcaagttcctgcgcgaagagatgggcgtgaagaaaattcgcttccctgagcagtgcggtatcggcgttaagccgtgttcagaagcgggcaccaaacgtctggtgcgcgcggcagtggaatacaccatcactaacgatcgtgattcactgaccctggtccacaaaggcaacatcatgaagttcaccgaaggctctttcaaagactggggataccagttagtgaaagaagagttcggcggcgaactgatcgacggcggcccgtggatgaagttcaaaaacccgaacaccggcaaagagatcatcgttaaagatgtgattgctgatgcgttcctgcaacagatcctgctgcgtccggctgagtatgacgttatcgcctgtatgaacctgaacggtgactacatctctgacgctctggcagcgcaggttggcggtattggtatcgcaccaggcgccaacatcggtgacgagtgtgcgctgttcgaagcgacccacggtacagcacctaagtatgcaggtcaggataaagtgaacccaggttcaattattctgtccgcagaaatgatgctgcgtcacatggagtggttcgaagcggctgacctgattgttaaaggtgttgaaggcgctatcgctaacaagaccgtgacttacgatttcgaacgcctgatggatggcgctaagctgctgaaatgttcagagtttggtgacgcgatcatcgaaaatatgtaatcggctttacgtaacatatagccagcacgaatgtaaaaatcgtgttggctttttacttcccgctttctttcctcaaaatctccccaaaacggtttataaaatcaccttcacgcagcaaccacaatccaggctttgccgcgatcatcgttatagcgattactcatctaagcgcttattgctttcgcaccgtgctgtttaagacatttactccgtgagagtgctgctaaatcatttcccgctgactggcattttactctctctgcaaattgaattgtctgatgccacggtaaaagagtgagtgaacgcatatctgtcatccaccctgtcacgcctgatttgttaaacgaccctctgttaatctctttcagtaccagttaagcgcccggcattaaatgtgtcgggccacgttatttgctccttacagctgatccatttttgtaacctgtaccacaaaaaaatagagttacgcatgatccggttgccgcagacgtgtacgcttctgccgatacagagggagagcattatggatgatgaagcggtaagtgatgctattgcggcatgtcgcctgctatttggacaggcggtgatggaaatcgtggctgaaaataagccggtgactggtgaagccatttctgaaaaaattcatcaaatgtttaccggaatcaacccggaaacccgtgatgacgctggctatcagcctgctgacaacccgcgccgactgaccgatcccggtcatcaagccaaagacctcaggccgccatgggcgtaatgccagtcagttaagcgacaggtgataacgcagtctggtgccgctcaggggctggcggtcctcgcgccgctgcgcggttccttcacttcattcgcctgcctgacggaccgccggggatggcacatcctgtgccgccccgcctttcgcccgcgtcctgcgggctctcctggcagactcattatgttcagcgctgcggattgcctgcccctgagcgaccccggcctgctcaggcccgcactgcggctcgctcgcccagaaaaaaagctggcacgtttgaccgtgacagcttttacaaatctaatcttaactgaccagtattacgccatgggcggccttttccttttctgcatgctggcccggcagggccgacgccgtaaaataataatccggttaataattcaggtctgtctctggcctgtcgtgctggcctcatattttaacaatatcgcaactatggaaccaatctgacactgcgctgactaatttgctgactataccgttacgttaccgttttcagaacgttaaccgggcgagtcttactttcattcagccagaacggcgtagcctttgcgcagaggatgtcagacatgcggtttttaattatttgtcgggataatattggcgacaccttactgaccacgccgctgatcagtgcgctggcgcaatcggggcagcatcaggtcgacgtgctgactaacaattacgctgcgccagtgttgcagcataatcccgatatccggcagctcttctattacaccaaactgcatcaccgtgaggcagggcagggacgactggcctgtgtattacagcgactgaagctgatgctgaccctgaaaaaacagcgttacgatgtggtgattctggcaaaaagccgctgggatcagcatggcctgaagtgggttaaaacagtgcgtcccgccagagtgattgccctgggccatccccatccgctgattaccgatctgctgccgccacccagccagtcgccgtgtcatattagtgaaaccctgtttagcctggggcggcctttcaatctcagcgccacagcgccaggcaaactgacgctgctaccggatgcggcaatcgcggccagcctgcgtgacacctgtgcgattgatcccgctgttccggtctatgcattgcagatcagcgcccgcaagccgagccagcagtgggaagccgcgcggtttgccgggctggctgaaaaaatcgcggcgcgtcatccctgccagataatgctgctctggtcacccggcagccgtgataatccgcgtcatccgggagatgatgaaaaagcgcgggaaattatggcgctctgcccgcatctgccgatcaaggcggtggcaaccaccagcctgccgcagttgattgcagcaatgtcgttgtgtcaggggctggtgagcagtgatggcggggcaatgcacattggtgcggcgctgggattgccggtcgtcgcgctgtttggcgacagcgatccggcgtgctggcatccgtggcaggttaactatcaggtgctgcaaccggcgtcacgtgaggtcaatgcgctgagcagcagcgaggtctatgacgccttcgcccataccattactcagtaagcctcttcaggccagcgtcccagtctggccgcttcacacagcatggcgaccgtcagtggacgataaggctgtgctgtgcccgcagtaaaccagtttgccactgcaaagcgccgtcggcgcggctccggaaaatagcgggcgtcatcatactgttctgaacagacgccgaaagtgataaaaaaatcactcatcagaatggcaaagtccacttcactcagcggtaactgctgcagatgaaatcccgcccgatccactttccggaaccagcccagtgcggttggctgattgtggtgctcaatcagcgcaatgatggattgagaaaggtcgttcattaccccaccagtttcgccacggcctgcccgacctcatcggccttgatcgttgccatcggatgctgtgaggcggttttatccgggcggtgaataatgatgtgccgatcgctgtcctggcagggaccggtatagcgcggattggcggtggagaaacaggctgaccgttggcgtctgcgcggccacggcgatgtgcagtggaccggtgtccccggtaaccagcacatccagcgtgcgaatcaggctaatcaggccgctgagattcgttttacccgccatcggggtcacacgctgacggtagtgcaggggcaggctttcaataaattcctgctcaagaggctgctcagcggcggtgccggtaacgataatttccgtgtcaggccagcgttcaagcaaggctgtcgccagctggctgaaggaggccagcggccagcggcgaatatcttttgatgcccctaactgaaaaccgatacggcgatggtcagcctttgcagtcggactgttgttcagtgccggaaggtgcatccgggtctgctctgtctctgcgcccaggacttcaatcagtttcagcttacgcttgatggtatggtcgtcaaaatagcctgaatagtgatcgagatatttatttagcagaggcgactcgcggccgtaatgatcgcgcacaatcaccttactgccggtcagtaccgagctcataatatcgtaggggaaatgggcgtgtaatattactgacaggtcaggtttctggcggcgcagtttgaaaaaaagcggcaggaaattcgccagtttgttatcccagatatagatcttatcaaaccagttataacggctgacgagatccttatttttcttgctggaaaccagaataaatttgctggtgggaaagcgatttttcaggctccagatagccggcgtattcatcagaaagtcgcccagtgccgtggtggagtaaatcaccactgtttgcggggccaggtcgtgcaaggcctgtggttttgttctgctggaaaatcgagaatagagcgttaaaagtcggtctatcagataaatcttttttttcttcacgtctgaattctcttaaacgtatcaataatatttaacaaaaggtgttgtgagttattagagaatatttctgcgactaaagttcattattaaggtttattttttacggccgtagacgtttcgtttaaattgtttccacaattttaatgttgtttattctgggtatatatacagaattgtgtaaaagaagtaagagattattaaaaagagatgggatgattcttataaaaaggaaagtatggaaattattctgattccggctataactaatagcaggttaatgattagcggaattattctatgacttctatctattaaaaaacatgcgataaaacaaaccccggcacgtgagccggggcagggtattacgactgtggctgacccaccgggcctgaacccagcgtaccgcccggtgacgactgaccgcttggtgcatgagggcggccatcatctttaattgcgtcgctcttctgcgagcagcccgccagagaggttaaggtcgctgcaaccagcagcagggcaggaattgttttcataaggtcaccttgatgttgtcagaaagagacgaaaccagactaagcatagatacttaccgcactctggcctgaaaaggcttatctttcagatgtttctcagccggcggaaggcggcctggcaaaaaaaaacggaagccagtggctcccgtttctgttgacgttcagcgcgattacttgcggcccagcaggaagccgataaatacgccaacgcctgcagcaacggccagacctgcaacaggattggattgaacctgatccttgatacagtcagcagcatcgcgggcagcatagcttgcctggttggtgtaacggcgtgctgcgcctttagcctgatgctcagatgaaccggttgctgcaccccattgttcctgaactgcgccagcggcttcttttactttatcttcgatttttcctgacatttattgctccttggttttgagtgagaccctcaaagcgtagcaaagatagtgaattctgctcctccagcggaggaaaatgggctaaaaaatcatttctggctgttaatggcgctgcgtttgcgggtaagggatttactgtctagcctttggaaagagaggcgcactcaggcgctgccacagccatagccaaagctacagccggaggataagcaatgaaacgtgatgcactgaatgatgacgactatgacgaagtttgccgggtcattggcgatgcggtcattgtgctgtcagagcgcggccatgacacccgccgtggcgaaatctacgacctgcttaaacgtatacgtcagcagcgggcccacagtgaacgggatgagcagcggatgctggatcatgctatccggctgattaagcctgaggtttagcatagtgcggaaacgctgcgctactgcagcagcacgccctgaatcagactggcctcaacaatcgtaacctcattaattttcagcgcctgcatataaccttcaaccagtaagagattgctgacatcagtggcccggtagtcgcccgggagttcactgtcgcctttccagacctgctgctgcgacagctgacttaatgccgtcaggctgtaacgatggggtttgcccggtaactgattgcggattgaaaaaccatggacgccgccgatgccaatgacccgacggctcgccagatcctgtttaatctgcggactgacctcattagcggcataaaattgcacaaagcgcagcaccgactgccgccaggagccaatcggattaggggatttggcctccgggctgttcttcagcaccgtcagaataaagtttttcagcgtcaccgaggccagtttgccctgatagatatctgcaaccggctgacccgcctgctgtcgccaggcggtcatctgcatcgatcccccaccaatatcccagaccagcagttgctcatcacggatcgccggatcgttaagcgcggctttagcagagaggaaaccgagtttcgcttcctgctgctgcgagatgatgctgatttgcgcaccggtctggcgctgcaactgatcgatgaccgcctgtccgttgctggcgttgcggaacaccgcagtggcaacgccgctgatgcgctgtggatgaaagcgccgtgcctgcgttaaaagctgctgcagggcggcggcaccttcatgagtcatcgccgggctgagctgattatctgttgaatgcgctaaggcctcgttccaggccacggcgcgctgatcctgatacagcatcttttcgatgcgcagctggcagacattgacacgggctaccgcaattttggtggtgccggaaccgatatccagaccggcgcgaatttgctggcagcgatcggcctggacagcagcggtaaaaaacagtgagcagaaacagcgtgacagcagacagcgcagcagaacgcatagcgactccgggggcaatgaagatcagagtgaacgggcggcgacgcaggccggatagacgctcaccaggaagtgacgcagatgatcaaaacaccattcggcgtcatccgcctgtgggcaatagaactgaatagtgatcttttcataatcgcgctgacgctggcgcaacggcgaccagctccagtcgagtaccgaacgggcataattgaccagcgtctccgcgggcatctgatgttgctgctcctgcccggtcaggtagcgataaaagttcgcttccagctgcagcgcctcctcaaagccgtgttgcggcaggtcgggacgaaaagccacatcgataaagccacagaccgcatctgcctgctgctgccagtcgcaggccagggtcataaacagcccctcctgcagattgatctcctcgaccagccgccgcagattcactgaatggttcagcaccgcgatctcctcaaggcgacctgtttccagcgtcagatcaaagccacagggattcacggagccatccgcattgcgggtggcggggaaggggaagtcgatataaccgttgttatccagacgcttttccatcggggagacctgctgcttgacgtttcctgacaataaaccatctggcagcaggattcatcccttatggacaggtccaggtgatttgggtgtcctggtaagggttgatcaggcggaactgcttatctgacaggcgctgcgcgtaatagccctcaggcgtgacggcggagggaacatatttaaagcgatccagcgactgcagcgggccactcttaacgctgaccttatcccgggtcacggtgaagctattaaccagatcaaaaatcacgccctgggtatgccccatcgactgaccataaattgtcgagacctcacccggacattccacccctttcgggccagatgaacatccagtcaccatcgcgatgaggataaaaatgctgagacgcatcatgattttctacctgcttcaatccctgggagtttcgtggcgcagagtctatcctgctgcgtcactgattacttaatcatagcagtttacgctgcgcttcctgtttgtgatttgtttaatcgttaagcaacaggaatgtaaaagggtgactttgcttatcaataaacgttattcttggctcctttgcgcaccacttaggcaaatccagggataaatgatgaacgaagaagaagcaagtctaatgattattcgccatgcgattgaccagttagaagccgataagaagcaacaggtgatcgcttgttcagcggatatacgtgcagcaatgcaggcttacgatagcgagaatgccgggctggcactgatgttagtggccgccgaggtagcagccgaataatcatatccggtcagtgtggcagcctgttacgctggccggattacttcattttttctcaactttcagattacttcgcacgccgattccatctttcaatggtcttgctgcgggttgccccgcgtcccttctccgtcctgtgatgtgttaagctaaaaaacctcaataaaatcagcggagaaacagcatgaaggcagcattaattgccctgggcctgctggcctgtcacatcgcacccacctggagcgagacggaatttcagcttaactgtcccggccggacaaccatgaccgtttcgcgtgccgaatatgggttaaccacgttaatgtggccgccggggcatttccagattgccgccggtcagcagcgtacccgtttagaggcgggtgataaggtggcgattacccgctttcgcaatggcgatcagctgattgtgaaccagcgcaaccaggcgaccttttttgtctaccgcgacagcgataaactgctgccctgcagccgcagtgaaaaacgcgatgttgatgcgttgagcctggagcgctacgacgatcgtcagcactccgacacttaacccacggagccactatgcaacccgagattaccgataaggtcacaacgcaggatctggatgaagtcaggctgggtctgactgcgttcaacagcaaatatattaatattgatgagatcagatcgatcggcgtgtttattcgtgatgaccagggccgaaagctggccggactgaccggatcaaccgccggaaactggctgcggattgatatgctgtgggtgagtgaggcgctacgcgggcagggggcgggcagcaagctgatgcaggcggcagagcaggaggcgcgggatcgcggctgccgctttgcccaggtggataccgccagttttcaggcgcgaccgttttatgaaaagctcggctatacgctgcgcttcagcctggataactatccacggcatcatcagcgccactatctgacgaaagccctgtaatcagaacaacggttgctgacgcaaatccagcggatgctgttctgcttcatcaatcgcggccagccagctctgcagcgtgacttttttccaggagagatgcccgcgcgtggtactcatcagcaccacgtcgggacgcagggagcggtaaaactccagcgtctggctcagctcagccggattactgtccggcaccagcaccgtgatccagcggtcatgcgaacgcgtcacggtatcgccaacaaacagataggtcagccccagcggcgaggtgtagagatagctgcaactgcccggtgtgtgtcctggcgttggcagcagatggaaatccccgaagtgcgtctcctgctgcgaaaaggtgtcatcaggctcagcaaaacggctgatggggcccagcgatcggctatggcagtaaagtgcgctgctgaagcgctgctggatcagcgccgcaccgggcgcggattcatgccagtgggtgaggtagtggcggatcacgccgccggtatcggccatgacttcatgatcgagcggattttctacgcggccaatcaacagattgccgcgcgggtgacgcagcataaagccatgcatcatcaggtcattaacggcatcttccaccggaaattccggggttgagatccacaaatcgtcatacaacggcttcaatgtcgatctcctgaaacaaacgctattcccgcaggacgggatgcccggtcgcctgcaaacgggcgtggccctggctgaccgctaatcgtgagctggcacccaaaggcagtgttacggtgtcagcggcatgaccaaaatctaatccacaaatcagcggcagaccggtggtgtcacgcagtcgctgccagacggtgctgaagtcaaacccgttgtcatattccgtcagggctgtactggtgaagctgccggtaacgatcgcccgctgtcgcgccagaatgccgctctgctgcagctgaatcagcatgcgttcaatgcggaacggatgctcattcacatcctcaatcaccagaatgccgttctcaaactgcggcatccacggcgtgccaatcagtgagcagatcatcgccagattcccgccccacagtgtaccctgccattcaccctcgtcaggcgtttcgctttgccatgtcacctctactgtaggtgaagtcagtgcctgccagaagtggtgaagggtaaattcagataaggtcgcggcgccgaagttaccggccagcatcggtgcgctgaaggtaatcaggccgacctgcgccagcagtgccagctgaatcgcggtgaagtcgctgtggccgcacagcgccagcggctgattcagcagacggcgttgcaggccgatgtaatcgatggactccagtaaccggctggcaccataaccgccacgcaccgccagcaccacatcgggcagcgtgctgagactggcaagctggttgatatccgccaggcgctccgcgtccgtaccggcgaagcgctgaaaacggcgggtgatcacctgctcgttctctacctgatggccggccgcacgaagtcgtgcaatgccctgcagcgccgcaggctgattgtgacagtaaccggagggggagataagacgaactgaacgtgaaatcatcatactttcctgctgttagcgcctgactgacggcgatgatggcgaaaagcgccgctgaagtcacggtacgcgccgcattttcatgcatttaggataaacggtaattttgctctcaggctgcctgggtatgatagcattcgccacaacagctacgagatgaaaaattgctgaaaatccgacaccttatactctcagcgttactcctgaccggctgtgccagcgagccaccgcaccatgccgttaagcagcgcaacacgccattaactcaggcaccgccgtccagcgtcaatggcacctgggcgatgtttaccgaagatgccgccagtcattatggcgttgatgagaagttgatcagcgccattatcagtgtcgagtcgggtggaaatccgggcgtggtgagccgttcaaatgcggtggggctgatgcagattaaagcttcgaccgccgggcgcgaagtttatcgcacgctgggccgtcgtggacagccatcgaatgccgagttgcgcgatccggccaaaaatattgatatcggcaccgcctatatccgcattctgcagaactccgcgctgtcgggcatccgcgatccgctgaccctgcgctatgccaccatcgtctcttatgccaacggcgcaggggcgttactgcggactttctccagcgatcgcgatcgggccattgcgatgatcaatgcgatgtcaccggatgagttctatcagcatgtgcagaacaagcatccggcggcgcaggccccgcgctatctgtggaaagtcaccacggcttaccgcactatctgaccggttgtgatgaatcctgcggcgtgagcagcagccgcgccgtgggatagtcgatgatcagcaccttgatgtagccgcccagcagcgcaccgcgaatcgcctgcgctttctctcttccgcctgccagcccgaccacctgtggacactgttttacctgcgccagctccataccaatcaccggatcttcttctgctttcagcaccggctgtccgcaggcgtcgaaatagtgcagacagatatcgcctaccgcgccgcgcgccgccagcgtttgcagcatcctgccatcgtagtagttgcccgaattacgtaacagcgccgacggctccagatcgccaatgccgacaatcgccaggtcgacctgctcaaatttactcagcacctcggcgacctctgcgttggcagagagccgctggcgatcgctgaccgaatgctcaatcgactgggacggcagcagccaggcggggcagttcagcagcgccgccagattttgcgtcagaatcgtggcctgcacattgccgttagccccgacgccacccagcagctggatcacccctttgcaggcgctgttgagcggatgcagcgcatccaccatcgcccggatcgtgccgctccatgacgaaataccaatcagctcatcgtttcgcagtcgggtctccagatagtgagcggccgccgatccaatcgcctgcttaatctgcagcgacgacgcctggtccggcacatccaccacaatcgcctgcggcaggttataggtctgctcaatggccttttccagctcagggtagacgttggctggtggcaccacgctgatcttgaccacaccttctttcacgctgcgattaagaatgcgtgagacaaacgactgcgataaggtcagcgactgtgcaatctctgactgcttcaacccttcgacatagtaaagggtggcaatctttaccatcagtcgctgttcatcctgttttgccatcggtttttccctctctgattctgcccggtattgttaaccaggatgatcaaaatcacaacgcaggctaatttgtgatcgttttcgctttttgacgatcgcgcattggacggcacgtcagcgcgggcgcatagtcattatgcatataaaatcgcgtgtgaatatatattcaagcggagaaaaataatgactcgtcctctgatcaaactgaccctgctcgcatcgatgctcgccttttcagcgaccgcgctggcggcagagcaaggcctgctggcgattatcaccccatcccatgacaacccgttctttaaagccgaggcggaaggggccttagcgaaagccaaagagctgggttacgccacgctggtggcgtcgcacgatgatgacgtaaacaagcaaaaccagctgattgagaccgcgattgcgcgcaaagccaaagcgatcattcttgataacgctggtgccgacgccaccgtcgggccggtgcagaaagccaaagatgccgggatcccgaccttcctgattgaccgggagatcaacaaaaccggcatcgcggtagcgcagatcgtctctaacaactatcagggggcgcagctgggcgcggagaaatttgcgaaattgctgggcggcaaaggggactatgttgaactgctgggcaaagagtctgacaccaacgcgggcgtgcggtcgcagggctatcacgatgtgctggatgactacagcgacatgaaaatggtggctcagcagagcgccaactggagccagaccgaagccttcagccgcatggaaaccctgctgcagaaacaccccaacatcgtgggcgtcatctccggtaacgacaccatggcgctgggtgccgaagccgcgctgaaagccgccgggaaaacatcggtgatcgtggtgggctttgatggcagcgactacacccgcgattcgatcctcaacaaaggcaatattaaagcgacggtgctgcagccgggctgggatcaggcgcagatggcggtcacgcaggcggattactacctgaagaacggcaaagcgcagaaacaggagaagcagctgatggactgcgtgctgattgacgacagcaacgccgctaagctgaaaaacttcaacctggcgaaataaccatgaaacggatgctggcggtattgaccggtatggcgctactcagcgcctgcaccgtggtggatctggatgcggacggtaagccgatcctgccgaaggatccgcacgcgaaacccagctataccacccagacaccgcagcagattgcggaagagacctggcagccgcgcgtgatgaccaccgcgaacagccatgcgctgagctgggccgacatggaggcgaaaagtcagacggtcaaacccggcgggcgcgaaagcgtcttcgtgcgagccggggggacagccagcgcctttgatgagagtaacccgcgtgaacgcacgctgacgctgatgattaacggcaagccggtggcggtcagtgtcgggccggtgctgcgcagtaacgctatccgggatgccgccggattccgtttcgaagagtttaccaatcaggtgcagtacgcccaactgacccgggcgctgaaccgtcacgcggtgaagcaactgccaccgctggatgccagctgggtcaaccagccggtgcaggcgctgctggccgtaaccatcgggcagaacagcgttgaagatgtggtggcggttgagctgaagcgggggacgccctgatggacgatgagatcattctgcgggccgaacagatatcgatgctgtttcccggcacgctggcgctggatcgcgtcgactatcgggtctggcgcggcaaagttaacgtcatcatcggtgagaatggggcgggaaaatcgaccctgatgaaaattctggccggggtacagcagcccacggccggttcgctgttcctgaatggcgagccgctgacgctgagcagcacccgcgacgccgcccggcacggcatcggcatggtgcaccaggagctgaatctgtttgagaacctgacggtggctgaaaacctgtttctgggccgggagatccagcgcggcctggccccgatcaacgaggcagagcaggctcgccgcaccgccgcgctgatggcgcgcctcgatcagccgatttcaccccatgagcgggtcggtaatctcaaagtgggtcagcagcagctggtcgagattgccaaagcgctggcggaagatgcggacatcctgatcctcgacgagccgacctcggcgctgagcaaaaccgaagtggagatcctgttccgggtgatccgcgacctgacgcagcagggcgttaccgtgatttatatctcccaccggctggaggagctgatggcgattggcgacgtgatcaccattctgcgcgacgggcgcttccaggcagaagcgccggtcagcagcatcgatgtgccgtggatcgtgcgtgagatgctgggcagtgaaccggtcaccaccttcctgccggaagcgcgtgagtttggcgcgccggtgctggaggcgcagcacattacctgcgtcagccccaatggcaataccctggtggatgacgtcagttttcaggtgcgggccggggaaattgtcgggatttacgggctgatgggcgcaggccgcaccgagctgtttgagtgtctgcttggcagtcagcgtcactatctgggcaagctgtggctcgacagcaaaccgctgccgacccgtctgcccaccgccgaccgtattcgcatgggcatgagtctggtgccggaagatcgcaaacgtgccgggattttcccggtctcatcggtcgccagtaatctcaccatcgccagcctgtggcggcgtctgtcacatcgctttgccattgcccaccaggcggagcagcaggcggtgagccagacggtgggcaacctggcgatcaaaatctcctcgccggacgtggccattagcgcgctgagtggtggcaaccagcagaaagtggtgattggccgcgcgctgctgaccaatccgcgtctgctgctgctggatgagccgagtcgcggcattgatgtcggtgcaaaagcagaggtgtttcgcatgatggtggcgctatcgcagcagggcattgcagtactgttctccacctcggacctgaaagagattatggcggtagccgatcgcatcctggtgatgtcgggcggcaaacttacggctgatcttccccgcgaccaggcggaagaggcagcgctggtgaaagcaagtgcgcaggggttctgagcatgaaaagcaatgacagcgtcgcgctgaccacacttccggctaaggcgttcagttcacgtgaaagcattctgctgctgcttctgaagctgcgcacttttattgcgctgattctgatcgtcggcttcttcgccatcaccgtgccggactttctcgccaccggcagcctggtgatcatggtgaaacatatcgccatcaacgcctttctggcgctgggcattacctttgtcattatcaccgcgggaattgacctgtcgattggggcaacgctgggactgtgcggcatgatcgccggctggctgattaccaaaggcattgtgctgccgatgtttggcatcgctatttttcccagcgtctgggtgattgtgccggtggtgctgctgatcggcgcgctgattggcgcgggcaacggctggatcattacccgctacaacgtggccccctttatctgcaccctcggcaccatgtacatcctgcgcggcgcggcgatgcttacctccggcggcgagacctttcccggtctgcaggggaatccgctgctgggcaacaccggtttcgatcggatcggtgccggaacctttctcgggctgccctacgccatctggatgatggtggtgctggcgctggtgatcgcctacatcgcccgtcgcctgccgtttggccgtcaggtctatgccatcggagacaatgaacgtgccgctgaaactgtcgggtgtgaaaacccggcaggtaaaaattctggtctacacgctgtcgggattctgcgcggcgattgctggcatcgtggtctcatcgcaactggtcgccagccatccggctaacggcaccgcgtttgagatgaatgctattgccgccgtggtgctgggtggcacgtcgctggcgggtggacgcggcaccatcctcggcacgctgattggtgccttcgtcatcggctttctggcggatggcctgatcatgatgggtgtcagtgaattctggcagatggtgatcaaaggcatcgtgattatcatcgcggtgatcatcgaccagacccagagccggatgcagcagaaggcggccgtggtggctcagaaagcgttaatcgaggaggggacaccggcaaaaccctgacggggaagtgcgtgaaaccagacaggaggtgccgctgagtgattccttgcagcggacggcctgcccggtttaatgaacagagtagcgaacaaagggcggttcagtttattagccctctttttcaggcacaaaattttttaaccgacatgaatatatattcataaccgatttaaaattcagaggtagtgtatgaatcctttcaatcttccggtcgatgaccttgagcgccgggcgcgggcaatccgccgccgcatcatccagcttaacgcgggcagcccggcaggcggtcataccggcgctgacctgtcacaggtagagatcctcaccgcgctctacttccgcattctgaactgcgcaccggatcgtacagacgacgatcagcgtgacatctatatccagtccaaagggcatgcggtggggggctattactgcgtgctggcggaagcgggctacttcccgaccgactggctggcaacctatcagcatgccgactcgcatctgcccggccatccggtacggcagaaaacgccgggcgttgagctgaacaccggcgcgctgggtcacggcctgccggtggcggtgggcatcgctatcgcggcgaaaaaagataacagcccgcgccgcatctttgtggtgaccggcgatggtgaactggctgaaggcagcaactgggaggcggcgctggtggcggcgcattacggcctcgacaacctgatcatcatcaatgacaaaaacaagctgcaactggcgggcgcgacccgcgacatcatgaacaccgatccgctgccggaaaaatggcgcgccttcgggctggaggtcaccgaatgcaacggcaatgagatggcggcggtggtcgacaccattgaaaacctgccgaagaacggcaaaccgcaggtgattgtggcgcataccgagaagggatttggcgtctcatttatccagagcaaggcggaatggcatcaccgggtgccgaaaggcgaagagatcgcactggcactggaggaaactgaaagatgagtaatgcacaacatttagcaagcgtcatggtcacggcttttatcgacgcggtgaatcgcggtgtggatctggtgccggtggtagccgactccacgtcgacggccaaaatcgccccctttatcaaggcgtttcccgaccggctgattaacgtcggcatcgctgagcagacgctggtgggcacagcggccggtctggcgctgggcggcaaggtcgcggtgacctgtaacgctgcgccgtttctggtgtcacgcgccaatgagcaggtaaaagtcgatgtctgctacaacaacaccaacgtcaaactgttcgggctgaatgccgggaccagctatggcccgttagccagtacccatcacagcattgatgacattgcggtgatgcgcggtttcggcaacatcgagatctatgcgccttcctgcccgctggagtgccgtcagatcatcgattacgcccttgagcatgtcgggccggtctatatccgtctggatggcaaagatctgccgcagctgcatgaggaaagctaccagttcaggccgggcgcgatcgacctgctgcgtgaaggcagcgacatcgcactggtggcgatgggctcaacggttcacgaggtggttcacgctgctgagcaactggctgagcagggcatttcagccggtgtgatcgcggttccatcgattcgaccttgtgatacccaacagctgcgcaacctgttaaatcactacccagcggtgattaccgtagaggagcataacgttaatggcggtgtcggcagcctggtggccgaagtgctggcggaaggcggctgcggcatcccgctgttgcggctcggcattgcagatggggaatatgcgattgccggcgatcgcgcctctacccgcgcccatcatggcattgatgccagtagcgtggtgaacagtgcagcgcgcatctgcgcaggagcataaacatggtgggacccctgattctggcgatcgacgaaggcactaccaatgctaaagcgattgcggttgatcgcgatggccgtgtggtggcacgcggcagccagagcttaaccctgcaacacccgcagccgggactggctgagcaggaccctgtggcgatctggcaggcggtaaaagaggccattacccattgcctggcagcctgtggtggcgcgcctgtcgcggcagtggcgatcagtaatcagcgcgagtcggtactgatctggcagcggcgtgacggcaagccgctgacgccgctggtgagctggcaggatcgacgatccgagtcactctgtcgcgacctgcatcaggcgggcaaagcacctcgcatcaccggtttgaccggcctggccgttgacccgatgtttccggccgccaagctgaccgggatgctggccgccattcctgacggcgcggcgcgggcggcggcgggtgagctctgtatcggcacggtcgacagctggctcagctggcagctcagcgccggcgaggtatttattaccgatcatgctaacgcctcccgtactcaactctacagcctgcatcttaatgactgggacgacgagctgctgacgctgtttcagctgccgcgcgccgcgctgccgcgcatcaccgcctcagccagtgaacagggcgtggtcgcggtgagtgatattcccggcttagcgccaggcacgccgattctggcgcgcatcggcgactctcatgccgccttacaggcgcagcggcgcggcgagtctgaagtggtgaaagccacctacggcaccggatcttccctgatgatgtccatggcaacgccgctgctgacggaaaatggcctcagcaccaccgtggcctggcacgacggcacgctgcgttatgcctttgaaggcaacattacccacaccggttccggtgccgcctggctgggcagaatgctcggcgtgcaggagccgcgcgagctcaccgcgatggcgcagcgctgcgacgataatcagggcatctattttgtcccggcgctctctggcctgggcgcgccctggtgggatctgcaggcgcgcggcatggtgtgcggactgacggatgccgccacacccgccgtgctggcgcgggtggcgctggagtcgatcgtctggcaaatcgccgacgtcttttttgccatggagcaggccagcggccagcagcttccggcgctcagtgtggatggcagcgccaccgaaaatagctggctgatgcagttacaggcggatgtgttacagcggccgttgcagcgggtgcctaccgccgaggtctccgcgctgggcgcggcactgctggcaggcaaagtgctgggatggtggcagcagggcagtgatatgcaggcgctgcagggcggcagcgtcatcatgccgcgtgaagagcacgcgcagcgtatgcaggaaaactataaaggctggattgacgccgttgcacgctgtcgttatcagccacattaatccttatccggagcagagccatgtcaacacttcctcagcagttaaccttcggcgtcattattggcaaccggggtttttttcccagctatctggtgggcgaggcgcgccagcaggcggtcgcgctgtttgaaaagatgaacattaatacggtgatgctggatgagacccagaccaacctgggcggcgtcgagacgcgtcaggaggcgaaaacctgcgccgcgctgtttcgtcagcaccgcgaagcgattcacggcattgtggtgctgctgcctaactttggtgatgaaaaagccatcgcggaagcgctgcgtctcgccgggctgaacgtgccggtgctggtgcaggccgaagaggacaatctggataaaatgggactggcgacccgccgcgacagcttctgcggcaaaatttcgctctgcaacaacctgcggcaatatggcatcccgtttacgctgacccgccagcacgtctgcgccctgagcggcgacgtgtttatgcaggatctgcagcggttcagccagctctgtcgggtggtgaatgctatgcgtcgggtacgcgtcggggcaattggtgcccggcccgccggattcaacaccgtgcgctacagcgaaaagctgctggagaagatgggcatcgcggtggagaccctggatttatcggagatctttacccgcaccaaccggctgcgcgatgacgatatccgcgtggcagagaagcgtgaaatcctggaggccaacgccgatgcgcggggtattccgggtgaaaaactggtgaccatggccaaactgtttgtggtgatcagcgagtggatcagcgacaacgatatcgataccaccgccatccagtgctggacgtcgttgcaggagaaaacctgggcattaacgtctgctcaatcatgagcgtgatgtcgggccagctgatgcccagcgcctgcgaagtggatgtgatgggggcgctgtcgatgtatgcgctcgccagttgctcgctgaaccccgcctcgctggcagactggaacaacaactttggcgacgagcgggacaaatgtgtgctgtttcactgtggtaatttcgccagcgccagcctggagtcagcgaccatgggcacggcggatatcatcggcaccaccgtgggcaaagagaacacctgtggcgcagtgcatggccgcatgaagcagggcgatctgacctatttccgcctctctaccgacgacttcagcggcgaaatcaaagcctatgtgggagagggaatgtcggtcaccgatccgctggacacggtaggttgccgtgcggtgatccaggtgccgcagctggagacactgctggcgtggatctgccgtaacggctttgagcatcatgtggcaatgaaccactctgccacggctggtgtgctgcaggaagcgttcagtgagtatctcggcgtgagctgctaccggcatcagtaagcggtaaggcggaacggctgaatgcaggggatgaagcagccggtgcggtcacgattccgcccgcaccggcttgtatgcccgccacttctgaaaaagaaaggcgggcactgatttagcgcgccattctgcgcacctcgtcatcgtcattctgcaccgcaaccagatccaccggtggcagattgccgccgctgaactccacctgacgaatcgggaaggcgaagcggatatttcgctcttccagtgctgccatcagctgcaggttaatctcctgctgaatatccatgtacttgttgtaatccgcatccagcacaaaatagaccacttcgaaggtcagttttgaatcctcaaaggccaggaagtgggcacggtcaaaacgggtggtctcaacgccctggataatctctttcaccagcgggctgatctcccggacctgctctgacggcgtggcgtagctgataccaaacttaaagacgatgcggcgctgctgcatgcgcttatagttgtggatcgtctgctgcaacagaatggtatttgagcagacaatctgctcgccactcaggctgcgcagtcgggtggttttcaggccgatgtgctcaatggaaccggcaatgtcaccaaagacaataaaatcgccatgctcaaacggcttatcaaagcctattgccagcgaagcaaacacatcgctcagtacggtctgaatcgccagcgcaatcgcaatacctccgactcccaggctggcgaccagtgcggtaatgttgatgcccatgttcgacagaatggccaggaacatcatgatccagaccaccacccgcagcagaatccccaggatcaccgtagtgaccgggttgcgcacgtgcagcgggtcacgcagcagacttttcagccatagccggatgccacagtcgagccacagagcgagctgcacaatcagcgccaggaaccagccgtgcgcgatggttacactccacgacgcgggcagatcgacaaacttcagggcaatcagcagcgaaaagatcagcagcagggtctggctggtactgcgcaatatctccaccagaatcgcagtggcgcgaacatgacgatgttcgctgtaaagggcaatccggttggagataaagcgaatcagggtacgtaatacccagtaaatcaccagcgtggataccaccacgatggcgctgtttaaccagagttcctgattaaaaaagagggagtgaaaacgacgtgaagagagccagttttccattggggagggtctccttgctgggttccggtttaaaagaaaacaagcaagaagcatagcctggatgcggcccacctgtgtggcgcatccgtaaagcggttactggaatcgggtcgatttatcgcgcgccaggcgctcaagggcaaaaataatctgctgaagctgccgctcctgcgccgggttcagcgtggcaaaacgaaagctcagtcgcggtgtgatgcgggtttcatttttgccggtcaccacgctgcgctcgccaatgctcagcagctttaccggcacgtcaaaatggccatactcgcccagctcgacccggaacgggttgaagctgtcaccgtcctgcaacccgtccggcagcgcttcatcgaccagcacgccgataccgcccagcgacagatcctgcagacgcaggcgcgttttcctgccatcgggccacacggtatgacaccagaaaactgcggctccagcggagcgcagacccggaaaaactcacgtcgctggatctgccagagcaggtctggcagcggcgcgctgaaagcgggtaacccttcaaactccacgatttccagcgaggcgaggctgaattccaccttagcgccgtaggtttccgcggtgatactgagatcgtcgctggtcagggcataatcgttatccagattattactgccgaggtcaaacagcaggcgatcttcatcggcagccagcatccggctgataaactgcccacgcggaaagcgcaccagtaatggcgtctgcaatcgcagcagatctttcataacgccaagaaccgccagcgtgccacgttttagatattgttcctggtcggcttctttcacgtcctgctccacaaggggggttactttattgatgcggtttttttgcctcgtctcggttatcggcgcggctaaaaaaagctttagcatgctattcatcaataataactgtgagcaggcaggcattttttgaaaagctggttatacttatcgcggtaaaccgcttgattaatcaggcgttcacgatttaatcaaaaaaggaaggagcaacagatgggtattatttcctgggtcgtctttggcttaatcgcaggtattctggctaagtggattatgccgggtaaagacggtggcggtttcattctgactatcgttctgggtattatcggtgcagtagtgggtggctggatcagtacgctgtttggcttcggccgcgtcgatgggtttaacttcggaagttttgtggtcgctgttatcggtgccatcgtggtgctgtttatctaccgcaaagtacgcagttgaccgtaaaggtttaaacgaaaaaggggacgaagcgattcgtcccctttttttatctcttattttgcaatcagaagtcgtaaccgactgtcgccattacactgcgctctgcgccccagtagcaatagcccgtgccgtaacagcccgctacataggtacgatcggtcaggttattggcattgacctgcacccatgcacctttcaggctgttgttccagacgccgagatcggcccgcactgacgcatcaaacagcgtaacagacggcacacgcgtggtgttttcattgtccgcccactgtttgccgatgtaacgcacgcccgcacccgcactcagaccgtaatcaaactgatagtgaccccagagtgcagccatgctgttgggtgtgacatatggcgtatgtccgtcgttgccatctaccgactctttaaagcgcagatgattcagcgtatagctcgccacggtgctcagacgcggggttaactgattatgcgcttccagctcgatgccctgtgaatgcactttgcccgatggcgtataagtcgccgtcagcacgtcgcggttcgccacatctttctgcgtcaggtcatagaccgccacgctatagagatcgcgggtgccgaccggctgatatttcaccccagcttcatactgctcggcggtagttggcttcagcaggttgttgttgggatcggtgagcgcggtcggggtaatcgcctggctccagctgacgtaaggcgagataccgttgtcgaaggcatagagcagtgctgcgcggccgctgatgtgatcatcctgacggcggtcactgccgctgttattggcgacaatgcggtcataacgaccggagagatccagatgccagcgatccagcttcatctcatcctgcagatagaggccggtctggtagtagcgacgggttttatcggcccaggtgtaatcaggcatgtcgccaacctgttcaccagtccgtgcattaagctggttggccgagccgccagcggcagtgatctcatttttatagcgatgatactcagcacccagggtgacgcggtgctccagctcgccggtatcgaactccgcctgtaagcggttatcggtggaccaggccgagagcgacgagcgctcgccagagtaatatcggttcagcagatcgggattcacgctgtcccagccaatctgatagacctgatcgagatcgacattcgagtggctgtagctgccggtcgaggagaatgaccagacgtcgttaaagcgatgggcgaaatcgaagctgtagatctgctcgcgacgcttgaactgatcgagatcgctgttgccctcataaaagccgttgctcagcttgtagccgttgtgttcggtgagactgccgtcacccggtaccgaaccgtgatagccgcccgacggatccttctgcagataggctttcaggatcagatgcgtatcttcatccggctgccacatcagctgcggcatcagcgcatatttctcttcgcgggtgtgatcgtactgggtatcgctgttgcgggttacgccggtcaggcgaaacgcccactgatcgttgatggcattggtgtagtcaaacatcgtgccggtggtggcgttgctgcccgcctgcaactggatgtgaccctcttcgctgaactgaggacgcttggtcaccatgttcaccagtccgcccggcacggtctgaccatagagcgcagaagaggggcctttgatcacgtcgatgcgctcaaggaaggcgttatccacctgcaggccgttgaaactgccgccgtcgctcatcagccgcatgccgtcgaggaaggtgttatcgacatcgccgccatggaagccacgcagggcaatggtgtcgtaacgggtcgcggcaccgccgaagttggtgaagacgccggaactatagcccagcgcctggttcagggtcagcgcgccctgatcctgcatctgctggcgggtaaccacggaaatcgattgcggcgtggtgatgagcggacgatcgcttttggttgcgccctggctggtcgtcgccagatagccctgggtcggcgaggtcgaatcttcctgcggttgcgcggttaccaccatatcggcagcataactcagagcaggcgcggtcagcgccagggtgcataggggaacataacctttcagcgacaatgacagtttcatcaaaattcctttcttggcaaaggttcaggcaggtgaataaaagctttgataggcaatctcattatcataatgagaattattaccttttgtaaattggctgcaattttgcctgttgatgaaagaaggtcaagtaaaattcgcggaaatgaagtggggatacccccggcaaggccagaggtatccagagtggattaaggttgtgaggcagacgcctgcggaatatcgtgggcgctgttacaggttttatctttcgggcagtacttatccagcagtttcagcgtgacgccgttggtccagccgaagccatcctgcagcggatattcaccgccaccgccgccgccgagatttttgccatcaacgacatatttctccaccagcttatgctcacggtcataggtgttctgaacgttttgcaggaagcgtaatcccacctctttcgccagttttggctggttgtaatgctccagaccttccacagcaacccactgcagcggtgcccagccattgggtgcatcccactgctgaccgttgttcacggtggtggtcaccagaccaccaggtttcagcagctgtttttccactgcgctggcggtgctttcagcctgcttatcgctggcgacctgcagatagagcgggaacagcgcggcagcagtcagctgaggatggacctgctttttctgccagtcataatcggcgtaccagttctgtttgctgtcccacagatagcggttgatcgccgcctggcgcttctccgcgcgatcggcaaactgcttcgccagatcgctctgcttgttcatctgatagcctttcgacagggtctgctccagatggaacagcaggctgttgaggtcaaccggggccagctgcgtggtacgaattgtcgacaggttatgcgcatcggtaaaccagcgcgaactgaaatcccagcccgacgccgcaccggaacgcagctcccggtagagttcggctttattcctctgcggcgctttctgggcggtggcaatgtcatccatccaggattctgtacgtggcacgtcgcgcgcatcccagtagcggttgagcaggctgccgtccgccagcttaatcacacgcttgctggctgcgcccgccgcgactttatcgctgtctgccatccagtagtcatactctttctgcagctgcggcagataacgggtataggctttgccgttatcgtgcgtcgccagcagatcgaccatcaggctgaagaaacggcggctgtgaccggctcagatagtagctgcggttgccgttgggaatgtggccatagcggtcgagcagcgaggcgaagttatccaccatatcctgcactttatcccagtgtccgctctcggccagccccagcatggtgaagtagctgtcccagtaatagacttcacggaagcgcccgcctggcaccacatagggtttgggcaacggcagcagcgagtcatactgaccggcgctgctggtggtgcgcgtcagcaccggccacaggccatcaatgtggtcacgcaggttttgtccggctggtggcacatatttgtcaccggccgcgggcagggtaaagttggcatccacaaaacgcttaagatcgaaattgcgctgtttcttctgcatctgccagtcggcaagaattgaggcgggatcgaatttcggcaccgcatccgcaaaggtcttttgatcgggatagaacttcgcctgttgcacggcattaaacagcggtcctaaacgaacgtcaggcggctgcggctgattattcagcatgcgactgttgtcgtcggcctgggcagtgaaggcgggtacgctcagcagcaacgtgagcagaaagggcgcataacgctgacgccgtggagcggcgtttacctcaatttttgtcatcggtttttctccttgtccgaaacgcggccgcgcgtaacgcattgaccacaggaccaactttagaccttatctgaccacttcaccctgaagcgagccggaaatgtgaagccacgggaattatttttatggaaaaaaccgctttattacgctggttttttcttgctctcaccctacttttccctgacgctgaaagaaaaaaaggagagcaggatggagatcatctggtatcacccgtcgcagtctgcagcggcctggattaacggtttacaacagcggctgccccaggcgcgggtgcgtgcctggcagccaggcgataatggtccggctgattacgcgctggtccgttcgccccccacagaaatgctacagggacgcgccaccctgcgcggcgtctttgcgctgggggcaggcgtggacgagattctgaaacagctgcagcagaaccctgagatgctgcccgacagcgtgccactgtaccggctggaagataccggcatggcgcggcagatgcaggagtatgcggttcatagcgtactgagctggttccgtcgttttgacgactaccgtctccagcagcagcaacagtgctggcagccgctccccgcttacacgcgtgaaaactttactatcggcatcctgggggcgggcgtgctggggcagagtgtggcggaaagccttaaaccctggggattcccgttacgcgtctggagccgctcacccaaagaaattgatggcgtgaccagctttgccggtcgcgatgcattgcctgcctttctgcaggagacgcgggtggtgatcaacctgctgccgagcacgcacgagaccattaatcttatcgaccaccactttttacagcagctgccgcacggcgctttcttcctcaacatcgcgcgtggcgcgcaggtggtggaagaagatctgctggccgcgctcaatagcgggcagctgaaagcggcggcgctggatgtctttcaggttgaaccgctgccggaagcgcatccgctctggtcacatccgcgcgtcacgatcacgccccataatgcggcggtaaccttgatcgacgaagctatcgactacatcgcccgcgccatcacccaggaccaggcaggcgagccgccgcagggcagggtggatcgtcagcgcggctattaatgaaccggccccgtcaggggcaatcagcaggagaagaggatgtatccggtagatcttcatatgcacaccatcgccagcacccatgcttacagcacgctgcacgactacgtgactcaggcgaagcaaaccggcatgaaactgtttgccattaccgatcacggccccgacatggccgacgcgccgcactactggcacttcattaatatgcgcgtctggccgcgcgtgatcgatggcgtgggtattctgcgcggtatcgaagccaatattaaaaatcagcagggtgaaatcgactgttccggcccgatgctcgatgcgctggatttgatcgtcgccggttttcacgagccggtttatgcgccgcgcgaccggaaacatcacacggatgcgatgatcgctgcgatggcgggcgggctggtccatatcatcagtcatccaggcaacccgaaattcccggtcgatatcccggctatcgccgaggcagccgcgcactacgatgtggcgctggagctgaacaactcctcctttacccattcgcgtccgggcagtgaaccgaactgccgggctatcgccgccgcggtgcgcgatgccggtggacgtctggcatttggctccgattcccatacggcgtttacgctgggtcacttcgatcactgcctgcgcatcgcccgcgaggtggattttcctgaggatcgggtgttaaatgtcacgccgcgtcgcctgctcgactttctggagctgcgcagcggcaaacatattgctgaactggctgacttttagcgccatgccaggtaagcaacacgctcaccatgatgaaaatccccgcttttatctgcggggatataatgactgaggcgagtattttaccgtaacgtgttctcttatcagcccggaaagggcgtgtggcaagacctgaagcttaaagctgagagagcacttaataactgaaaaatggtctcaatcgttcgggttagcaatgtcaacggggcggttcgtccgggcgggtaatggcgtaaactttaagttctactctgctctttattgatcgcgttagatcaaagcgtagaattaccacgcctggtaacgcgctttactaatttaatagttaaccatgctaatagcaaagctgaaattattattgctatgaataatgcattcgctgttgaagggaaaatttgaaatggatttacgatttcaccgagcttcatgtaagcatcttccgaaagggttctgaagatgatttccgggatcactataagataaaatagagtaaatacggtgtataaagccagccacttgatccttttcataagccattctctttgcatacctttcacttcagtatacaatcgttgcataaggaattctacacaaagggatgagtatgagcatgtcttatcttaagattaaacttcaggcagagcgaaccattgcgcttaactttgagaaggcacttgctgagttacatcaaacaatgcttgatacaggaagggggattgtgtctggcgctcaacgtgcaagcggctatggttcatgcttttttgatgactacaaggatgtttgtaatcaacttaagcaggaagatttgcgatacctgaagcaactcagaatgctgtttacccggcaggacgtggttttagagatggtagaaatatacttcagaaaaaaactgagccgtattggtgatacaggcatccagaaacatacagagactgttagctgaaaaagcgtctgattatgcttctggtaaattctctaaacttgctatagcacagttaatcgcgctcgttattacacaatcccgggatttcaaacagtcacatattaatgtaattaatgctacaagttcgtatgccgtaaccgcttttaaattttatggtaagtttgagattgccacaaaagcagcaagaaaattacgcttcgatgatgcggagtattacttcgacttatataatgctaatttagaaatgttctattatttgattgagccggaaatgtctaaaataatctatttgaaaaattcaggttccactagcgaagagcagattttaaatctactaaaaagattttaataaaatgaaggcgatccttcgctggctatatgcctgggtaagtcaatccttctttggacttataccaccagcggccggtctggtcggggccattttttttgtaagcgtttttcctacatatggtctgctgttcgcttttctatggatccttttaattatttatttttgtggaaaatattttcgctattactagtggaggtaagcccccgtatgaaaagtgctttttattttattctatttttttatgaaatttacgagtttgattagcctgttattgcatatcttcattccgcctggctaatagttcatcagaatcagaagttgctggatgatgtattctgaagttttctatgcaaaattaaccagttgctttaagattttttctgaagtatgaactcactttctggctgagatagccaggtgtaagggtggattactcagagtcccggtcatcgccgttgttaagaccgccgatgccggtggacggctggcatttggctccgattcccatacggcgtttacgctcggaaattttgaacattgcctgcgcatcgcccgcgaggtggattttcctgaggatcgggtgttaaatgtcacgccgcgtcgcctgctcgactttctggagcagcgcagcggcaaacatattgctgaactggctgacttttaatttacttgcctcaaggaaatctgactcatgaatgagttttccattctgtgccgcgtgatcggctcactgtttaatcgtcagccgcaggacccgctgctggtgccgctgtttacgctgctgcgtgaaggcaaactgcagtcgcagtggccgctggagcaggatgagctgctgacccgtctgcaacagaaacagcgatccccaggcgctggccgccgattacaacgcgctgtttgttggcagcgattgcaacgtgccgccgtacgcctcacagtggccggaaggcaaaacggagccagaagtgcgtgcgtttttaacctcacgcggaatgccgctgagcgatgcgcctgctgatcattttggtgtgctgatgctggctgcgtcatggctggaagatcagtcagcggaagatgagagcgcggcgcagatggcgctgtttgaagagtatctgctgccgtggtgcggtgctttcctgggtaaagtggaagcgcacgcgaccacggccttttatcgtactcttgccatgctgagccgcgaagcgatccaggcgatgtacaacgaactgctggatagcagcgaagagacgcctgacgcctgattcaccacgtcgccgggtgcgtacccggcgcacagtgctgaatcatctttctcaatgggttctggggggattctctggatacggcgtgctttttttcgggcacctgaaccctctcaatcggcttacaggattaactgcccgggtcggcagccatacagttttgcgagacgttcacgcgtctttttctgcggcttactttcaatacgctccagttgagagatcgcactttgcgtggtacccaactgctgagccacatcatgctggctaagcccccgccagatgcgccaggccgcctgaagactcacttcctgctcaatcataatccctgcaacgtcgtgcgggatcgtctcatcgtcgtgctcgtcagcctccacaggaatcgtctcccattcgccatcgctggccgagagcagcctttcatattccgccaccggcaagaccacaaactggggtttgcctgcttcatcatagatgtactgttttgacatagtttatccgggtaattgtgtgtcgcagcagaggtcgtgagtgcgtaagactatgccggtatccaaaaagctttagtaagtggcggatgttcttcttgctacctctgtaatttccagaatcaccggttcgcccccggttaacgtaaaaaggacccggtagttgccaacccgcagccggtagtgattatcgctgccctgcaattttttaatgtccagtgtgacgaccgggaaacagactaactcacccaccttctggtaaatgattttctggtaacgtttgtcgatcttcataaggtgcttcaatgcccgcctggaccagtctaccctgaccattctgcaccccgtttcaatgaacttcttccctgagccatgtgtaaataataagatagcaatctaataccatcaacattatttttctaattatctaatgtttcgcttcaccacgtcgccgggtgcgtacccggcgcacagccaggcatcgcacagagctgtggggtgccgggcagccaggcggccgctcgcagcctcactccaagcccccacggcgttaattcgtaacagggcaggttatccttaacctgcggcgcaatgccggagcctgtgcgctgatcggtgggatgctgctgcaacagccacgcggtgcgcgccagcgacagccggacctggctgccgtggccctcagtaatgcgtcgccgtaatccctccagcaccgccgccgccagcagatagccgctggcatgatccagcgcctgcaccggcagcgggaccggtttatcgctctgctgccactgcatgcctctttcagcaatgccgcatcccatctgcaccagactgtcaaaaccccggcgattgcgccacggaccctgccagccccaggcattcaggccggcatcaaccagaccgggtgagagtgactgaagggtctccgcgtcaaacccgagccgttccagcgcatccgcccgatagccatgcaccagcacgtctgcttcacgcagcaggtggataaactgctcgcgatcggcgtgctgagtcagatccagcaccgctcgtcgcttgccgcagctcatctcttcatccagcgtcggctcctgccagccgggcggatcgatgcgcagcacgctggctcccaagctggcaagaaaacgggtagcgaccggcccggcaataatccgcgtcagatccagtactttaatgcccagtaaaggacgggcttcggccagcggccacgccggcgccgctgcctgttgtgtggtctgccagctaaatagcggttcgcgctgcacggcctggccctgcggatgctgcttccaggcggcggcactgcgcatctctgcggcacagccacccgcatcaataacggcctgctccagtttcgctggcctgccactgttgcacctgctgcgccagtgctgcgcgatcggcgtgcgcgcccagcacccgctccatcgccagccggtgatgcacggcgttggtgtgcagacggatccagccatcccggctgcgatagtcaccggcaaacgcatcccacatcgcgggtgccgcgcgattcagcggatggaagctctgctgaaaccagcgtgacgccagccggacgttaacggtgacgggcggagagagttcagggcgggatgtggcgataagcgcagcagcagcctgcgttgccagaccgatactggtggccgccagttcactgaccgaaaaggcagaagagaaggtggcgcgatcaacgaaggcggggagaggccaggcggcgtcgcgacctcgcaatccctgctgcatctgctgccagagagaggcggcaagcggtgagtccatgttgtgcttcctgagagaggtgatttctcaagcatagcacgcgggattaacgccgccgcaggcgcgggaagcgggcatgcatccgcaggctacgcaggttgattacggcaatagcggtgccaaggatcaccagcgacgcaccgataatcttgaagctgttgaggctgtcgcccagcaccacaatccccatcagcacggataataccggcgtcagcagtgagtagggcatgatcaggttaacgttatatttcttcagcagcatataccacagtgtataggcgacaattgacgaggcgatagcgctgtaaagaatggcaaaccagccatgccagcccgcattttgcagggcgtagagctgatgtgattccatcaacagactggatgcgccgacgacaggaatggccagaaacgcaatccagccggtcatggtgagcggtttaatcggcggtgacttttttacaatcaggttgctgacagcccagccggtggcgctgcacaacaacagacaaagcacccaccacgacggaatcgtcgggctgccggacagcacgacaacgccgctcagcgagatcataatgcccatcagctgcaccagcttcagcttctctttcagcaccaccatcgccagcagcatggcaatgggtgtaccgagctgaaccacaatcgcgccggtaccggcatcggtatagcgcaggccgacaaacagcagcgaaaagtgcataaaaccgaacgtgaaagccagcagcaacagccagggtaactgctgacggttaatccggcaaaacggtaccagtacgatggcgacgaccacaaagcgcataaacgtcaggaaaagtggcggaagctccagcaggccccatttcaccgcaacgttgttgaaggcccagattgaaaccaccatcagaatcagaaaaaaatgccgcacagccacgataatatcctttcgatgttcttttgcttagcccgctaatgatggcacgaactgcggcattgcagccaatcgcagggagaaattttctgcgattgcggcgcagcctgatgagactttcgggcgcgttgctggcagactgatttgaaacgacttcttaaaggaactgattcggtatgacctacacgtccgccttaccccttgcgttaattcagcttgaagtcccacctgcaaacgttgtctcagagattggtgaacagccgcgctggttcatcgacgcgttaaacctgcaacccgatgaatacctgattgtacggccccatctgggcgaggcgctacccgctttcgaccagatttccggggcgatcctcagcggttcctgggcgatggtcaccgatcacgctgaatggagcgaacgcagcgccgtatggattcgcgcagcgatggatcactgcttgccgctgctgggggtctgctacggtcaccagctgatggcctatgcgctgggtggcgaggtggcggacaatcccaatggatgggaacgcgggctgttaccaatcaactgtatgccggaggcgcagcgcgatccgctactgaagaaattgccacaggacttcagcgtctggctgtcacatcgccagtcggtgatcagcgcgccacaacaggcgcaggtgctggccgcctctgcgcgcgatggctgtcagattgtccgttattcgccgcaggcgctatcggtgcagtttcatcctgaattttcacggcacatcatgaatgtttgtatgcccaaaggctgtacagaagatggggcaaacgagatggaggggaaagactgggcgcgtgagttgctggtggcgtttctggcaacaaacgcgccctgtaatggcgcaagctcagggtgcgtagtgacgcgtgcagcgatagacccaggcgggtggcacgtttttcagcacccgctggcgctcccaggtgaagtagcgcgacaggtctggctgagtcagcgaggtatactggaactgtacaaagacgccgttgggcccgagcgcgttatacaccgcacgcagaatcgcctcccgcaattcagtgggtaatgagagcagcggcaggccggagaagatcacgtcatattctccgctcaggtactccgctgaacaggtgcgcaccgtcatgcgcggatcgttcagcgcatttagcttatcggccagcgtgctgctgatctcaaaggcatccagcgtggcatcgggtgacatctgcgccagtatctgccgcgtcagtacaccgtcgcccgcgccgagttcggcaatacgtaacttttcaggccattccaccgacgcaatcatggtgcggcacagcgcctctgacgagggcgtaatgctgcccatcttgcgcgggttgcggataaactgatgcacgaaattggctttagcgcgcatcagggtaaaagctgaagccagcatgctcatctccagaatgaattcatcctcacgttgacccctttgtgccgcacaagtttctctctgaccagccttttgggtaaaagtcggaattatctaaagacgaagcgtaaacacccattccttcggggcggtcacagtttccggttaacagaactgacaggctcttgatgatgcttcatgttaataataagtttcatcattgttacatcagtcacctgtcaggagaatgatcatgcgttatgccgcccccggagaacagggttctctgattaccctacaaaagaattatggcaacttcattaatggtgaattcgtcgcgccggtgaacggcaactacttcaccaatacctccccggtgaacggctctgcggccggtgagtttccgcgctcagacgttgccgatgttgataacgctgtggctgctgctgcggcggcggcggaagcctggggcaagacctcgccgcaacaacgctcgctgctgttactgaaaatcgccgatcggctggaacagcatctggagacgatggcggtctatgaaacctgggataacggtaaaccggttcgcgaaaccctggcggccgatatgccgctggccgtcgatcacttccgttactttgccggttgtgtccgggcgcaggagggcagtgccgccgagattgatgagtttaccgccgcctatcatttccatgagccgctgggcgtggtagcgcagatcattccatggaactttccgctattaatggcggcgtggaaactggctccggcactgggcgcgggtaactgtgtggtgctgaaaccggctgagcagaccccgctgtcgatcaccgtttttgtcgatctgattaaagatctgctgccgccgggtgtgctgaacgtggtgcatgggttcggcaaagaggcgggtgaagcgctcgcctcccattccggcatcgccaaggtagccttcaccggctctaccgcaaccggcggtcatattctggagctggcagcaaaaagcctgatcccctcgaccgttgagctgggcggtaaatcacctaacatcttctttgaagacatcatgcaggcggaggagagctttatagagaaagccgccgaaggcgtggtgctgggtttcctgaatcagggcgaagtctgtacctgtccgtcgcgtgcgctggtacaggagtcgatctacgaaccttttatggcagccgtgatgaagcgggtaaaaaccatcaaacgtggcgatccgctggataccgaaaccatggtgggcgcgcaggcgtcgcagcagcagttcgataaaattctctcttatcttgaggttgcccgacaggagggcgctgaagtgctggtgggcggtggcgtagagaagctggatgactcacttaacagcggctactacattcagccgacactgctgaaaggcaacaacagcatgcgcgttttccaggaggagatctttggcccggtcattggcatcaccacctttaaagatgaggcagaagcaatcagtatcgccaacgactccatctatgggttaggtgctggcgtctggacccgcgatatcaaccgtgcttaccgtgtgggcagggcgattaaagccgggcgcgtctggaccaactgttatcacctctatccggcgcacgccgcctttggcggttataagaagtcgggtatcgggcgtgagacccacaaaatgatgctggatcactatcagcagactaaaaacctgctggtcagctacagtatcgagccgctgggcttcttctagtttctggcccgcaacctgccaggataaccctgcactcttccctcagaaccacgctacggcgtggttttttttgctccacgtagccgggcgcgctgagaagcatcagaagcatggcgatggctgcaatgccgataaagaacaattaatcagtcctttcttaaagcgacgccgggccgttttgcgcttcgcttatctcgcttcacgaccaccttatcctcagccctttatgaaccgtcccataatgaatcaacttgctgatttgtaaccattatctcacttttttttacgctaaaaactgccacgtattacggtcacctcgccgttaaccttcattacggcttggtgaaacagcgccattttatacatgagtttttttaatgctgactacaggggtgtctggtttctgtgtaagaatacttcatagttgctcatcttgttaagaataatcctaagcgagtgattaaaagtaacacatatttgcactaagtaaattacttaaactttacttaagtaaaatcttatgaaagtggcccgttgaaattttgtcaatcttctgtaaactcgcagcttatgtttacaaaggaattgtgatttcatacctacgggcaggatatacctggctcgtgcggtagctatgagcttatacacatattgtaacttactgaatgtgatcgtaaaaacaggaaaatcagtctatgcgctgcgcttttttcttttgtcagcgaatagcgtcacaagtgtaaatctgagtcaatatgtcagttttcggccagggatggcataagtaaagcttgggttttgcctgcctcatccaatctgacggaaaaaaatagatcatgtttctgatcatttcttgccagctcagatttctcgctgcaaccgtcccggtcgccatagttgctttttaatagttaactttagttgatcttttaacgtgcctcgccatggcactttaacgctatttgcttaaggtttttcttttaggctggcactaagtggcgctctatcagcaccacatccccgattttcattactgacaaccggcctctggccactctccaggatatgaatggaacacaacatgaaaaaaatggtgaagctccgtattgcgttaggcctgatgtttgttttttctgtcgcgggttgtaaaacgccgccaaaaatgacggatgacacgctggtcaccagcaccgtggatggcgtggtgatcagtcatcgttatgcggttaaaccgcctgcgcagttcagcccggtcaatgaaacctaccgtgcgctctatcccgcttcggtgatgagccatccgagttttggcggcaaggtggtggagacgctgaaaaccggcgaaagctacaccgtgattggtcaggtagagaacaactggttggcgctgggtgaacccgctcaggcgtcagcagaacctgaaccgggtaaagccagcagtgccgttaaagagtcaacgccctccgcagcaccgcaggcaactgttcagctgaccggctatgtgccatttcgcgccgtggtgaaaagcgagctttacgatcagacgatcaaggctgaccagccgaagcgccgggtgcgcagcagcaagaagaaaacctgtgttgcggtaaacggtgacagcaccgcctgccagaaacagcactaacggaacctggattattaactaatcgcactaagcagggagggcgggatgatgacaacaacgcaatggcgtggggcgctgatagtgctgctgacgtggctgatgaccgcgtgcagcagtactccacagcccgttgcctggtacaacctggacgttcaggcgcaaaaccaggttaacggcggtgcgccgctgaaagtccgggtggtattactgacctccgatgcggagtttatgtcggctgacttctactccctgcaaaaccagtccgctaccgcgctgggtaatgcgcaactcaatacgcaacagttcttcctgacttccactcagccccataaaacgctgcggattaagagtctgcccgaggcgcgcttcatcggcatcatggcggaatatcaggcgctggatggcaaggtctggcgactgtcgctgcaggttcccgaaggcgaatcaccctcattctgggcgttctggaagcgtgacgatggtgagctgaatgcgcgcattgtggcggggattaacggccttcgcgtggaaaaacagtgatgtctatgaacagagccgaaaaggtggtctggaccgaggggatgtttctgcgtcctcaccatttccagcagtcagaaaattatcttctcagcaccctgcgtgagtggggccagtcgcagcgcgcctatacctggggtttttacgatctggagttcgatgaagcgctgctgcgccaggggaaactggcgctgagcgccgccagcggttgtctgcctgacggcacgttttttgccttcagccagccacagcacggtccggccccgcttgatctgcctgcctccgttgaccgcagcaaagtggtgctggccattccggcacgccgcaatggccgtgaagcggtcgcctttcaggagtcgcaggattctctggcgcgctacctcgcctgggaagcggaagtggaagatgacaatgcccaggccgtgggcagcgccacggtgcagttcggcaaactgcgtctgcggctgatgctggaacaggatctgaccgccgagtggaccgccatgggcgtggctcaggtgattgaaaaacgcagcgacaaccacatccggctcgacagcgactacatcccgccgatgctgacgcttaacagcagccgtccgctgcaaaacatgttcaacgatctgcacgggctgatccagcaacgcagccagcagctgagtcagcgcgcgccgggcaccggtcgttttaacagcgcggatatggtcgattttatgctgctggcgctgctcaatcgtcagcttggcctgcacactcacctgcaacatctgccgctgctgcatcctgaaacgctctacagccactggctgcaactggcggcggagctcagtacctggacgccagcccgcgcgcccgatggcctgccgctctatgatcatgacgatctgcacagctgttttagccgcctgtcactgctgctgcgtcaggggctgtcccaggtgatggaagagagcgcgattcagctgccgctgattcagcgctcgcacggtcttaacgtcgcgaccgtgccggagagcagtatggtgcatgagtttggctttgtgctggcggtgaaagccagcgtgccagccgacaccctcaaaacccacttcccggcgcagatgaaagtcgccccggtcagcaaaattcgcgatctggtgcagttgcaattgcccggtctggcacttcgggcgatgcccggcgcgccgccgcagatcccgtggcatgccggatacagctatttcgaactggataagaacagcgagctatggaaagagatggagcgctcgggcgcttttgcgctgcatcttgccggtgagtttccaggtctgaacatggagttttctgggccattcgtagtcagtcagaatcataaactgagcacgcagcatgatgcaggaacaacaaaaatcacacagcgatcttgcgccggaggccagccatcagaatgtgctggtcgcggcggccaaccccctgattaacgccattcctcagatccgtcactcggtatcacatgaagacccggcgcagctgcgtcagcagctgatcgatcagattcggcgcttcgagctgagctgccagcagtcaggcctgggctatgaagtgatcatcggtgcgcgatactgtctctgtaccgcgctggatgaggcggcggcgctgacgccgtggggcagccgcggcgtctggaccagcaatggtttgctggtcacctttcacaatgaaacctggggcggcgaaaagtttttccagctgctggctaagctgtcgcagaacccaagacgccacattctgatgctggagttgatctacttctgcctgctgctggggttcgaaggacgctaccgggtgctggacaacggtcgctcgcagctggagaccatcaaacagcgcctgctgcagatgatcaaaagcgtgcgtggcaattatgcagcggcgctgtctccgcatcccaccgatcagccggtcctgcgcaaattgtggcggccaatgatcccgctgtgggcctgtgcggcggtggcggggctggcggcctgcctgttctatatcgtgctcaactggcgtctcggcgattacacctcgccggtactggcccgtatctatcagacggcgctgccggaagtgaagatcggcaaccctgcgccaccaccgcccgccacgctgaacctgcgcgctttcctgaaaccggaaattgatgccgggctggtagcggtgcgtgacgaagcggaccgcagcgtggtgacgctgaaaggggacggactgtttgcctcggcggccaccgaggtgcgcggacgttacaccgacgtaatccagcgcatcgctgctgccatgaacaatgtcagcggccagattcaggtgattggctacagcgataacgtgccgatccgcagtgcccgcttcgcctccaactttgagctttcgctggcacgtgcccggtcagtacagaccctgttgcaacagcagctggcgcagccgtcacgggttaaagcggaagggcgcggtgaaagcaatccgctggtgcctaataacagcgcagaaaatcgcgcacgtaaccgtcgtgttgaaattaccctgctggtggcaccggatgcgacgcatgccgaactcaacggcctggcgagagggaactgatccatgctgaatatcctgtttgcggtgctgaccagccgcctcgcgtggggctttgtcggcattaccgcgctctcttttatcatctgggtgattggcccggtgttctcaatcgtcgattcgcgcccgcttgagccggagcagaaccgcattatcagtatcgcgctgctctatctggtgtggggcttaggccaggcgattccgcggctctataacatctggctcaatcgcaagctgatgtcgagcctcgaaaccggcaaaagcgatgcgccggaagccgatcgtcagcgcctgaccagtgaagagcaggtgctggcagggcgtttctccgaagccactgacatgttgaaaaaggcgcacttccagcgccacagcagcaagggcacgccgtttctgggcacagcgctttggccgtcagtatctctatcagctgccgtggtacatgatcatcggcgcgcccggtgccggtaaaactaccgcgctggtcaactcggggctgcagtttccgctggcagataaattcggcaagtcggcgctgcgcggcattggcggcacccgcaactgcgactggtggttcaccaatgacgcggtgctgctcgataccgccgggcgctacagtacccaggagagtcagcaggagcgtgatgccagcgaatggcatcattttctcgacctgctgcgtaaatatcgcggacgtcagccgatcaacggcgtgatcgtcacgctgagcgtttccgatctgctgtcgcagtcgcccgaggcgctgcgtaatcaggcgctggcactgcgtcagcggctgatggagttgcacgatcgccttggcatccgtttcccggtctatgtgctggtcaccaaagcggatctgctcaaaggcttccgcagctactttgcctcgctggataaagcgcagcgtgaacaaatctggggattcacctttccctgggcgaaggcgtccgccgccgatttcgaacttaataaccagttccagcaggagtattccctgctgcaacagcgtctggatgccggactggccgatcggctgctgacggaaagcgacgcgcaggcgcgggcagagagctatctcttcccgcaggagtttgcggcgctgcggccgttgctggcagacgcgctggatacgctgtttgcccgctccgattttgaaacccagttcgcgccgcgcggtatctactttgccagcggcacccaggagggactgccgtttgaccgggtgatgggcgagctgaaccgcgcactgaatctgccggggcagcaggctggcgagtcaggaagctgggataaggtcgataaagagtcgcccatcccgcagaacaaagggcagagcttcttcctgaaaggggtgctggaaaatgtgattttccaggagtccggtctagcgggcagcaaccgctggtgggagctgcgcaaccgcgccgggctctggtcgggttatctggcgctgctgatggtattgctggtggccggggcgctgtggctcaccagctacagtaaaaacaaagcctatctgcaggagatggccgctaaagcgccgcaggttgaacaactgggcgatcagcttcagcagcaggtcaatggcgatctctttgcgctggtgccttatctcaacaccctgttgcacctgccggagagcgccgacttctcactggaagcaccgccgctgacgcgccgcatggggctttatcgcggcaccgaggtcagcgatgccacccgtgcgctctacgacaaggcactgaaacagctgctgttgccgcaggtggcgcagaacatcacccgctggctgcgtaatgacaacggcagtgatgctgactacagctatgaagcgctgaaagcgtatcagatgctctaccagccaaagcactatgatggcaaattcctgcaggcgtggctgatgctcaacctgtcacgcgaactgccgcagaacgttacccagcagcaggtgaaacagctggcgtggcacctgcaacagttgctggagacgcagattcactcgtcgccgtatgcgaaggatgaagcgctggtaaagcgcgagcaggcgctgattaatcagatgccgctgtcacagcgcgtctatggacggctgaagcgcctgctgcaacgtgatgacagcctgcagccggtgacgctggcggcgctgggtggtccccagagcgagctggtgttttcccgcaaaagcggtaaatcggtcaatgacggtgtggcgggtctctatacgccggatggctactggcagcacgtggataagcagattgccccggtgacccaggcgttgtatcaggacgatctctgggtgctgggcggcgcggcgcctcagcagaaaagtgagcagacggatcttgcggtgcgccagctctacgtgcaggactatatccggcagtgggagcagttcctcagcgacattcagctcaacagcagcgccgatctctcgcaacgcatcaacaccgcccgtttgctgtcgggcaaccattcgccgctgcgccagctggtgattaacctcggtggtctgctgacgctgaaccgggcgcaaccggatgagaaaaccgcgcaggcagcaaagccgtcggataacagcgccacccgcacccttgaagcgctgtttacctcgcccgaggccagtgccgcgcgcggacaggccgccacccaggcatcaccggagcaggccgtcgcgcttcactttgcgccggtttctggagctggcccagccgctgcagcagggcagtaaggtgctggcggtggatgacttcctgcatcagattgacgatctctatcgctacctcaccgccgtgcaggatgcggcgaacagcgggatgccgcccccggccagcgatgccatcagtcgtctgcaggccagtgccggccgtctgccgggttcattgcagaacatggtttccagcatggcggtgggtgccagcagcgacgcacagcgccgcgatatggataacgtccgcaaacgcatcaccatggaagtgggcagtttctgccgccaggcgatcgcgggtcgctatccgctggttcgctctgcgcgcagtgaggtcacaccagacgatctggcgcggatgttcgcacccggcagcggcatgatggacagcttcttccgcgacaacctggccagcaaagtcgacaccaccaacccggcgtggcgctttacgccgggcattgacggtaaaaccctgccgggaggcgaagccctgctgcggcccttccagcaggcgcagtcaatccgcgatgccttctttgccaatggtgcgaccacgcccggcttccgcgtcacgctgcgtacggtaaaaatggataacgacatccttaacctgacgctggatgtggatgggcagattttacgctacagccacggaccgcaggcggtacagatggtcagctggcccggccccggcggcaccagccaggtgcggatgcagctgggtctgaccaacggcaccacctccacgctggtcaccagcggtccctgggcgctcaatcgcttctttgaccgcgcccggctgacagcggcaggcggcctgacccgcgaagcgagtttcagcgtggacggtcatcaggtcacgctgtcgttcacccctggcagcattcgtaacccgttccagcttcccggctttagctgcccctgaaacaggacccgacaatgactcattacgctgcaccctgctggtacggcaaagtgcccagcgcgggtgactttgtgaagcgccgcttcccggacgtgctctatcgccaatggtccagctggtttcaggtgggcctgcatcactggcagagcagtcaggagagtgataacgccccgtcgcgcccgttcctcaacgcgccggtctggaattttgtggtgccgccgatgctgggcagtcagctgattcagatgggctgcctgattgccgcgcgtgacagcgtgggccgtaactacccactctgcgcactgcgccacttcacgcccgccgagtggtcgccagccctgctggcgcgctccggcgagtggtatcagcaggtgggcaatacgctgttgcgggtggtgcagggcggcgggtcaccggagcagctggatcaggcgctgatcagcattcctcagccgcagccgccgcaggagtcggacgagacgtcagacattctcaacgtcatcgggcatggcgataccccttcgacactgaactggacactgccgggcgagaacttcgacccgcagttctacaccagtttctggtggaccaatcaaagcgacggtttcccgctttatacccaggttcacagcggtaattttaccgcccagctcttttcattgctgtttgatccggccggtggggcaaagccgggacgaaacggactttatcccccgatgtttgaatcctgaggcgacacgcatgacgatgaatacagaggctctgctggctccggtcagcgaggacaatcccggcggcgataacctggagtaccacgccgattttcaggcgatggagcaggccagcgccggtaaagcggagcagcagttcggtaataccatcattccggcagaaccggccgactggaacagagtcgagaagctggcgatagcgctgctggcgcgcagcaaagatttgcgggtaatgctggcgctgacccacgcctggaccgaactgaaagggctgccgggctatgcccagggcctgaagctgattgaacaggcgttgttgctctactgggagccgctgtggccccggctggaggagttcggcgagcaggatcccttctaccgcattaatgcgctggcgttgctgggtgacaaaactgatctgagcggcgcggtgcgtcagtgctggctgctgcgctatccctctgacggcatcacgctgcgcgatgcggccgccctgtgcgacggcagtaaaaccgaagtcgcggactatcctggcggcctgccgcgtctgatcgacgaactggcgcgcggcgaccagcctggtattgaggcggtgctgcagattcatgagcggctgcagaccatctgcgaaaccgtgaccgaacgactgggcgaagccgcggtgccggagctcacacagctgcgcagacagattgcgctgatcgctgaacgttgccaggccaccgatctgaatgcgctgatccccacagccgccgtggaacagcccgcagaaaccacggcatcgcctgcaccggccagcccgcgcgctgccgctgactggcgcacggtgcagatcagttcccgcgccgacgcgcagctgatgctggagaaagtgaagctctacttcaaccagcatgagccgagtcatccggccccgctgatgatcgaccgtgtacagcgcttaatcgagcgcgactttctggagatcatccgcgaactggcacccgacggcgtacatcagctggaaaccattttcggacgtcgcgattaagcaggcgtgacgcacacacactcagcgggacctgcgcgcctgctgtgacactttatccgcgcatcatgtatggagaaaaccatggcaacaagcaaatccagtgggcagaagttcattgcccgcaatcgcgcgcctcgcgttcagattgaatatgacgtggaaatttatggcgcggaacgcaaaatccagctcccgtttgtaatgggcgtgctggcggatctggtgggtaaaccgctggagccacagccaggcattgatgaccgtaaattcatggaaatcgacatcgacaacttcgatgagcgcatgaaagcactgaagccgcgcgccgcgttccaggtagacaataccctgaatggcgaaggcaagctgaacatcgatctgacctttgacagcatggatgacttttcgccggacgcggtggcccgcaacgtggagccgctgagcaaactgctggaagcgcgtacccagctggcgaacctgctgacctatatggatggcaaaaacggtgcggaagagctgattggtaaggtgctgcaggatcctacgctgttgcaggcgctgacccatctgccaaagcaggatgaggccactgaaggtaaggagccgcaggcatgacgcagacttcacaacaaccgcagtcgcagggcgcagccagtttcagtcaggatgagttcagtgcgctgctgaataaagagttccggccaaaaagcgatcaggcacgtgctgcggtcgaaagcgcggtgaaaaccctggcgcagcaggcgctggagaacaccgttaccgtctccagcgatgcctatcgcaccattcaggcgctgatcgcggagatcgacgaaaagctgtcgcagcaggtgaaccagattattcaccatccggagtttcagtcgctggaaagcgcctggcgcggcctgagctatctggtgaacaacactgaaactgacgagatgctcaaaatccgctttatgagcatctccaagcaggagctgggtcgtactctgaagcgttacaagggtgccggctgggatcagagtccgctgttcaagaaaatttatgaacaagagtatggtcagttcggtggcgagccgtttggctgcctggtgggcgactactactttgaccacagcccgcaggatgttgagctgctgggtgagatggcacgtatcggctcagccgcgcactgtccgtttatcaccggcaccgcgcccgaagtgatgcagatggagtcctggcaggagctggcgaatccacgcgatctgaccaaaatcttccagaacactgagtatgctgcctggcgcagcctgcgtgagtcggaagatgcacgctatctgggcctggtgatgccgcgcttcctggcgcgtctgccttacggcatccgtaccaacccggtcgacagctttgactttgaagagcagaccgatggttccgatcatggcaactatacgtggagcaatgcggcttacgcgatggctgccaacatcaaccgctccttcaaagagtatggctggtgcaccgcaatccgcggcgtggagtcgggcggggcagtggaaaatctgccgtgccacaccttcccgagcgatgacggcggcgtggatatgaagtgcccgaccgaaatcgccatcagcgatcgtcgtgaagccgaaactggcgaaaaatggctttatgccgctggtacatcgcaaaaactctgacttcgctgcctttattggtgcgcagtcactgcagaagccgatggagtatcacgacgccgatgccaccgccaatgcccgcctggccgcgcgtcttccgtacctgttcgcctgctgccgtttcgcgcactacctgaaatgcatcgtgcgcgacaagatcggctccttccgtgagcgtgatgaaatggaacgctggctgaacgactgggtgatgaactatgtcgatggcgatccggctaactcctcgcaggaaaccaagtctcgcaagccgctggcggctgccgaggtgaatgtggaagagcaggaggataatcctggctattactccgcgaaattcttcctgcgtccgcactaccagctggaagggctgacggtttctctgcgtctggtctctaagctgccgtcgctgaaaaatgacaatgcgtaagggctgaaagggagtcgtgatgccggggatgacctggcatcacgtttccgctgagtcacagagttaacaggcgcgaaatggttttacgcctgatgcctgacacaaaggttgctgagataaagtcagggaggatgacaggatgcttaagaagtcagctctgcacctgctgcattatccgctggtatttatttctgctcttattttaataacctgtgcaggttattacattttctcactggagtattgtagtgcgaggaaagtttgttaacgaagttctggttaatgtttctatggatggcgtcaatatcgctttatgccgtagcagaaaagttgaaacaaattaattaaccggctttctgcgcgctattttaattaaaataaaaacaaaggccaggcagccagcggtaaagagaattttaccggcaatgagaccggaagaagagagagtaaattcttcatagcgagcaaccagatatatcgaaccaataatatcagcgatgacgtaaagagaaagcagcgacaacacgactatcaggaaaagtgagatgatctttttcatgttcattccttctgtgaactttttaagcgcctgcctactataaactatcggccagaattatgtctatgaaatgaccacctgaaagcgcgggatgcagcagggtatcaggttatcgatgttggcctcgccatgaaaaacgcatactgatttttgcctggttaaataactggcaatacgacgtctgaaatatggtttatgacgatatttcagaagcaaggcaaaggtaaaatatggactgttttattcagccccatgcttttctttttgccatatccttgcttttttgaaagcaataatctcaaccaataaagagtgaaagataatggctattgatatgtttatgaaggttgacggagtcaccggcgagtctaaagactctaaccactctggctggactgatatcacctctttctcatggggtgcttctcagccaggtaatatgtctgttggcggcggcggcggcgccggtaaggttaacttcaacgacctgcacgtcaatgcactgatcgacaaatccaccacggcgttgctgaagaactgcgcaagcggtaaacacctcgctaaagttgaactctcaatctgtaaagcaggtggctctcaggttgagtatgcacgcattaccctggaagacgttctggtgaccgctgtgaattacaatggctccgacaacggcgacaccctgggaatgacctactccttccaggcttctaaagtgaagcagcagtactgggagcagagttcttccggcggcaaaggcgcagagagcagcgccggctgggacatcaaaggcaacaaagaagcgtaatgttttatagccgcctccccttcgggggaggctttaaaaggagttctgctatggcacatttgagacctcagttttcggccgcctggaatcgcttctctgaagtcaatgttggagtagagaaggtgggggaaatactgggtggaaaagtagaggcgaatatcaccgccggaattttcgagaatgcctgcccaataagaatgagctatgttcttaattacactggtgtttctgttcccgcaaacagccgttatgcgaccgtaacgggtaaagacaaaaagcgttatatgtttcgcgtcaacgatatgatggactttttagtcggtgcgtttggtcagccagacctgactgtgacctcaccaaaacccggctcatttaacggtaaacaggggattattgtgtttcaggggagtggctggagcaatgcccgtgggcacgtgacactctggaaacggcaatatctgctctgatacctgtcacttcctgggtggcgcagaaaatggtagttttgttcctgatgttgcctccttgtggatactgaaatgaaaaaattcctgatgttatttgctctgactttatctcctgcggcgctggcgataacgccaccggcgccagactcctttaagcaaccggagattttcagcaactggcttctgaaccgttgtgcaggaaaagctgcgactgacaaggctttcaccgatgatgcatttaaaagcgcgtcagcctggttagaggtaagtcatctccctgttgaagcattcagtgatggtgataagttaatcaatgagtatctgaagatgaacctgactggctcggtcacaggaaacttcaatatgatgaaatgcacgttgctttcgcaaagtcaggatgcaaaaactctctataataagtataaaaaatagatatctcatatgaaaaattatttatttttaatgctgtgtgtctcagttatttacgttcccctcgtccacgcgatgagtgattgctcaaagggaaataacgttcaggaagttaatgaatgtgcagaaaaaaataaaacagagtcagagctgaatttaaataaagagtacaaggctgcgaaggctcgaattgagaaaatttataagggccatggtgaggagtcaagccagtacagaagcgcctttgttgatactcagcgtaactggcttaaataccgtgatagtcagtgcggtcttgaagcctatgccgctgaacaaggcagcgatgcttatgtgagtgccataaatttctgtattgaccgtctcgatcaggaacgcaccgcgattctgaagcaattgccttattgattatgcctctggctcatttctttcccggcctgacacactcttcatagcggatggtgaatgttgtggtgcagtgtcaggccaaagccttattgccaccagatgatcttgtttaaatgaaattcatacaggccaatcattttttatttttataaaatcaatgcctattcttttccgtattaacgttatgccattttaattcgaaaatttataagctgtgatgtaatgcatttaatttgttaagcagttgctctgttaatttaattaataaatttatcgccactattatttaagataaaaacaactcccaaaattaaatccccccgctttctataccccgcgcctttcccgagaggtgcgcggtatagatgccgaaccgctaaccgcaggaatccgttatgcgctttacgataataacgactaaacccggccaacagccgccgcaaactcattgtgatttctttccgcctggcggcaccattggtcgtggtgtggataataatctggtgctgccggatgacgatcgcacactctcccgcctgcaggcgattgtacacatcacggcaaatggcgaatgtcgcctgaccaaccgtggcaatgtgacgcgcgtgttactcaacgatattccgctggaacgcggacgtcaggttgagctgcaggatggagacatactgggcatcgatgattaccaattgctggtcagcgatctcaacagtgcgcagcaaccgcagagtgaaagagctgttccgcgtcctgagccggtgcagcccgtagcacccgtttcgcgaaccggcagcggaaaaagccagcaccaccgccgccattcccagcgaaatctgggacagcctggcgaaggagttttcgatttcggacgatctctctaaacgcaaagctgcgccagagatgcctgaggcccatccgctgactgcgcccgctcgtcctgaccgaaatccggaagatccgctggctcagctgattaacgatgcaccgctggattatggtcagcagccaaaaaacagcagcctgtttgatgaaggcgatgcgctgttcgggcagcagagtatttttgacgaccggacgccaagcacgctgtctgctcagcagaatacagcgccaccgcaggctgaaacgcctgccgctgaacttgatccgttgagcctgtttgacggcgagagcagcacggatgtgcgcaaccatgatgatccgctgggtctgatgatgggcaacgcggtgccgctggcgcagccggagctgacgacgccgaaaccggccacgttgcatgtgccacctcaaccggtggcaaaaaatgagccgatggccgcacatccatcggagcaggctcccgcgagcctgaccgacatggatcattcaccgctgttcagcttcgacgaatcacagcatgagactcacagccagcctcaccctgaggcacagcagcatacaccgctgattgacgaggaactgcccggccagtctgacgcggtaaatccacagatcgattacggcggaattacgctgcccacgccgcaggcggtacagcgtacgccatccccgacgccgaaagggcggttgcgcatcgatcccgtagcttccggtcgccatcatgccgccgctgcgcacccgacgacacccagcgaaagcagcggtgatgccctcaagggcgaactactggatgcgttgctggagggaatgggtctgcgcgacctgcaaccgacgccgcaatttgaccgtgagcagatgctgcaattcgggcagatgctgagcatgttttctcagggcacggtggcgctgctctcatcgcgttcgatcctcaagcgcggggtaaaggctgacatgacggtgatcctcgacgacgccaacaacccgttcaagctgctgccttcaggcaaaaccgtcttaatgcagatgtttggcagccggatgccgggctttatgccgccgcgtcaggctgtgcgtgatgcgctgatcgatctgcaggcgcaccagctgggcatgatcgccggtatccgcgccatcatcgcctcaatgctgcaatcctttaacccggagcagctggaggaggaggcgcgtcaggcgggatcggtgtcacgtatcggcctgccgggcagccgtaaagcggcgctctgggagcattttgttgagcgctacggcgagacggcgggcgagatcgaagacgatttccacaccctgttcggcgaagcgttcctgcacgcctatgacctggaagttaatcagtacaaagactcacaaacccacacggatgacgcatgaatatcactattgcctcgacgtcgaatcagggcgatcgcgccagtaaccaggatcagatcggtgatgtcatcggtaagcgctcggcctgctttgtggtctgcgacggtgtagccggatttcccggcggggacatcgcggcatcgattgcccgtagcagcctgctgcagtcgtttgatggcgatgcgcatctcaatgcgcagtcgattcgtaactacgtcaatcaggcgaatcacgccatccgccagcagcagaaagccagcagcgaacacagccggatgggcactacgctggtcagcctgtttattgaccgcgactaccatctggcctgctgggcccatgcaggcgacagccgcctctatctgttccgtcgcggctatctctatcttgtcaccaccgaccacagcctggtgcagcagatgaaagatgccggacatcgcaccgaaggcatcaacagcaatctgctctattttgcgctggggatgggcgatgagcagcgtgacgccagctacagcgaggtggtcgggattgaagatggcgacgcctttttactctgcaccgatggtttctggcacggcgtgacgctggaacagatgcagcagtcgctgcacatggtgaatacgccggaagagtggctgacgctgatgcagcaaatcatcaggaacgatcagccggatcaggggcagcaggataatttcagcgcgctggccgtctggattggatcacctcaggacaccaccttgctgcactcgctctctgaagcggcgcagttcttccctctgcgagattgagaacgccaacatgaaatatggattactgggtctggctgcgctgctgctcagcacgcaggcttatgctgaaaactatcgcatcgtacagtccccggcacagaaactggatgtctggattgatgacgtaaaaaacaatcagctgtcgagctggtgtaacagcaccattaacctgcgcatcgtcacgctgggcgaaaaaaacgccgcggtgctgaaagattttctgccgcgcgttgccggactgatggcgtcacagtgtaaaccgctgcaacagttgcactggcaactgaccgatgcgcaggggagtgaaatcgctactggcagcgccgcccgtgcgcagcagtggaaaaccgtggtgacgccgcccgcgactcaaccggtccggccgacggctacagcggtccccgcagacgcactacgcaacgccgctcaggccgacacgtcgccgtggctgcaattcagtctgctggacggatgccatttccgtacctggtggcagcacccggcacagggcagcgcgctgtttgttccggcaaatcaggggctgatctgcggttcggatggctggctcagcggacacagccgactgacgcaacagggtaacggcgcacctgcggcagtcggcgtgaccttcctgcagggttttccggtgatggggttgagcaatcagtcgcccactgccgaactgcacatcaccacggtcaacagtgaacgcatggtgctgagcaatgaaaaatccccggatagctggctgattctgccgttcagcaaccgctttaacggctggcaggcaacgcgtcaggtggtggtgcagatgcccgtcagcgaagccgccgatcagagtgcgctgcaggcgcgtctgcaggaagtccgtaaagtctggtcgccgtggatcagtggcgatgccgcactgagcgtgcagctggtggaaaaactgcatcctgaactgaaagatcccgccgctgcggtttaccgcacccttaactgacgcaaaaggagtttgcatggaatccttacaacaccgtctggccagcgccaccctcggcgagacgctcgctgacgtgacccgccagattcaggcgaatccggcgaatgctgacctgcgggccgcctttgtgcagctgctctgtctttcaggcaactggtcgcgcgcgcaggcgcagctgcaatcctggctggcgttaagcccgcaggcgcaaccgacagttaatctgctgcaacaggcgatcgccggtgagctgcagcgtgacgcggtgctgcgtggccaggccgacccggtgctgccgggcagcgcctggcactggtgcgacacgctgctggccgccttgcaggccgaaacggcgggtgatgtcgcgcgcggcagcacgctgcgggctgaagcgcttgagctcgcggcggccaatcccggcaccgcaacgcagcaggatcagcccaccgcattcagctggctgatggatggcgacagccgtttcgggccagtgtgtgaagttatcagtcagggccgttattactggatcccgtttgccgccattcgtgagatgcagtttcaggcacccgccagcgtcaccgatctggtgtggcgtcacacgcgtgtgcagctggttgatggcagtgagcaggtgtgccagatcccggcgcgctatccgctgctggcggcatctgacgaacgttttctgcgcgccagcgtcaccgaatggcagccactgggcgacgatccggaccagttcatcggtcaggggcagaaaatgtggctcagcgacagcgcggaattttcgctgctgagcctgcagcaggtcgcgtttgacagcgttgagtccgccgatgagccatgattcaggcgcgcaaaacgacggctatgcccagctgcatggcggctttcgcgcgcgtaaaaaacgtgatgcgttaaccgcccgcgacaagctgcaatcctcgctgctggatcgcctgaccgacaacgcgccggataaacagcaggaagcggacaacagcatgctgatcactcacagcacgctgcgccgccacgtactgcgcgatctgcagtggctgttcaacaccatcaacaacgaagcccagcaggatctcagcggctttgatcaggtgcagcgctctgtctggaacttcggtgtggcaccgctggccgggcagaacgtctccgatatcgaatggcaggatatgcagcgcaaaatgaccaacgccattctgcacttcgagccgcgcatcctgccgcagggtttacaggtgcgctgcgtcagcgatctcggctcgctcagcctgcacaacgtgctgtcgattgagatcaaagggcggctctggtgcgtgccttatccgctggcgtttctgttccgcactcaggttgatctggagagcggccatttcgaactacaggatgcagggtaatcatggacagcaatctgctcgactattacaaccgtgaactggcctacctgcgtgagatgggggccgagtttcgctgcgcgctaccctaaagtggcaggacgtcttggcatgcgcggcattgacgtggcggacccctatgtcgagcggctgatggaaggttttgccttcctgacgtcgcgcgtgcagctgaagatggatgcggagtttccgcgtttctcgcagcgtctgctggagatgattgcgccatcctatctctcgccaacgccgtcaatggcgatcgctcagctgacgccggacagccgcaaaggcgacatcacgcagggctttcgcgtgccgcgcggcaccatgatggagagccagaacctgaaaaaaaccggcgtgacctgcagctacaccaccgcgcacgatgtggtactgcatccgctgcgcatcagtgaagccagtctcggcggcgtgcccggcgatctgccctctggcgagctgaaactcggcggcctgggcgcggtcagtgcgctgcgtatccgcatcagctgcgaagggatctcctcgctcagtcagctcagcgtggacgatttgatgctgtttctcagcggcccggatatccaggcgcttaaactgctggagttgctgatgcagcaccgggtgggcatcgtgctgcagtcggttgagaagcgtccgcagcgtcaggtgctgacggacgacgcgttacagcaggagggctttgcgccggagcaggcgctgctgccggacgatctgcgcaacttcgacggctatcgtctgttgcaggagtatttcgcctttccggcgcgcttccagtttatcagtctgagccagctggccccgtttctgcgccgctgcgacaacgccatggcgttcgacatcattattctgctcgataaagcggacagcgcgctggaaagcgtggtcgatcacagccatctggcgctgcactgcacgcctgtcatcaatctgtttccgaaaaccgccgagcgcctgaaggtcagcgacagccagcatgaatatcacctggtggtagataacatccggccgctggattatgaggtgcactcggtacagcggctgttcgctacggtagagggcaagcgggaagagcaggttttccgtccgttctggagcaccttcagcggtgaccagggcgattacggtgcctatttttcactgcgccgcgaacagcgcacgctgtccgagcaggcgcagcgctacggcacgcgcacgggctatatcggttcagaagtctttctgtcgctggtggatgagcatcacgcgccgtggcacgacgaggtgcgctatctctccgctgacgtgatgtgtaccagccgcgatctgccgctgatgctgcagcaggatcagggcaacttcgtgatgccggactccattccggtatcggagctgaagctgtgcaaagggccgacgcctccgcgtccggcgctggccgagggactttccgcgtggcggctgatcagccatctgcagatgaactacctcagcctgatggacagcagcgacggagaaggcgcggcggcgctgcgccagctgctgagcctctacgccaacctggcggaagcgccggtcgcacgtcagattgacggcatccgccactgcacgctcagcgcggtcaaccgccgcgtgccggagccgggcccggtggtgtttgcgcgcggcgtcagcatcacgctggaagtggatgagcaggcgttttcgggggccagcccgtggctgttcggcagcgtgctggagcgggtctgtggccgccttgtggcgctcaacagcttcacggagttcaccctgaacagccagcagcgtggagaagtgggctactggccgccgcgcatgggccggaaagcgctgatatgagtggcgaaaaggtgatttcgctgccccggctcacccgtctgccggatgatttctggcagcgggtgatggccgcgccgtggcgctacgatctgttccagctgctgcggcggctggatgcgcagggcggtcagcgctatccgctgggccgtgcgccgctgccgaagttcgaatcggtgcgtatcggtcagacaccgtcactggcgtttgcgcccgccaccgtcgccagcgccacgccgcgtgacgaggcgggacgtcatgagctatccatctacagcttcggtctgtttggccccaacggtccgctgccgacccatctgaccgaatatgtgcatgaacgtatcgtgcatcatcaggatcacagcctgtcggcgtttgctgacctgtttcaccatcgcgccacgctgcttttttatcgtgcctgggccgatgcgcagccgaccgtgtcgctggatcgccccgacgacagtcgcttccttaactatctcgcctgcctggccggcatcggtttaccggcccagcagcaggccagctcgctcagcctccatgcccgactgatgctggtgggtcacctcagccgccacggccatgatgccgaagggctggtgcggattctgcgccactattttggtgtgccggtcaggctgacgcagaacctgccgcactggctgacgctggacagccgcgatcaggcccgactgggcgcgggacgccatatgccccggctgggcgcttctgcatttctcggcgtggcggtgcgcgatgtgcagcaccgttttcgcctgcacctgggaccgctcagcgccgcgcaatatgcccgttttctgccggatgcccccggcgcgtgtgaagtacgcgactgggtgcgtcactacctcggcattgaaatgcagtgggatctcagcctgatcctggccgctgacgaggtacagggtgtgacgctgggtggaactgcccgactcggctataccagctggctggggctcgcgccgcagccgcaagatcgtgaagattttatgtttgaggttgaggctgcttcgcgctagcccagccgctttccctgttacacagcctgcgtctttcattgaagagagccccctatgtcagaaatcagccgtgccgtgctattcggcaaactggatacgctgttatttacctcgctggaaagcgccaccgccttttgcaaactgcgcggcaatccctatgtcgagctggtgcactggctgcatcagctgatgcagcagcaggatggtgacttacagcaggtcatcacacatttttcactggatgaaaaggccctgactcaggatatcgttgccgcgctggatcgcctgccgcgcggtgccagtgcggtctccgacctctccgagcatatcgacagcgccgttgaacgggcgtgggtttacgcctcgctgaaatatggcgcgacccgcattcgcggcggccatctgcttatcggcatgctgaaaaccttcaacctggccagcgtgctgaaaggcatctccggtcagttcagccgcgtcaacgccgatgcgctgctggcggagttcgacacgctgctcagcaacagcaaggaagcacagcaggtgctgagcgcaccggcggatgctggcggcgcaccgcccgccgccagtggcagtacgctggcacaatatgcgcaggacctgacggcgcgtgcccgtgaaggccgcattgatccggtaaccggacgtgacgacgaaatccgccagatggtcgatatcctgatgcgtcgccgccagaacaacccgttgctgaccggcgaagcgggcgtcggcaaaaccgcggtggtcgaaggccttgcgctgcgtatcgcggcgggcgatgtgcctgcgccgctgcgcgatgtgcagctctggctgctggacatcggcatgctgcaggcgggtgccggcatgaaaggggagtttgaagcgcgactgcaggcgctgatcaatgaggtgcagtccagcccgacgccgattgtgctgtttgttgatgagatccacaccctggtcggggcaggcggtcagcagggcaccggtgatgccgccaacctgctgaaaccggcgctggcacgtggacagctgcgcaccatcggcgcgaccacctgggcggaatacaaaaagtacattgagaaagatccggcgctgacccgtcgcttccagaccgtgcaggtgcaggagccggatgaagccaaagcgattctgatgctgcgcagcaccgtcagcgcactggagaaacatcatcgggtgctgttgctggatgatgcggtcagtgcggcggtgaaactgtcgcatcgctacattccggcgcgccagctgcctgacaaagcggtggcgctgctggataccgcctgcgcccgcgtggcagttagccagggcgcgcagcccgcggcgctggaagattgtcttcaccgtctggcggcgctggagattgaagcagagatcattgaacgtgaaatccgggtgggcctgggcgacgccacccgccagcaggcgattgcagcgcagcgcactgcgctggaagccgagcgggatgcgctgcaacagcgctggcggcaggagcgcgaactggtcgagacgctgattgcgttgcgcgcccgctgtgtgacagaagaggatgcggcgctgcgtgaacagcgtgatgcgacgcagcagcagcttattgcgctgcagggcgacacgccgctgctgtttgccgccgtcgatgcgggcgtggtggctgccgtggtgtcggactggaccggcattccgctgggcagaatggtgaagaatgagatcgacgcggtgctgaatctggccgataccctgaaccagcgggtcataggccagcgtcacggtctggatctgatcgccagacgggtacgcacctcgcgcgcgcgtcttgataatcccaacaagccggtcggtgtgtttatgttgtgcggcccttccggcgtcggtaaaaccgagaccgcgctggcgctggccgagtcgctgtacggcggcgagcagaacatcatcaccatcaacatgagtgagtttcaggaggcgcacaccgtctcgacgctgaaaggggcaccgccgggctacgtcggctacggcgagggcggcgtgctgaccgaagccgtttcgccgtcgcccctacagcgtggtactgctggatgagattgagaaagcccatccggatgtgcatgaactcttcttccaggtgtttgataaaggctggatggaggatggcgaaggccggcacatcgatttccgcaacaccatcatcattctgacctccaatgtcggcacgcagttaatcagcgcgatgtgtgccgatcctgaactgatgcccgatcccgatgctctgagcaccgcgctgcgtaagccgctgctggaggtgttcccgcctgcgctgttgggccgcctgctggtggtgccttactacccgctcagcgacgcgatgctggcggagattgtgcggctgcagctggcgcgcattgtgcgtcgtctggatgataaccacggcattgaagcgcagatcgacgagtcggtggtgagccagatcgtgcagcgctgcaccgaagtcgagtcgggcggtcgcatggtggatgccatccttaccaacacgctgttgccacagatgagccagatcctgctgagcgcccacgcccgtgatgaacgctatcgccgcgtcgatgtgcgttgtgagcagggtgaatttgtctgccagttcgcggtttaaagcctggctatcagagagtaatcgaatatgtcggaacatgatcaacccctgaatgtccccaacgccttgccgctgggttaccgcttcaatgagtttgaaatcaaagaggtcatcggcggtggcggctttggcatcgtctatcgcgcctgggatcaccagcttgagcgtgatatcgcgatcaaagagtttatgcccgcctcactggcagtgcgcagcgatgatctgaatctggtgctgcgcagcgaacggttcagcaaaacctttcacgccggactaaacagctttattcaggaggcgcgtctgctggcgcgctttaatcatccgaacctgctgcatgtgctgcgtttctgggtgcagaacgacaccgcctacatgggcacggtgttctacagcggcaccacactctcgaacttcagcgaacgtaatccgcagtcggtaaatgaggcctggatccgtcgcatgttgccaccgctgctgggcgcgatcaaaaccatccatgaagcgggttatctgcatcgcgatatctcgctggataacgtccagatccagagcagtggcgagccgatcctgctggacttcgggtcggcgcgtaaaactatcggcaatctgtcggatgagagcgagaccatgctgcgtcccggctatgcgccgattgagcagtacagcgacaacgacgagagcgagcagggcgcgtggaccgatatttacgcgctgggcgcggtgctgcataccctgatcaccggtgcgccaccgccagtcagcgtggtgcgcagcatcgaagataactatcagccgctggtgcagcgtcgtctggcaggctactcgtctgcgctgctgagcgccgtcgatcgcgcgctggcgctgaaaccggaagatcgtccgcagagcattgatgattttgctgtactgatggcgctgccggaacgcgaaccggaaccgctgcttagcgcaaaaatgagcggaccaggcaccatgctggtgccgattgaagaagaagaggaggtgatcaaacccgcctctaaactgaaaacgctgctgggacaccgctttgcactacccggcctggttgccgctggcgtgctggtcggcctgggcgccggtctgctgatgtcacgcggtaacgaacagacaccgctggctgagatcacgcagaaacgacgcgccagccgtcaccgtcgcgccggttaaccagccggttgccgcgcctccgactcagactgaggccccgccggataccgttgccagcactccggctcagacatctgagcccgcgcagaccgccgcgcgtgaacctgatccacaaccggcaccaccacccgctccggtcgcccaggtctatatccgtctgcagcagggtgaacgcgttcaggtgaacggtcagccgcaggcgctggtgccggcggtgaatggcttcgccacgctgcagctggcgccgggcaactacacctttgccatcagcggccagagtggcacccgcgaacaaacgctgaacatcagtgaagaaggtgtctggttgctcgatccacacagttaatagtcagggattacttatgttctcacgcattactgcacagctgccggcggacggcctgctgttccatacgcttaaggggaccgagacgctgtcccgtccgtttgtgctcaccgctgaactgctggccaccgacgcgcgcatcgaccgccacgccctgctggggaagccggtgacgtttacgctgccgaccgacgggctgatgaacgcgctgagcccgcgctacctcaacggcaaaatcacccgggtggcggtgcgcagccaggagctgagcggcacccgctacgcggtctatgcgctgacggtcgagccggacctgtggccgatgaagcgcgaccgcaacctgcgcatcttccagagccagacggtgccgcagattgtgcagacgctgctgaaggagtacggggtcaacgtggagacgcgcctggcgggcagctaccgggtgtgggagtactgcgtgcagtatcaggagagcagcctggactttatcagccgcctgatggagctggaggggatttactacttcttccgccacgaggcggacagacacacgctagtgctgtgcgacgcgccggaccagcatcaggcgtttccgggctatgagaccattgcctatcacgtcaccccgtcgggcggcgtggtgactgaagagggcatcagccagtggtcgctggcggagagcgtgacgccgggcatctacagcaccgacgactacgacttccgcaagccgaacgcctggatgctgcaggcgcggcagaacccggcgtcgccggtaccgggctcggttgacgtttacgactggccgggccattttgtcgaccacagccacggtgagtcctacgcacgcatccgtcaggaagtgtggcaggccgagcaccacagcgtgagcgggtcgggcacggctaccggcatcgcgccgggctttaccttctcgatcatcaacgcgccgcacttcagcgacaacggcgagtatctggtgacctcggcgacctatgacttcgccgagaaacgcctacgccagcggcgacaccggcgacagccgtcacaacatccacttcacggtgctgccgtcgtcagtgacctaccgcacgccgcccgaaacggcgtggccgaaaacgcacggcccgcagacggcgaaggtggtgggacccaaaggcgagtcgatctggaccgaccgctacggccgggtaaaggtgaagtttcactgggaccggctggcgaagggcgatgacaccagctcctgctgggtgcgcgtctccagcgcctgggcgggccagggctttggcggggtgcagatcccgcgagtgaacgacgaagtggtggtggactttatcaacggcgatccggaccgtccaatcatcacaggacgtgtttataacgaggcgagtatgccgccgtgggcgctgccggcggcagcgacgcagatggggtttttgagccggtcgaaggatggtaacagcgatactgctaatgcgttgcgttttgaagacaaagcagggcatgagcagatttggatccacgccgaaaaaaatatggatacggaagtggaaagctgtgagacgcaccatgtcggtgtggatcggcagaaaagcataggccgtgacgaaaaggtcacgataaagcgcaatcgtcaggccgacgtgggtgaacatgcggtgagcaatacgggcatccagcacgttattaatgttggcgaaggcgaaacggtgctgaccatggataaagacggcaatgcgctgcttgaagccaacaccagcattaaattaaaggtgaaagagaattacatcttgatcacccccgacgccattcaaatccaggtgaatacgggaaatatccatgctgagagcgagttgcaggcactgtttaaaggcaataagctgaccaccttaggtaccggtaaagatgctgaattaaaggcaaatgatacggtaagcattaccggcacgaacatcaccgacatcaaaggcgcggtcgtcaatattaacagttaatcgcttattgaaaggaacatcagtatgggtatgcctgcggccagagcttctgtggataaagcggctcacgatggccccattcagtgcggcagtcctgacgttatcattggtggatttcccgccgcccgaaaaggtgatgaattttcgtgtaagcaacacggtggcggtattatcgtcagcggctccggcagcgtattcgttaacggtatggcgctggcccgtcagggtgataagacgcagtgtcatgcaggcggggcgacggctcccgctaaatgtaaacctgcgcccccgcaatactggggaggctcgctggcgaagaaggctggtgaggatgggatgttgcatggcgagcactacgatgcgcgaatcttaggggcgtatgccagcctgaaagacagcaccaatgatggtagttatgacactgtgtcgactgggttttcgcttgaaaatctcacattagcgaatatgaaaagtgacgcccttttgaaaggtgagttgcggaataaaatagcggatgccaatgcaactggctcactttacaccggtgatagcggaatctatggcattaatggcaaagccgcagcggcgggtatgcaatatggcgcgacgggctcaataggaacagagaacacattgtatgccatcgctaccggcgatgtgacgcttggcactgctgatgcaaaagcggttgcagaagtatataccggcaataaaggaagatatgggttcagcgttgagggtggcgcaggtgcagcggcagtgaaagagagcgttacggggaaagttagcctgtacggtattgtagtagctgatgctaaaggcggagtacatttaggcgcagtaggtgcagcaggaggtttaactgcctatgcggatgaaaccgattactcagctacagtaaagctctcaggtaggttagcttttatactggggataacaggcgaaattaatgtaaaaattgcattaaaacccctccgcgacctgttttttggtgaaagggatagtacagaaaaatctggaagcaatggtggtgcagatggtgctatcatcaacggttgcgcaacggttttagttggcggttaaataaagatagggttgattctaacatgaaatttatagcatttttatttttctggattgtaacggtttattatgtctggaacggaaaggatttttataacaaaaaagaatgggcaggatttggtaagaagtttgtaggtgtgctggttggtattgtagtacttgcctttgcgctcaaaggattagtgttagctattcccggatttagtaatgatcttgctggagatttaatggaagaaataggcatttcttttatatttattcttggcataaagtttatgattatcatgatttgcactttatttagtgggattgtgggttttcaaaaaaaatataatgctgataattatgcccgaatttcacctgctgccagtaagttagtgcctggcatgctcatctttgcaaaatgcgtggtttctcttggctctatagtcatttattacggcatctggctagcgaattaaattaagaagggaaacaggctatgaattttgaaacggactatacttttccccttacgccgggtttctctaaagaagaaatcgaacaacgcttctggaaatgcctttatacatcggccagagaagaaatgctgcattactgggttgtgctgcctaaaagcctcaaacctgtggaaactggagccggttgccttccctgatgtcggtttaaccaatatcggacgctacttaactacggatgactcactctatctggaagtttgggccgcgtatgaacgctgccagtgggagatgaatgcgtctgattggctgtttaaaaaactcgccatgatgggcgaaaaaatcctgcaccgccgtcttgtcggtaaggcctcggaaaacggtatttttgcagatgtattgaccctaaaaacgcacgcttccggtgacgatgtgatctcacgatacactgttcaaaaagattacaatcgggacagcggcggtgggaactacctcttattaaaagcgtcctgcgcagcacgcgactatccttcgcttgccaatgacatctattttacagtggttaactggaatctgctgcaccgcagtaacttagccatggcggagttgctgacctcggtaaacctggatggggaaaacacttttaaaataccgtcttcatggcatgccagcgttattgctgagaacagacttatcgtcgatcacacgataggtggtgtgaattacggggtcattaatttttacttttattccggtaccgtatgccattccgtagaggatgtttttgaaaagtcgacgctacgtttccgggagcatgagcattccgtcacgctggcggcaaacgagttggaacccattcctaatgatattaatgctgcgctgggttcgatatcgacctgtacaggtgaactctacagcgacgaagagaaaatgcgcgccttttaccagagttacatattcaactgttcaggcttgtggtgctacgttgaactggtagggcagcacaggaatgataaaagttatcactttgaagcgaataaacgctgcgtagaaattattctggcgacactgaatatcaacgtgaaataatactgatcctgccaattaatcatcttttgctggcattccgcctcgtagcaatgagtatcatggcacctctttttaactcttcatgtgatccgctgcaacaataaaagacgcttgtctgacccactggtattgcccggtcgcgggtaatacccgggttaattcaccgattaccattagtccgggaaatcactatgtttgatcgtatcaccgtccttctgccggcggacggcctgctgttccatacgcttaagggcaccgagacgctgtcccgtccgtttgtgctcaccgccgaaactgctggccaccgacgcgcgcatcgatcgccacgccctgctggggaagccggtgacgttcacgctgccgaccgacgggctgatgaacgcgctgagcccgcgctaccttaacggcaaaatcacccgggtggcggtgcgcagccaggagctgagcggcacccgctacgcggtctatgagctgacggtcgagccggacctgtggccgatgaagcgcgaccgcaacctgcgcatcttccagagccagacggtgccgcagattgtgcagacgctgctgaaggagtatggggtcaatgtggagacgcgcctggcgggcagctaccgggtgtgggagtactgcgtgcagtatcaggagagcagcctggactttatcagccgcctgatggagctggagggaatttactacttcttccgccacgaggcggacagacacacgctggtgctgtgcgacgcgccggaccagcatcaggcgtttccgggctatgagaccattgcctatcacgtcaccccgtcgggcggcgtggtgactgaagagggcatcagccagtggtcgctggcggagagcgtgacgccgggcatttacagcaccgacgactacgacttccgcaagccgaacgcctggatgctgcaggcccgccagaacccggcgtcgccggtgccaggctcggtggacgtttacgactggccgggccattttgtcgaccacagccacggcgagtcctacgcgcgcatccgtcaggaggtgtggcaggccgagcaccacagcgtcagcgggtcgggcacggccaccggcatcgcgccgggctttaccttctccatcatcaacgcgccgcacttcagcgacaacggcgtgtatctggtgacctcggcgacctatgacttcgccgaaaacagttacgccagcggcgacaccggcgacagccgtcacaacatccacttcacggtgctgccgtcgtcagtgacctaccgcacgccgccggaaacggcgtggccgaaaacacacggcccgcagacggcaaaggtggtgggacccaaaggcgagtcgatctggaccgaccgctacggccgggtaaaggtgaagtttcactgggaccggctggcgaagggcgatgacaccagctcctgctgggtgcgcgtctccagcgcctgggcgggccagggctttggcggggtgcagatcccgcgagtgaacgacgaagtggtggtggactttatcaacggcgatccggaccgtccaatcatcacaggacgtgtttataacgaggcgagtatgccgccgtgggcgctgccggcggcagcgacgcagatggggtttttaagccggtcgaaggatggcacggcggacaccgcgaacgcgttaaggtttgaggataaatcgggtgaggaacatctgtggattcaggcgcagaagaacatggatacccatgttaaaaatgacgccagccattcagtcgccaacaatcacagccattacgcgggcggcaatgagctctaccgtgtcgaaaccaaccgtgtccacggtgtaaaagggggcgaagagcggctgaccggtaagagcaaactcgatgcggtggtcgatacctatgtagtgggtttcgggaactaaacttcgccttgagtgcggagagagtgctatcgaactgaatgcgaatggccagattaatattgtgggcaagggcttcaatatttttgtgcagggtgatggtcatatcaccacctctggcggcaaactgaacctgaacacggatggcgcgaagccgggcacaagcgcaccgggctccagccataaacagaacatcagccaggccgtagagaatctgttcccgccgaagcagaaaggacaggcggctccggctgcgccaaaagctgcggcggcaccggcgaaaggggcggctgcgccgttaaaacaaaccgctaattcggatgacgctaagaaacttgatgacagtgttgttcgatcaattatgaagtcagaaggagcgggtggtgaacagggcggtgttccggaaatgtacggtttcagaaaaggatttgggcctgcatataaagatatcgcagccgccaggaagaagtatggtcaggggagtgatgaagaatttgaggtggtgtcaaaatatatgaaccagacagcccaaaaagccggggcgcttaattttagtgatccaggaaaacaagcagccgttatgtcattagcacacatgagaggagtgggaggtgctcaggctatactcaattctatgagtggtgatgatatcgtcaaatcttcacaactcactgaaaaatctattgactatgttgaaaaaatgggttcttctgaattccaaaatgaccttgtcagcgccagattgaattatgacaaggctatatatggttcaaccactacggtgaaaaatggtgtttcatataactggtgggatcattattcaaccggtttgactaagcgctataccaatgaagctgctgaatttttgaagttttcaggtgaatgaaatgaatctatttattaagttattttttctggtcttttttacaggtggttcaataggtgttgcaacagcatcggatacccagacggcttattctcagtataataacctgaatagtgtttcagctatttttaatgaccagaaagtcgtttccagtttaaaatctgttttaggcagcgagtacagtgactttagccagaattttgatgtatttggcgagcctcacaaaacagctaaggggggtatatttgtcgagggctggttaaaagatctttatcttgagcaggcttcagcatttgttatacagcctgacggtaaagtgtatgctgcatggatgctgcctgaagataataaaatacattatgtaagcaatgatcttgcaaataataaaatgcaggaagatattgcgagttgggcaaagcgttttgataaagaacagtcagttactcctgctaaaaaccaaaaagaaatgcaaagcaatggcgagaaagttttcgagacggaaaaattcaaaatcagaataacgtcgctttgccctgtgggtttcggagtgtaatgacgttagttatgagggtgtaaggaaatcagatggggcagttgtcagattaaaaggcaaagccatgaaaagtgattgtggtcaagcatcctgcccggtgttgagttataaattccgtaatcatgatgcaacctatattatcaataatgtaattagtaatcttactgttgttgttaataataaaatcgtactatctgaagacggaaaatggaagagtgattccgagtaattaaatttctgtgtgatggtgtgctaattttacgcactatcacacacgatttttgcacatcatatataaatggatttttaaagtggcagatcttaaatataatttatttttcgattaggtgtgctgctgtctgttatttttttatgctcattgtgtaatggcggattatttcactactgaactaaatgcctctgactttcgtgtaattattaatcatcattgttttgctttaggtgaagattgtagcagttaaactcagaagcaggcgggcacgcagataagtgaaaactttgacaatgacaataacctaatctgtgaaaagcgtgatgacaactcgctcagtcaggcgctgtaactctaaatttacctaatcttaacggctggattaatagggttaatgattgtctggattttaaaggttaatcaaatgaataaagttggatttagcttagcggttttgttgtcaatttcttcattatccttgtttgcttctgataattttactggtcagtggagtgggcaagagaaaaatgataatggatcactatattccactctaacattaaaattaaaacagaataataataacataacgggtagttattgttatgtgacaaggggcggaaataaaatagattgccctgatgataatgacagcaatctcaaaggtacggcaaacggtaaaaatgctttgattgaatttgattcttcatttggcggagtgaagggtaaagcaaatttagaacttaaagataataaagttttatggaagttaatcaaagaccctgagaatggggatttttatgcgccaaaaacttataatcttgacaaagatgttagtgaaggagatttaaaatcagatatgaaggttttgtctacatctgatttcacgattactttattgaatagctgtgggggtttttatactgtgtgtgataaggttaaatacataggcctcagaaataaagatggaaaacaaattactcttgaaggtaaaactacgcagcctgtaaactcaaataaagctgaagggatgattttcaataatagcggtgtagattatgttgtgagctttaatccgcttgaattgaaggtggtacagggtaataaaacgcttgttaagcaaggtggcaagtgggaatgataattttcattatcactcaagtgagatttttactgtatttcaagtaataagaatgacattataatagtgttatgggttttattagggtggtgatatgtactctccaccccacataattttgaagtgtgagtaatttctttaatttaaaagattttaattacgttgctcttagtgattaaatacccttctatttttctattgtcaacccccgataaaaacacaatgattgtaaaccgttatttcgccagcattgtatttgtgcctgtcctcatggttttatcctgcattgccagggccgaatccagcacggaatcgaccgttcctgcccttaacgagggcgatttttccgttctgctaaacgactatgctttcactcccggagacacatggagcaatgaaagcttcgtacgggctggtaaggctctgagttcagttttctggccggagaagtggctatcaataaccagcagtacaactacttccagcatagctatgacggctttgagttgttcagcgcggcggcggttggagatgccagccacacggttctggctgagatccttctggaaaatgccaatgtgccgacgtcccgaaatataaaggtaggcgatagccttgaacaggttcagcaagcctatggacccggaaaagaagataacagtgatgatcagcactggcttgtctacccgtctggcgggaaacagttgatgttccagattgaccagggaaaggtcagctgcatcatgttgaaaacagacatgggtgcagagcaaagcgaaatcagcgctgaccaggctatcagcgctgcaaccgaagcaattcatacctggcacctgaccaccctcgacgagaaatgcctgcgatacgatcttgacgacagcagtgatgaaagtttctttattattacggttcgtgaagataatcacgacgccagttgcggtggcgatcctgatattacgcatcgacttttcgacattaaagttgcgcgtgataatacacagatactcactaatgccgataacgttgatggcgaataccatagcctgattccacccgccacaaacaattaataaaacggatacccaatatgcattaccaattcaatgagggcgcctttgcgctttttcctgctgcctggcaggacaccaccatgaatattctccgcgatgaagccagtgggctggcctgggttgtgagccgtggcgttatttctgagggcagtgatgcggaaaaagagtttcagcgtcagtgggacacattgcggagtcagatgggccatatccagcaggctgagtttgtacgtttgatggcaggtgtagataacacattacacgcggtagaagttgaaaccgtatttgaccgtaacgggcaggcagtgtggcagaaacagctggctacacaggtgcctgaatcgaacatcttaatgatttttacgctctcagccatgcgtccattcaatgaagaggatggacagcgctggagtgcatttaaacaaagcctgagtctgaacaatccacggaaagcataacctatggataaccctgctgcccgcgtgggcgacgagatcattcactccagcattttcgctgatatcacaagcattgttgcggaaggtgcggcctatgccgtcattggtgccgcagtgggtgctgctatcgtctcggcagcgcccctgctgggcacaggggcggcagcggcgagtgtggcagccgtgggtaacagttgcctgctcagcggtattctgggtggtgtactggccaatgccgttggtctgtcacaagagatcagcaaagcggccgatgggctgggaaacatgatattcccgccgtcacctgccggagtaatcgccagtggatcagtgaatgtctacgttaatggtcttttagccgcacgcgcggccgggatgctcacgcctggcgagacaccgccaccggaaccgcaatcgccgcagagcttcgcggactatggcggcatgttgctctctgcggtcggccagtttggcagtgcaatgtggcagcccacggtagcctccgccgatgcgggcacctctccgctggagcaggacaaagtggcctgtgaaaaacacagcgcaccgcaatatctggctcagggatcgaaaagcgtctttatcaatggccagcctgcagtgcgcgcaaaggataaaaccacctgtgacgccaccgtgagcgacgatgtttcccccaatgtcatcattggtggtgaaactgtcacggtcagagagatcaaaagtggcaaggtgccaggtctggccgtgatgatgatcggcctttccctcatccgtggtcgccccagtcagatcatcaaaaacatgccctgcgcgctggccggtgccgtgggcggtatggcggcggacatggctatcaatgcggccttctcgtcgctgtttccggttcatgcggcgaccggcgtcaaagtccttaatgatgatgccgagcgcgatttttcccttcccggacgtttcccgctcagttttcagcgcagctttaacagccttacccagcgcgctgggctgtttggtcagggctgggccacggtgtttgacagctacctgacgctggaagggaatcgggcgacctggtttgatgacaacgggcgcgaaactgagctttgacgttcccggtgacaaagaggtgctctacagcatcagcgaagggctgatggtgcggcgcaacgagtctggcgatatcgccattgccgatgatgacggtgcggtatggcgtctttacaggcgcacggccgctgatccgcaggtgctgcggctggcttcactgagcgacgagtacggtaatgcgctggagatgggctgggatgaacaggcccgcctgttgcgtatccatgacgcgccgctggcgattgacgtcacgctgcactacgacgacaaacagcacgcgcggcgcccgacatcagccagccattttgatggcgatcagcactggcctctcacgcgatggacctacaatgatcggggccagcttaccagcgttactgatgccgcaggcgttgtctcacgacgcttccgttacaacgacgatggattgatggtctggcaccaactgccgggcgggctggagagtgaatatcgctggcagaagctggatcactggcgcgttatagaaaaccgcaccaacagcggtgatggctgccacatgcattacgatcttgaggcgggcatcacgcgcgtgtcgacctatgacggtcagcagcgcgaacaccactggaatgccgcgggcctcatcacctgttttatcgacgagcgcggcgagaagtggcgctacgagtgggatgaaaacgaactcctgacgcgtcgcatcgatccgctgggcaacgcggtgagcttcacctatgacgatctgggcaaccgtgttgaagagaaggatgctgacggtggtgtgcaggcggtgcaatggctgtcacaccgttcgttgcccacggttgttgccggagcagacggttccacaacgaaatactattacgatccccatcacggccttgaacgcgttgttgatgcgctcgggcaaagcacgctgtataagcgggatgagttcggactggttgtcgaagagactgacgcagcaggtaatagctaccgccgtgagtttaatgatgccggccaggttatccgtgaaaccgactgttcagggctgaccacgcgctaccgttaccatcccctgggctggctcagctgtgtcatcgcgccggatggtgaagaaacccgttatcactatgatgcagcaggccgtcctcttcagctggaacgcgcagaaggatgggaagagcggttgcactggagtgaaaacggactgccgctggcctatgaatcggctgatggcaagcgcagtgaattccgttacgacaatgtcgggcgattgatcgccaaccgtaatgcgcagggtgagacggttcagcgaagctgggacagccgtggccggttgacggcgctgcaaaacgagaacggcgagcagtatcagttcgagtggggcgcagattctctgttgctggcccaggtcgggctggatggtgttgccacgcgatatgactatgatgcggcgggccgcacggtatcacgcacctttgccgccggacatcctcagtccattacccatcgctatcactggagccgtgcggggcaactgctggcgcggaccacgccggaaggccagacgcgctatcactacagcggtggggggcaactgggcaaagtgtcgcagcatttgccgctgtctgacaccgagtggagccagcaggccgagcaggagattaactttaagtacgatgcgctgggccgcatcgttgctgagcagggggagcagggcgaactggcgtgggagtatgacgcgctgggcaactgcactgccctgacgctgccggatggccgcaacctgaagcaactttattatggtagcggccatttactgagcatcgcattagacaacctgccggtcacggaatttacccgtgacacgctgcatcgggagctgagccggacgcagggcggcctgaccatgcgcagtgagtatgatcgcttaggcagactgcgccgccgtgacgtgtttaagggtgactcacagcgacctgcaccgcgcgtctggtcccgccggcgcgacttcgattacggcaacaacctgattcgtgaagagcgcgacgataatccgttcagccagacattatggaactacgataacgccggccggctgttgtcacaggacggtgcgcagccgggtaatgaacagtggcgctgggatagcgcaggcaacccgctggatcgccatagtgccgctcatgtcatgcataaccgcgtcaccgaactgaacggtatccgctggcagtacgatattcatggccgtaccactgagaaagatgacggtcacacccgctggcgctaccgttacgatggtgagcatcgcctgacggatgtgatcagcgagccgcgggaccgcaataagccgcgcactaaggtgagtttccgctacgatccgctgggacgccgcatcagtaaaaccagccagcagctgttgcagggaagaccgtcggggaaacgccgtcacgacgcgctttgtgtgggaaggctaccgcctgctgcaggaaatccacgacgggatcccgctgacctacgtttacagcgacagccagagctatgagccgctggcccgtattgatggtgttgaaagcccggagatttactggttccataatgcggccaacggaatgccggagctgctgactgacggtgaagggcaaaaagcctgggaaggcattaacagcccgtggggcaagctgctgcgcgagtccagccagcgtgttcctgtggtggagcagaacctgcgtatgcagggccagtacctggaccgggaaaccggactgcactacaatctgtttcgttattatgatccggacagcggacggtttacccagcaggatccgatagggctgggaggcgggatcaacctttaccagtatgccccgaacgcgctggggtgggtggatccgtgggggttgatgaagtgtaaaaaccctgcgaaagaagcaacgaagtggcagggaccagggaataaaacttatccaggcatcgatgtttatgagaatacggttataaaaaaagggacgatactttatgctcttcatcctaatggagatcagttacctgcttatactgtaagtcatcctacagtcagacaacataaaggtgatccacttggctaccatgaagctttgcaagttgagttgaacccagcatatccaatgcgttcaaaggtgagagcttattacgttacagaagatatatttgtagccagagggcgtgctgaagccaatcctaaacatggagaagggggagggctgcagttctatataccggaagaagctcggcttaaactgaaacctggaaaagtaattgacatatgaaaataatgaatttagacgagtcaaatggagctttacatattgatgggagtgaaatagatctttcatcttacgaggcttttactaagtccttgttttttaattcagttgatgagctgaaaccaattggaaaatatcgttttttttcaaaggacgtcagttggcacgatgaaccatttactgtggaattcaatccggctgttttttcttttaaagcgctagttttcctcaccagtaaaacaggtgatttttataaaagtctatctgattgggaaaaaagagccaatgtaaaggctttaaaggaggaagaaaaaagaatgtttgaatggatgctaaatagatatcctaataattataagggtgaattaaaggaacctccttatggtcatgtttggagttttgaatggggggagataactgtacagtcggaagagaaatcatttaattgtgggatatatattgagtggaattaatttaaattatcagtcctattgagacgttatttgataatgttggtgcaataacatattaacaagattccaacgtttacaagttagtcgttgataatgaatacggatgtcagatagcagtttggttttagtttccgtaatgctggcaggaatgataaatagacccgctggcgatattttcattatgataaggatttcctgatgaatgttatttcagatggtaagtaatctgttataatatttttctgatgggatttatggctgctgttggatgtcattattgcagtgttgataaatagaataactggcacttttcattcaatcagaaaatgataagcttgttcgtggattgcataattactgatatataatcctggtgcaataatgaggggttttctcttcgaatttaatatctaaacaactctattttatcattgagcctataaggagataaaatgaacctgccaggaatgaatcctgaaaataacttaccgggttatgacatcgcgaggatgaccggttatggggcacctgattttgatttcaaagcgctgggtgcagcaatggattgtactcgggagttttatcaggctggcatcatctatgcggatggcgcacagcgttatcttgttcggcctggtcagcgtcatcctaatggtcaaagtggtatcgttacacatctgattgtgaccaaaacgcctaagcaagccacagcgtctaatacgggcaagtcacttagtgaagcagtaagcgtaacctcaatgggaaacggagattgcctcgaccgtgctttcctgtggtgcaatgattatcactgctggcgtagcggttatcggcgcttctgcaacgcctataaccgctggcagtagcggcgtgcttgttgctattggttatgctggcgctgccgcaacaggcgtgcaatgtgtcaatggtatttaccgggtttatgatctcgtcgaaaatggtggtgaaaacgtagcgtggctggactctcaggattggtacgttgccacttcaacgtctcttgaccttatttcactagccagtgtgggcggtgcgttaaaagaagcccttgcaacatggcgagcgatgaaatcagtctcttctttaaaagcaacggagtggctccggaactatccaaggcaggaccgggctcgccttactgaattaatcattaaggcacaaaaccctggtataagtaataaagagcttaaagccgccatccgtgcaggactttatccaaagcgtttccctgtagagtcggtgcaaaaagaacttgttaagcaactcgcgcaggtcgttacgagcgcagctgctgtggcaggcagtgctgtcagtggtatcattgctgctccaggtaatgtgccacgctccgggcgctatattgtgggaacaattcaatcactggcggtattttaatgcaatttctatcatggcttgtcgggcgaaatatcactgaactactgcaacatggtcgcgaaatagatcagctaatcgcacggcaggataattcgatacttgcccgttccactacagagcttgaacgttattttaaacagcctgctgagtcgcttcccaggcaaaacggcttcccggttgcgatagtgctgatgctgttgctggtttcatttgcatttaatttgctgacgtttctgcacgctttacctccgctcagtccacagatacatgcgttgagtttttttgttccctcaatcgtcgttattggcgcgatactcacggccagttacctgcttgcgcgaggccatacagccggtgtggcggggctggcttacgtctgtgcgatgttgtttatatcgaccgttttactcttgagctacagcgtagttacgggtagccactcgggtctgtggctgcttctggcactcgcggctttggtgggggctcgctggatacttaacgggcaggctttcatcctttttgccatttactgccggacacaacgcctcgccagcgtcgcccggcagcgtcgcatgaaataacccatactgatctgtagtactgttatcgcggaatacccattccgcgactctcttctatttttctctcaacacgatctttttcctatgacccactccttcttttactccatcccctgtcccaaacccccctgaaaaacccatccatcatcactattacctctggctataacctgccgttataccctcctgctaaacaagcattcgtcacctttcagagcgcatgaaatagtggtttcagaacctgatcttttggctgaaacgagagacaacatgctaatcccacaaccctatttactctttcttggcgatgttaccgatccccttgcggcaaaaacggcgcgcggtattcatatctggcggccggagcagtgcgttggcgaaattaaactgtcgggctgcacggtcagtctgggtctggatgaactggatattcccggcgccaaagcgcgcggagcgaaaacgctggtgcttggcactgccaatgccgggggctatctgccagatcactggctggaaacgatcaaaagtgccattaaagcaggcatgaatgtggccagtgggctgcaccaccgactggtagacgaaccggaaactggtgacgcttgcacaggcttcgggtgttgaactttttgacctgcgtcatatgcgtccagtgctcagtgtaggcagcggcaggaagcgttcaggtaagcggatactgacggtgggtacagactgctcagtgggcaagatgtacacctcactggcgctggaagcggcgatgcgtgcgcgtggcctgaaagccgattttcgtgccacggggcagaccggcattctggtcgcaggggagggcattgctgtggatgcggtcatcgctgattttattgccggtgcagcagaggcgctgtcaccggcgaatgacgaggaccactgggacatcgttgaaggccagggctcactgttccatccctcctatgcgggcgtgagtatggggctgatgcacggtgcgcaaccacactggctggttatgtgccatgaaatgggacgacctcatatgcgtcatttgccacaccagcccatggtcagcctgcaggcgtgcgttgaagccaatctgcgtgccgcgcaggtgaccagtgagtcggttcagctggctggctttgctatcaacacctccaattacagtgaagaagaggcgctcgcttattgcgccgaaatcagcgctgagtttggcttaccggccacagatccggtgcgttttggtattgatgagatcgccgcactgcttcaggagcgtggctgaaatgagaaagttgcagattgatgtggtggagttgccgctggcgcgaccctttgctatcgcacgcggtacccgtaccgccgtgacggtcatccgtgtcacgctggagcaggagggattcatcgggcagggcgaatgtacaccaacggctcgctacgatgagacgccggatagcgttaaggccatgctcgaagcggtacgcactgacattgagtcgggcctcagccgtcatgatctgcaacaccgcttacccgccgcttcagcgcgcaacgtgctggactgtgcgctatggcgacttgatgccgcacgggctaatcaaacgctttggcaaaagagcacctgctctcagcctgagtcagtcattacggcagaaacccttagcctggatacgcaggaaaatatggctctcgcagcggcggatgccgtgtcacgaggcgccatcctgctcaaaattaagctcgaccgcagtgaaattctggaaaaagtggcggcgattcgcgcggcggcaccccatgccacgctcattatcgatgccaatgaagcctgggcgggtctggaaactggaaagcctgctggtggcgcttaaggcattcaacatcgcgatggtggagcaaccccttcccgccggacaggaccatgacctgttacgttttaaacatcccataccggtctgtgccgatgagagctgccatacgcgggcggatattgccggattacgcgatcgctacgagatgatcaacatcaagctggataagtgcggtggcctgacagaagcgctggcgatggtggatgaagcccggacgctcaatatgcgcattatggtcggttgcatgctgggctcgtcactggccatggaggccgcattgcccgtcgcggttaacgctgagttcgtcgatctggatggccccatctggctagccgccgacagttctcctttcctgagctactcccaaggccgtatctggctataactctgtgaggcgacgatgacggacacacaacgtacttcccctgcaacccgcgctgcctctgtctctcccgtgctggcgattcaggatctcagcgtctcgtttcatggacgcagcggtgagaatcaggcactcaaaggcatcagttttgccattcatccaggtgaaatcgtcgccgtcgtgggtgaaagcggctcaggtaaatctgtcacgtcgctggctgtgatgggcttgctggcaaacaacggacgtgtcgatggcggcagcatgcagttccgcgaccgcagcggaaaaatgcatgcgttagaaaagctggatgacgctcagcgccgcacgttgcgtggccgtgaaatggcgatgatctttcaggagcccatgacctcgctgaatccggtgctgcgtattgatgatcaacttaccgaggcattacgcgatcatcaacagtgcgacagaaagcaggcccatgcgcgggtgcgtgaattgctgcgacaggtgcgtatcgccgatgtggatcgcgtcatgaaaagctatccgcactcgctgtcaggcggcatgcggcagcgtgtgatgattgcgcaggcccttgcctgtgacccacaactcctgattgccgacgagcctaccacagcgctggatgtcaccgtacaggcgcgcattctccatattctgcgtgagctgcaacgcgagaaacaaatggcggtgctgtttattactcatgatatgggcgtggtagcggaaatcgccgatcgcgtggtggtcatgctgcgtggcgaagtggtagagcagggaaccgtgtctgagatttttgccgccccgcagcatgcgtataccaaagcgttactggcggcagtaccaaaactcggtgatatgcgggaacacacatggccgcaacgctttcctctgcccggtgcccgcgagactgtgcaaggcgaacagcataccgctcgctatgacgttgcgccgctgctggatgtgcgcggattaaaagtctattacccgattcgcagcggcatcttatcgagcctgacgcatcacgtgcatgcggttgagcagattgattttagtctgtggccaggtgaaaccctggccatcgtgggtgaaagcggctgcggcaaatcgacaaccggacgggcgctgatgcgcctcatcaacagtgaagctgaaagtattcactttgaaggaaaggaaatttctgacctgaaagaggcagaattccagccgctccgccgtgaaattcagatggtgtttcaggatccctatgcgtcactgaatccccgcctgacagtgggtttcaccattgccgagccgttgctgttacatggcatggtctcttcgcttgaacaggcttccccacagatcgatgcgctgctcaagagcgtcggtctcctgccagagcacgcgcgtcgttatccgcacgaattttctggcggtcagcgtcagcgtattgctattgcccgcgccatggcgctgaaaccgaaagtgattattgctgatgaagcggtatcggcccttgatgtctcaattcaggcgcaggtggtcaatctgatgatggacctgcagcagcaaacgggcgtggcatggattttcatctctcacgatatggcggtcgtcgagcgtattgctaatcgcgtcgcggtgatgtacctcggccagattgtggagcttggaccgcgccagtcggtatttaatcagccgcaacacccctatacccaacgactgctggcctccgtgccggtagcggattccgaaaaccgtcagccccgtattttcgatgacagcgaaatcccctcgccgttgcgtaaggtgggtgaaacggtcactaaaactcgatatcggcaggttgccccccagcactgggtagctgacggcattgcattgcaataatccttaacgaccaggagaatttatgaaaacgctgtttcgccgtacttcgctcgccctcgcattgacgacgacgctggtcatgactgcgcaggcacaggatctgcgcatttcaatgtatgccgatatcacggggctggatccgcacgacacctcggataatgtcagctactcggttcagagcggcatctttgagcgcctgttccagtttgattcccggatgaagctgcaaccctggctggcgaccggttatacctctaatgacagtgccaccgaatttacgctgacgctgcgcaaaggcgttaccttccaggacggtaccccttttgatgcagacgccgtcaaagcgaaccttgatcgtctggcagatcagaaaaaagggctgaagcgtaacagcctctacaaaatgattgataaggtcacggtgctggcacccgaccaggtaaaaatcgatttgaatcagtcgttcggggcctttatcaacaccctggcgcatccttccgcggtgatgtggagtccgtcaattcttaagcaatatccggacgaagcgcagttgcgactgcatccggtgggaaccggtccgtttacctttgtcgactggaaaccaggcaaagccgttacgctggccagatatgcaggttactggcagcagggatggcctaaagtcgaccatgtcatcttctcgccgagtcccgaagatgcgacacgggtggcagcgttgaaatcgggccaggtggacgccatctggccattgccttcagacctcatcgcagccgttcagcaggacagccacctctccattcagcgcgatccgagcatttacctttattacatggcgatcaacacgcagcacaagccgctggccgatgttcgggtgcgtcaggcgatcaactatgcgattgaccgtaatctgtggctgaaagtggcctttgccggtctgggcaaacctgccacatccgcgatcccggaaggcgtacagttctatcagaaacagaacgatcctgattacggctatgcgccggataaggccaaagccttgctgaaagcggcgggttatccggagggactggatcttaagctctgggtgaccaacgccacggcgagcgtccgtgccgctcaggtgctgaaagcgcaactggccacggcaggcatacgtgtcacggtaacaccgatggattccggcacgcgcaacgctaagttgtggggcgttcaggacccgaaaaaggcggagtttgacctctattatggcggctggtcgacctctacaggggatgccgactgggcgctgcgtccgctgtttgccaccgagtcctgggttccgacctcgtataacgtctcctacttcagtaacgctgatgcagacaaagcgattgctgccgggctggcgacggccgatccggcaaagcggggcatcgcctatgcacaagcgcaaaaggtgttgtggaaagaagcaccggtggcgttccttggcacgccagacaatctggtcggcaaacgcaacacgctgagcggcgtttcgatgctgcctgatggcaatttactgttcactcaggcgtcctttaaataagacggtctcttcttcctcgtcccctgtccggaacggatgagggacgcgaggaggccagtcgcacctcatttcagggaatggcatgtttgcatacatcattcgccgattgctggagatgatcccggttttgctggtggtctcgttgctggttttcggttttatcaagctcatgccgggcgacccggcgcgtatttatgccggaccggatgcgccagttgaggcgatcgaagcggcgcgtcagcatctcgggcttaacgatccgctgccgcagcagtattttcactggatcggcaacctgctgcagggcgacctgggcaccacttatcgtacccagcaaccggtgctggaggtgatcaaagagggctttatgccgacgctgtggctcgccttagcgggttttacctggtccgtcattctcggtttgttattcggcgttatggcggcactgaaacgtggaagatggcaggactggacgctgatgagcgtggcggtcggcggcatttcgatgccagccttctggctggggctgttgctcatccagttcgtcgcgatgccttttgggctgttctcggttagcggctttaacagggccagcgatatagtcctgcccgccatcacgctgggttcgtcggttgcggcggtaatggcgcgctttacccgttcggcctttcttgaggtggcgcaggaagattacgtgcgtaccgccaaagccaaagggctgcgtaaccgcctggtgacgtggaaacatgtgatgcgtaatgcgctcatcccggtgattaccatgctgggcttgcagttcggttttctgctgggcggatccatcgtggtggagagtgttttcaactggccagggttaggctggttattgattgagtcgatcaaagcgcaggatcagccggtgattcaggcgctggtgatgctgttcgtgtttgaatttattgtgattaatctgctggtcgatctgctttacgcggtggttaatccggccattcgtctgcgacaggagccaacatgagtattcaatcgctgactgaaaatctgcctcagattattcgttcgccgtggcgcgatttcctgcatgctcttgtgcgtaaccctctggcgctggtctcaggcgggtttgtgctgctgttgattgtggtggcgatttttgcgccctggctggcgccctgggatcccatggctccggactggatggcgttatcgtcgccgccaacggcggcacactggatggggaccgacgaactggggcgcgacctgctcagccgcattatctatggtgcgcggatctcgctctatatcggcgtgctgtcggtgacgatcggcatgctggtcggggtcatgctgggcttactggcgggctattacggcggttgggtcgatatgctgatcatgcgcggtgccgacgtattattcgcgtttcccggcatgttgctggccattgcggtggtggcgctgctggggacgggtctgaacaatgtcattatcgcagtcgcggtattcagcgtgccggtatttgcccgcatcgtgcgggcttcgacgctctctctgaaacaggctgcctatgttgaagccgtgcgctgtgccggtgcaccagacagagtcattatcctgcggcatattctgcccggcacgctttccagcgtgattgtctatttcactatgcgcattggcaccagtattctgacagccgcgggcctgagttttatcggactgggtccggagcctgacgtgcctgaatggggcaatattctggcgatgagccgaagcatgatgatggccggatcgtggcacatgagcgtatttccggggctggcgatctttattaccgtgctggcttttaatctgcttggggatgcgctgcgcgacacgctcgatccaaaactcaagggctgactatggatttccaacaattgcagcgcgatttgctgctgaaacgctggcgtgatctgcgtcagctcgggcagccgcgaagcgcctgcggacccaccaatcgaatcagcgatgttgcgggcgtgcgtgtcggacattgcacgctgaatgaaggcgaaaagcagactggcgtaaccgctatcgtaccgtcgggcggcaatctgtttctcacgccgctgccgtgtggggtggaggtcctgaacggctttgcgaaacccatcggactggttcagatagaggagcttggcgtgcttcagacgccgattttgctcagtaacacgctggcggtcggcacgctgtttaccacgctggtgcgggatgccatccgtcgtaacccggaactgggacgaacactgcccacggtcaatccgctggtgctggagtgcaacgatggctggctgaatgatatccaggcgctggccatcactgaagcgatggcgcaggaggcattgcagacggcctcagcggacttcgcgcgcggcagcgtcggcgcggggcgcggtatgagctgtttcagcctgaaagggggaatcggaaccgcctcgcgggtgattccctcgctcaacgccacgcttggcgtgctggtgctggccaatttcggcgcactggaagcattaacgcttgatggcgttcgggctggcgagatgattgcgccgctgctggccggggagacgccgcagctggatgccggttctgtcatcatcatcatggcgacggatgcaccgctggacgcacgtcagttaaagcgcatcgcgaagcgagccggtgccggcctgggacggctgggcagttactggggccacggctcaggcgacattgcagtggcgttttcaacgcaacctctgccgcaaccgccacaggacgacacgctggagccgctgcttgctgcagcggcagatgcaactgaacaggctgtactggatgctttgctgagcgctgaggctgttaccggctttcgcggtcatcatcgcccctcactgatgcagattctggatagattaacgacatgaaaatttttatctcggccgacattgaaggcatcgcgggtgtcatgcgcccggagcaatgtacacccggccacccggaacatcagctggcccgtggtctgatggagcaggaagtgaatgctgcgattgagggggcttttgcaggtggggcaacggaagtggtggtggcagacagccatgcgcagatgaccaatttgcgtgcggaaaatatcgatccccgcgcccggctggtgcagggaaaaccccgtgtcctgtcgatggtggaagggatagagcagcagacgttcgacgggctgtttctggtgggatttcacagcgcagcaggtgaacccggcgtactggcgcataccatcaacggccgggcattctggcgtatccatatcaatggtctggtgatgggcgaaaccgatatttatgcggccgccgctgctgagcacggcacgccattgctgctggtcaccggcgacgatcagttacagagctggattgcggaacactactcagcagttaattacatctgtgtaaaacgcgccatttctcatacctgcgcggaatcaatcagcccacaagcggcacagcgtgcgatcgctgccgcagcaagcgccgcactgcaacatccccctcaggtgagcacgagccgcctgacggcaccttacgctatgcgccttcaggccactaaaccggtgctggccgatctgttcagcctgatccccggcgtcacgcgcctggatgccgttaccgtggcgtatcaggcggagaatatggagacgttaatcagcttactcagtgcattctcctatctggcgagcacacagtcatagcgaaattatcccgggctgcatgcaacgtcagcccgttaagcccgcctttactgttctcctgaaaccacgctgccaggcacacgcctgtagtgcgggctgtgcatgcgcatcctccctctggcgagtctggcttaaatccgctcaacccacgctgctgaccagcgctcctttaactgcaccacggcagcgcgagacccgctccctgcagaggcttcagtcgggactaccgggtgcggataggagcgagacaggcaactgagcctgcaccggttttgcggtacagtttttgcaacaggataatgattgctctctcaccctccgcctgcacctgcacctgatcgtacagcctgtcggagaggccttcgttttcggtattccatccagggtaaatagtcatgcggctccgccatatagaggtctttcaggccatcgtacagaccggcagcatcagcgctgcggcgcgcttgctcaatgtttcacagccgaatatcagccgtgtgctgaatcatgctgagcagcaattgggatttgcgctgtttgagcgacgtatacagggaatgagtgtgacggcagaaggacgacgtctgctgcctgaaatagacgatctctgccagcgcctgcaatccatcacccagcttaccgaacagctgcggcggggcgaagggcagctagtttcgcgtcggcgcggctcacgcttttggtcagatggttttggcgcccgcattggtcacctggcggcaacagatggcctcggtcagtgtcgaactggtcaccgagcactttagtaccttatgccagatgattctggataatcagctcgatttcgcgctggtttttggtcagcaggtcgatgcggatcttctggctgaacctctgtttcagtcttcgatggtcgcgctgttaccgctcaatcacccccgtaatgaacccgttacgcttgcgtggttatgcaacaataatttactgatgatgcaggctcaggatccgcttggacgcgtacttcaccgagcgctgcgcgataaaaaactgaatcccgccgtgtcgttgtcgattaaaacctattcggtcattgcggatatggtgctggcaggcggcggcacgggcgtcgtggatctcttcaccgcctgtcgctatgccgaacagctaaagctgctgccgatagcacagcccctgccgtttgaagtgatgctgatcagccgccgtgaccagccacagtcgcagtccactctgcagcttaagcaggtgatccgtaacagactgtgggagatcgcccggcagtgcgaagcgcagtttattcggggctgaagtaagtgccgtgcttcaccgctacccatccggctattttgtgagatgcatcacaaaatttttagaatttcttcctgatttgaaaccaggctcgctcgcgcatcactcaaccctgacgctgcggggtgagttgctcatttcgcaagttatcaactgaccggttagtgataaccggtacaacctggcggagtgagaattatggatggaattagacgcacaccttcccctgtgcatcacgaaacgattgaaatgcccacgcgcggtgggccatcaacaactgaagtcactgctacaacccctgctgcgagggctcgttctgcggagattagccgtattacagctactctgcataacgcgtgtaaaggcggagagaacgtgcgtgattacctggcaggaatcgctgtcaccctgcacgatgaattgcaccagacggacgatcaggtaaaagatgtcatcaaactggctcacagctgcgacacgatgatcatggccaaggcaaagggggcgattggaatgacctatgccctttccggtgtacctggcgatctggtcggcaaggggatagctagcgcaatgaagctggagccgggcacgcccatgcacaactttgtcgctggcgtagcgggggggatgactgcagtggcttttaaagcggtgctcactcgggttatcggtagcagcatccaggattcgagatggatgcaggcagatatggatgcactggagcctcttatgaaagatgaggcagaaaaacgcgagacatttgggcataaattaaaaatgacggcgctgggcgggacgggctttaacgtccgcaacccggtgacgggtggaatttccagtgcaacccagctattacccgaaaataagccgcggccagaaccgatggggattatacagggtgcgctcaagccgggttatgccatcaaccagatagcaggttttggcctgacttccgctgccggtgcattgagtggagttgtggaaaactactacgacaacctgcacggcgcggagtttttatttggccgtaacgactggaaggatcgttatatgtcgctgtccagcgggcacacgaatagtggcgaggggagccacttcgatgcggtgtgggaacacgccaaagcgccaaaacgttgggttgaaggtgttacaacgctgagtgcattaagtgcggtagcctctgagacgatggaagcgctcggtttgggcatcggagcgggggcggcacgtgtgaccaaaggtggtgcagagaagcttttcacctccggcaagacaagtgcggcagagaccgctttggatctggcgaacaaatccggcttccgcgtttcccgcgaaagtgttggcaatgcggcggccctggtgccaaacgcctattcttacctgcaacagggggtgttcggtcttctttatcaggaggctgagcgagcagtggcaaacaagctgcacccgaagcccgccgacgcgacagaagaggaagccccggtgagttcaggggcgagaacacctgaaggcgcgccagcacccagcgtgggtactgaggcgagaacgccggaaggcacgccagcacccagcgtgggtactgaggcgagaacgccggaaggcacgccagcacccagcatgggtactgaggcgagaacgccggaaggcacgccagcacccagtgtgggtaccgaggcgagaacgccggaaggcacgccagcaccgagtgtgggtaccgaggcgagaacgcctgccggtacgccagcacccagcaccggtacccgggcgaaagggccgtcagaagaaggcgaatcggacagcgacagcgtacattcgcataactccgggccattacgtaataccccgcctgagcgttcatcagaaatgcgcgctgcgggtgatacctctgcatggtggcactcgtttcccggacctggcgaatatcaaaagcccaaagcctgagaagttaacccaggctgactatgaggccatcatcgccgtccttgaagctgaagcagagaagatgagcgagcgcattgccgagatgataccgctgccggactccttaccgacatcatcagcatcatcagtgacatccgggtcatctgcgtcatcagaagctgcagggcctgcaggatcgccagaacctgaagaaacgaaaaaagcctcctgataccacaccttaaaagccgcagcgatgcggcttttttttacgccgaatttgcgctgtctcacgcgctgcccggaactcccgcctcgcgctttccactcaatcgtaccccggtcatagcgggagaaaggcgccagtctggctggcgctaacgatgacgctttgttgagaggagagaagaatgaatatctcgtcaggttcggctttcgggccgatacagccgcaactgcctgattttagcgcgctcgatgaaaaaaatttagcctcgtttactccgccagattctggcgccagtggccaggcgattaactttggcaatgatgccatgagcggcacggatttcagtagtctcaccgccacgcccgacagtgtgagcaaccgggatccgatgcagatgcaggggctgatgcagcaactggggccgcaaatagaggcattgctgcaactgctattaatgctgcaacagctcttcgctggtcagcagcaaaataacagcgcaggagccgggcgtggcggcggtgccgatatgccgggcacctcagcagaagagggggcttcgctcaccgcaccgtttaatgccgcgatgcagcagcctgttaacccgactgaatccgcttctgcacagcaaccgctaacggccagtacaatgccacagccaggtacggcttctgatgctgcactaaatacgcctgcccggcagacgccagcatccggcggcgtcccgctgataaaaggcgagtcggggttacatttacctgccccgttactggatcatgagcaggcgataatgcgtgccgccaaagagactagccaggcgcctgaagtgctggcagcgcaaatctggcaggagtcgcgcggaaaaacagaggcgaccaccgtgaacggcggtaatggcctttccgacagcggcctgatgcaggttaattccaacaccttcgccgatctgcaaagcagatacccgcatctgctggggccagatgccagcccgtccagccctgaagacagcatcatggctggcgcgctctatctgaaagagcagcgggaggcttttgggggcgatcccggtgccgggttgcgagcttataactcaggcccggggaatgtgaatgtcaacgatctgacggatatctcgaaaaccggaaccggcgatccgacctatgttggaaaagtgctcaactttgccgacattatctccagcggcaaaggcacgttacctgcataacgcgcaaaaaaagtccctgtaccggatacagggacaaacatgagcagcctcaaaatcaggcaaacggcggcggttcgttcttgcctttccccccgctattttccaccgcaatctgtacggtatcggtcgctgccgtgatgccccagccaatcggcccacgcgccgcgctcattccaccctcggccagtcctttcaggccaccggtaaagacttcgcccacattgcgggcttcgccaatattgttaaagaaaggcgcggcaacagatttgagaatcgggatgttcgacaatattttgccgaactcacccatgccccactggaagttgtctttattggtaccatccatacgaacgtgcgaatcattcgtctccggcaactgtttattctccggcagcatcttcagaccctgttcggcgatatccttcagtacacccgcctcggtaccgtggcgcgcgtcaccatctttggtgatgccctctattttgtcgttagctgagatctccttccgctcgctgccatcacgcgcattcaggccttttatgctgtttaacacgcaggccatgttatacgccgcatcagcacgactcttcggatctttattggcatccgtccagtcgccgaagcgctcttttagctctgcctgcttgatatctttctggttgccaaggtttttcagcaccgggttttcatcaatgatctgttcggcgctgcggttatcacccggtggacgacccttcagattctcctccgtcggcctgacgcggatgtccttctcactggttcgcacgccatcgcccggtgcctgtggaatatcttcaccggatgtttcgctggcaaataacgccgtgggcaccgtcccttcttcagcggctgccggatcgacaagcgcctccaatccagcctgcgttaaaagctgatcaagctcccggatcggatcggacaggcccgccagcggcgttccgctcccaccggagtagctgatggggagatcgctgcccgggaccgggaccgggaaacgcggagccgggcaggggagtggataatggcaggttacccggcagtggcctgccgggtgaaaaagcgggggttattccccccccgccaggtattggcataaccatacaagccccctgagttagctttgcggatttttctgggaagattgcccctcaccgccgcccaaaagcccctgcaacaatgaagaaagccctaacagggacagcaggttttgcatcattccgccctgttgcccaccattgtcagttgctccctgagccggtgcctgtggtgcatttccgccagattcttcgctgtctgcccctttacctttatctatccccatcatctgctggagcagttgctgaagcatctgcatcagctgctcaagcgggttgccgctgtgattcgtgccctgtgaaggtgcaggcgtgcccggttgctccggctgctgcgccttattaccgccgcccaacagctgttgcaggcctgtcagcatcataatctgctgtagtaagccgccgcccgacggggcgtcaggcgagtttgcaccgtttgcctggccgtttttctgacttccgcctgaaccggtcagcgaagccagtgtgctcaggccgtcaaaggcattactggcaaaattgagcgggcctgttttcgcattattgagaaaaggtaacgacgattttccgggctgatcgggtaagtctggtttacctgacggactgccccccgtcttgcctggcatatttgccggaggcatatcgattttgttcgcgtttgtagccccaccaccaaatcctggaatcttcatgaatttattcctcagagttaataagtcagcgattgattggggcagcaacagcggtaacattttgcaatcctgattactgccgattgcacaattttaccgttcaggctgatgctacctcgcactgtgagtggtagttgtcccgtgatggttccactaaaaatgttccctttgtgatgcgggttcagatttataaaaatccagcggtaccgccattaagaaattatcattctgtatttgaaggtttttttgtgattcctgtagggtaatccttaccggttgagcgtctatccctacaagataataatcctggactgatagcggggatgacctgattgggtgagagtgaggccgcggtaaatttgtaattctttgcatcaggctctgcttccagaacatccacaagtgctgaacgagcagcgcgtctcatgtaaggcgcgcttatgcgaagctaatggagaatgtatggttcgtctttacaggacacagtcaggccacgggactgtcgatgaggagagtgcggataacgtcttacgccaggttgattcccgcccggatgcggcggcgggttacccggagcccgtaaccgatatccatactcatctgtataagattttaaatacgattgcaccgttaaacatagatgtcttaatcgagggagaaacgggtaccgggaaagatgcactggcccagcggctgtatcaactttccggctgtcgcggcccgatggtgccggtcaactgtgcagccatcccggagacacttgccgaaagcgagctgtttggggtcatggccggggcgtttcaccggcgcaagcagttcccgcgccgggtatattgagagcgctaatcatggcgtgctgtttctggatgaaatagacagtatgccgctcacgatgcaggctaagctgctgcgtgtactggaaaatcgcgcggtagagagactgggcagcaccaaaagtatcgggctggatctgcgggtggtcgtcgcctcgcaaattccactggcgcagctggtggctcagggccgttttcgtcgggatctcttctttcgcctcgacacaattaaaattgccacgccaaccgtgcgatcacgaccggagctgattttgcccatgtttcgccagtttacgcaggaggcggcgctgcgtctgaatcagcccctgccggcaggatcgctcgcgcttgatgagaccctgctgctgcatagctggccgggaaatatccgcgagcttaaagcggcggcagaacgctttgtgctgggcttaccgccgctgtgctgtgagataaagcaggaagggcgcgtgttattaaaagacagaatgcggcgcattgagcgcagcctgatccacgactgcctgaaccggcacgacaatcgtatcgatgatgtcattcttgagttagggattcccaggcgcaccctttatcaccgcctgaagttgttaaaacttaccgcctgatatatcgcccacctctcttgccgtgggccagcaggcttaatctgcataaatattttctctgcgatggaaccggatagcttcattgattacttaatgaatgcaacacccaactacaacctatcatcaacgcgaggaatgactatgtcaggtgctagcttactttccaacgggatcaccaacgcagcttctgcttacactcaggttgccggtgcttacaacggtgcgaaatatatggttcgttcgcaacaggcgatggacaagatgcaggaaaaccaggccgataaaatggatcgcgatgtagagttccagcgcattaacggcatcgccgaaagtaatgcgcaggccgcgtcagccgcagcccaggtcaaaattcagtactaatcgactccggcagggaggtgtttttttgtctccctgctctctaatgccacaggagttttactgatgaaagtctctcaatcttccttgctcacttcagaaccggttccgtcagtcgaaatgtaccaggaagcaccgtcggcggaagatattcaatggtttaatgcaaagcttaatggccctgcgcctgacagcagccagatgagctcttcagagcctggcgtggtcggcaatattctgcaatcgctgagcggcaaccagcgtgcgcaaaaagaagcctttaacgatctcagagtcgcttcgcggtcatccagtgcggaagatttctcccgcgccaatgcgcagctctctgattactatatcgagagtctgatgaacgccaaagtgattgccaaaaccgttcagtcagtcgataaactcagcaacctgcagtgaatcttatgaatggcgctgtcattaaatgcttctgtgctctgtgcctggcgctgctgcttaccggctgcggtgatcagactcagttgcacagcggactgtcagaaaacgatgccaacgatgtggtggcggaactgagccgctttaagattgaggcggaaaaacaggtttctaaagagggggttagcgttagcgtcgcgcgcaatgacattgagcgggcggtgaatatcctcaatgccgccggactgcctcatcaggcgcgaaccagccttggcgcggtttttcagaaaagtggtgttatctccagtccgctggaggagcgcgcccgctatatctatgcgctgtcacaggaggtagaagcgacactgtcacaaattgatggcgtcgtggtggcgcgtgtgcatgtcgtattgcccgagcgtatcgcccccggcgagccggtacagcccgcttccgcctcggtatttatcaaatatcatgaaaacctcgatccggacagtatcgaaccgcgcattcgccggctggtagcaaccagcattccggggctgggcgggcgcgatgaccgcgatcttgcgattgtctttgtcccggcgaaagcctggcaggataaaattgaaatggtgcagctggggccatttcagcttagcccggaacgttacgggatggtcaagatagttacaacatgcctgggagtgctgctgctgttactggtggcaaatgcattcatccgtcaggctctgagtcgtaagcgcctggctgcacaggcgaagtgattgattatgctcaacgctgcgcctgatgaggaaattaccctgcgctggttacgctggtggcacgctgacttttggttacaggctgatgaaagctggtgcacccagccactggcccgtttatctgcgcctttgcagaggcactatctccgccagcatgcctcgtgctggcaccacactctgggtgtatcaggcgaactggtcgcgccggagccgatggtgctggccatcagcgacttaagctgcgaacagcgcgcgcaactgttgattttagtcgcggaaatttgcgccggagccatgccgctacccgcagagctaaagatctggttgcggcgtctggcgaaaggaatgcgcattgagtgctggctgcccgccgggcttttcactactggcggcagcgccgacagcctctgtctgctgcaggcgttatttccggctatctggccgcgcctgcggctactcttccctgtaagcgacgcgccggtaaacccggcactttcactgcctggccatcgtctgcgtcctttatgggaaacggcgctctggcaggtgcaacaacattcgggagagacgcgcgatgtggaaacttaaaagcctgcatctgcagggcggcagcgccccaccgggtaatgtgctgcgccgcgaggaaattgcgctcaggcttgaagcggcttccattatcgagctggcccataaacaggcgcaaacgatccgcgagcaggcacgcgccgaggcacaagccgaaagggcggccagccagcgcgaaggggaagcccggttctggcagcaggcgcagacgctctttgcggactggcaggaacagcgtgcagccgaagagacgcagctggtgttgctcgctggaaaggttctgaacgaggcactgcaacacctgctcgatgaggtggatgatgagcgccgttttcacgcgttgctcagacagttgttgcgtcactatccgcgtcagcagcaggcgacgctgtattgcgccagcgggcaggagcaggagattaacggctggctggtcgcgcagccgcagcttcgctggacgctgtgcgccgacccggcgcttgagccagatcgcttgcggcttattaccgacgcaggcgagctgatggttaactggcggacgctgtaccagcagctcgcgccagcgctggcagaagagaatgcataaaaaaagcaaaaacagtggaactgcttcgcttgtcgcgccacttaacaggggtgtccaacaagaggagtcaatatcatgagttccagcgatctgttacagcgtcagttatcttccaactcaaaccgcaaacatcatgaagcctatcagtttgcccgcgatgtttcgggcgaatcgttcagcattgcggatatgtatgctttccagaatcgcctgcaggatatgtccaacgccagctgggcaagttcgcaatacacccagttcaggtttggtatccgtaaagcgatcatcgacgctgttaactaagcccctgtcatcaaggagtcaggcgtgtttacgttttcttttccgggccgcctgctggcggccattaccctgctgctactgagtatgggcatcacaaacgctcgtgtgccggatgagtggaagaatggtgcgtatgcctattcggcagataataccccgcttaatattattcttgacgattttgccagcagctttggtgttgaggtcaatcttggcacgctgggcgacagcaatgtcaccggtaaactgcgcgcagacagcccggaagcgttccttaatcgcctggcgcttgagtatcgctttcagtggtttgtttataacaacacgctctacgtcagcccgcaggcagcgcaaacttcccagcgtattgagatttccccggaagccgcgccggatctgaaagaggcgctgcgcggtgtcggcctgctggaaccccgcttcggctggggcgaactgccggatgaaggcgtggtattggtgaccggtccgccggagtatgtgcgccagataacggaatttgcccgtaaatcggaaagcaaacctgaagccggggccaataaagatatgatggcattcccgctgcgttatgcggccgtggcggatcgcaccattcgctatcgcgatcaggagctgctggtgccgggggtggccaccattctgaatgaactgctgggtcagtccagcaacgcctcttccggaagaatgtcatcaggccagggagaggatgaacaggtatcacgtgaacagtcgcaaagtgttttaaacgagctgattaatcgcaatatgccggcctccggacgtaaaaaggcgcctgtcagcagtctggcgggtaaagtatcagcggatgtgcgtaacaacctgctgctggtgcgtgacgatccgaaaacccgggacgcttatcaggcattaattaacgccattgatgttccgcaaaagctgatcgaaattgatgcagtgattgtcgatatcgaccgcagcgcgctgaaacgcttctccagcaacctggccggtcagtttggcagtgtcgccagcggtgccaatatgctctccggtgccagtacactgtttgtgaccgatttccagcgattttttgccagtatcgaagcgatggagggggaagggacggcatccattatcgctaaccccactatcctcacgctggagaatcagcccgcggtgattgatttcagcgatactgcctttatacgcgccattggcgagagggtggcggatattcagtctgtcaccgcaggcaccagcctgcgggtgacgccacgcgcaatcaccacttcacaaaaatcggctatccagctcattgttgatgtggaggatggcaagctcaataaagatgatgagggcgatgcgcagggaacccataacgcagcggtcagcacccaggcgctggtggaggcgcgacgctcgctggttctgggcgggttccattccaaagagacgggcgaccgtgagcggcgcatcccgatcctcggcagtattccgctgatcggcaagctctttacctcaacgcgctatgagacctcccagcgtgagcggctgtttattattacgccgcatttaattggtgaccaggtcgatccgacccggtatatcgctgccgagtcgcgcgaaacagcttaatagcgcgatggatgaggtgactaatcgtcataagtacaccgacgtcaaagggatggtggaaggcgcgatgcgcgacctggcgctgaaccgcgtgccagcggggatgaccagcggtggcacgggccagacgctttcctccctgtgccgcatttcgggcgctttcgggagcgatttccgtcgccatcagtggtacggcaacagcagcgtacagataaccgttggggtgatcaccaacaacacccagcagacgcagcgttttgatgagagtctgtgccgcagcgaccgcacgctggcggtagcggtctggccgcgtggagaactgcgtccgggtgaatcggcggaggtattcgtcgcatttgatagcaatgctccgtcacgtccttctcgcgcttcgctgctctcttcagcaggcggtgcaccggccaaaaacctctactgagctgataaggaaaaagcatgttagtgagaataattgtacttaccgccgccgcgctggtgctgagtgcctgcgcgcggccgcagggcggatgtaatgacgtgggctgtcgcccctcttcagacctgcataacctgaccatctggtggcaaccacaactgcgtaatggcccgaacgactacacgcggataacggtagataactaatcacgtttcggcagtcccaggccccggctgatcgacggggccatattttaatgagaatcgaccatagctattcaccttccgtttccgggaagcctgcgtgcggcgcactctttgcccgcatgccagtgctggtaatgctattccattacgtcagttttcctgcagcagaccgcaggcggctctgttatcagcaaccgcttgccggtttcaccccggcgacttttagcgctttaatactggcttttattcagcaggcccgtgagatgcagatgtgactgcctgataagatagtccggcgttaccctccgcactattcttcccgaatctcaatcacctcatccagatagtgatcctccagctcccgcagcagacgatagacgtgcgcgacggcatttaacgtttcgcgtggaacataagccccttcgcgcgtggtgcgccacagagtgcgggtcagccagataaagcggataaccggtctctttttacgctgcgcctcttcaattaatgcccgcgcctcttcatcgcaagccttaaacagcagacgcggcagcggcgtttcatccgggcgataatagagaccgacggcaaaatgggtgggattaaccagcaacacgtccgcgtcttccacgttaatctcacgggcaggcaccggctcttcattcaggatctcctgagccagctgacggcggtggcctttcatatgcggatcgccttcgctctgcttaaattcgtttttgatatcttcatgactcatacgctgctgtttgaggaagaaatagcgctgaataccaaaatcgaacaggctgattattagcatcaccatcagcacccgacgtgacaccttcataaacagcgccatcaccccctgccagaaaccgttgagatcgccaagcgccagctgagcaaggccaccgaggtccggcatgatcgcctgccataccaccaggcctatcaccaccgctttaaagatgctggtcaaaagctgggtaaactggcgggcggaaaacatattcttcagatgattaaacgggttaagcgcatccggtttcggtgccagcgcttcggtggagaagagtgggccgaaactgcacccagccgcccaccacccgcagcagcatggcaatggcgcacgcgatgcccaccagtaccagcattacggtgacgctatcacttattacttcctccatcgcgtgatcgaatgggtcgcgcagacgcgttaacggcagcagcatcatcgcctgcaaccgctgcatcccggtatccaccatagcaaacagggtctcaaggataccgattgagataagcagcttagggatatcctggctctggctgacctggccttttttgcgcgactctctgagtttttgcggtgtagcgtcttcggttttttcgctcatggcgcgctcccggctgaaggggcaaatatctgcgacaggacagggataagatcgcgcagttcatacaaccgcgcattacccagatggtccagcagtggcagatagaggataaaaaacaacatgccgagcaggcatttcaacggaattgtcagggcagtcgcctgtagctgtgggctatagagactcatcacaccgatggcaaaatcgagcagcagcatcagcgccaccggcggcccggcgtaaagcaccatatcgctgaagattttccccaaaagcgtaagccagacgtgaaaacccgcctctgcggggaaaggtatccactgggtggcggaccaaagatgatagctgtcccagatcacctgggtgatggtcgataatcccagccctgtgaccagcagcaatatcagcacctgctgcattaacttacccagaggcgtcacatccggccccagctgggggttaatttgtccacccattaaggcaccccgctggttatcgaataacgcaccgacagactcatacagccagaaaggcaacgccagcaacaatccgagcagggtgcctatcatcaactctttgagtaccagccctgccagcgccatcattgtcggctcaagcacatcaatttgttctttgatgcctggggcgataaacagcgccagcgccacagcaatggcggttcgcagcagcccttttatgacgctaaaagagaatatcggtgtcagtaacaggcagggaaagatgcgcgccatgccaagtcccagcgcgaggatggcatgaaacgtatcggtgagtgggtaacctgtcagcatcaggaactgaccgttgacatcatcgcaaacgccgcctgcgccagctccatcagttcaacaccgacccagcgcccggtaagcgccagcgtcaggccgaccgcgataagtttgatgcagaatggcagggtctgatcctgcaactgcatcgcggcctgcaccagtgaaataattaccccggagatcactgccaccagcagcggcggcgcggagaggataaccaccagcaataacccctggcgaaacagcgtcagaatatccatgatgacctcataaatagctgtagaacaggccgtcaagcagccgcgtccagccgctgatgagcacaaacagcaggatcttcagtggcagcgaaacggtcatcggcgacaccatctgcatcccgagcgccagcaggatattcgagacgatcaggtcaacgacaataaaaggaataaagatcagaaagccgattttgaaaccgttctgcagctccgatagcacgaaggccgggataatgagcagcatattttcgggggtgaccgaatctgccattttctttggccacatacgctgggcattttcctgcagatggatgacgatgtccggatcggtatttttatgcataaacgttttcagcggttcgataccattagcggcggtatattcgagccgctccatactgctgaaatcgacagggatcgctttcagcctgtcggtcatatcgctaaataccggcgccataataaatagcgttgccgccagcgcaatgccgttgagcgccatcgttggcggcacctgctgcacgcccatcgcgttgcgcgtcaattgcagcaccatcgtaattttcaaaaagctggtacagataatgagcatcatcggcagcagtgccagtgcgccgagaaacagcgccagcataatcgggttgagtggccccatctccatcggaatcacctgttcacatccccgacgctcgccacgcccggtagcatgtgagtaatctgcaaccccagacgtccttcgacatcgaccagttcgcctttcgccagcggaaactcgccgtgacatagcagtgcttcaccgggcacgacgttttcgaccgtgaccgtcgagccaacatccagacgatttaactcacccagggtaagtctgagatggccgcagcgcacggtcagggccagcggcagcgcatcaaaaggtgatgccacaggcgccgttgtttcagtcaggccttcatccgcttgaggtgtatcggcaggcagattatcttcgggggtcacattcatgtaactattctccagacgggtaataagaaaacgggcaggatgcccctccccgaacagcaattcgcccttaaggtgcaattgcgcaaggcgaagctcgccgcgaccggtcgggaaaaaatacgaggtagcagggaaaatcacatcaccggggcgaagtgtgcgtaactgcgagggagcaaacgacaccgcacccagttctatcggcagcgataacggcagggcgctgcaaagcggtgcagggagcggagcccagccaggctggtttaacaacgccgccaatgtggcgggggcaagatatagctgactttgcgcctgcgcctcaccgatcgtgacgctaatcgcaagccacatcccctcaaccggtgcgcagagcgcgtcctgcggcgtcaggtcgccaaatagcgcgcgcaatgccgggctgagatgctggttaaagagcggccagtaccagtcagcgcacgccccgggttctggcagcagcgggcaagtggaaaacagactcagcagcgcttcgctctccgccagagataaccctcccgccttgcatgagaagctctgcgtcggtggccgctcgccggggggggcgagccgcagctgaagctcacccgcttcgcctgcaagggtaaaaggatagccaaggccgtggccgatacgctggcgcaggctggcttcttcgcgcggcagagtgcgcagggataagggtttcattcccggcctccgcgctgctcaaaacgcaggcgcacagcgcaggccatccggcggcgcagggactcccggcagcgttcctgatgggcggccatcatcgtcatggcaggtggcgcaaaacgcaggctgatatcccagcccgcggcaaaaggactcaggcgggcatccacttcgcctaaaaggggcagcagtagcgtcatcgatatcgggccagcaggctgcttttctaccatggcgcacagggggggctccagttgttgccaggccctggccggagaagcgggagccacatgctcatgggataactgtgacccaaaagagggggagccttcccagggtatgataagcggttgcggcagttcgctgggggtgagcaacagcgcgtcgaacagcgaaccctcttcgcgaaacggctcggtgcgggatttacgctcggatgtcgcgacgtctgaaggtccggtctgcggcgaacggcgctgcacctccggccgtgcaggcggcgctggattattttgcggggggtggggtaaggctgtcatcgtaatgcctcgctgtgcgccatcagatattccagtttttccacatcgcgcagacgcgcctgtgtttgctgctgtgtgtgctgcacctgttgttgttgcataacctgctgtgcgcggcactgttgcagctgattacgctgtccactcaccgcgtcgctggcctggcgctcccgggccaatcccccgaccagatgctcctgtttttgcagccccgactggtggtgtccggcaaagctatcgcgcagctgctgataatgctgttgtgcggcttcaagctggtgttccgcctcggctgactgacgttgcgtttcgcacagcgcctgctccgcttgccgctgcaaccgttcgcagcggcgtaagcgctggcggcgaattggcagcagcagagagaaggcctgctgcaattcagcgctgccctcatcagtcgtgatgtcgtgatcaggtagcggatgacggcgcatgctggcttacctccgctaagtaatgcagtgtgtcgtcatatccgcagggcgcgtgcatcgcctgttgcagatagccatttatcgcctcctgagccgatactgccgcatcggtcatggcatcatgtcccggctggtattctcccaggcggattaacatttctacctgctgccaggcggacatcatgcggcgcagctgcgtggcgtcgcggctatgctcgcgagtcgcaacgttgctcatggttcggctcaggcttgccagcacatcaatagccgggtagtgaccgcgctccgccagacgacgggtcagcacaatgtggccatcaatcagggatctcacttcgtccgcgaccggatcgttcattgaatcggcttcaatcagcacggaatagagggcggtgatggccccccgtgaggtctgtcctgcgcgctccagcagggtgggtaataaggtataaaccgaaggcggcagcccgccgcgacccggtggctcgcccagcgcaaggccgatttcacgctgggcgcgggcaaagcgggtcagtgagtcgaggattaacagcacgttcttacccttatcgcgccaggcttcggcgatggcagtggcagtaaaagcggccctggcgcgttccatactgctgcgatcggaggtggcgcagacgagcaccgtacggctgcgcagcgcctcatccagttcgtggtcaagaaactcgcgcaattcgcgcccacgctcgccaatcaaaccaaagacaatgacatcgcagggcgtattacgggcaatctccgccagcagggtggttttcccgcagcccgcgccggcgaagatccccacccgctgtcccacgcccagggtcagcgggccatcaatggcgcgaatgccggtcggtagcggcgtatcgatgcgcggacgatcggtgggtgccggggcatcgcccagtacgcctaccgcatcgtccaccgtaccgggcagggcgaacgcgccaggctggcctgcatccagtggacggccaaagccgtcaagtacgctgccgagcagggcgtccgacaccacaatactgtgcggcaggcgcagcggaaccacgcgtgccccacgcgctatgccgtcgagctggccaagggcggagagcagcgtgtgctgcgggttaaagccgaccacctctgccagcacgctttgcccgtcatcccgggcgatctggcagagatcgccaatccgcgcctcgggcaggctgctttcgagcaatatcccgctgatcccggtaatgcgaccaaagctttcgaccggcgaaaagcaggtcagccgccgctgctgctgctgataccactgctccagtgtcatcgtcattaccagctcaccttaatgttatcgcgcccgttaaactcgatctggttactggtaatcgccaccagccgcaggttgtcgacttcatcgccaataaacagacgctgcccatcatcagtgacgatattggcgcggctaccggtggtgatttgcacaatgcgaaacggcagtctgaccttcagcagcctgacctggttatccagcgggatatcgctggtgtacgttgcgttaaagcgctccagcattcgtttatagatttgcatctgtggcttactgaggcggcctgtaagacgcagtcgctgattatgcatgtcaactttcacgaggctcgccagatcgcgttcgcgcaacattttctgtaacggagcctgcaattctgcgggagtactcagtggccgggaggaggtgacctgagtctgggctacggtgggctgcaaaacccagctcattactgtcagggtgagcagcaacatcaggctccagaccagcgtgcggatgctgcgggtgaatatccctttacgtgcagcgaccgggggtatggcctcattcggtgcttcagcagtttcttctggcacagaaggggtggcaggcggcatacaggcggcccacggcgtgtcgatacgcgcgacgcagagccagacgtcagcgacctgaaaaggttcttcactattaatggcataggcttccccgccgtgcggttgtgccagccaccgggtctcttcccggcgcagctcgcactggcgggcagcaacgcgagcatcgctaagcatcagatcggcctcatcggcgtggccaatcagccatttatcaccgaagaggggtaacgcggcgcctaaatgcaggccagacagcacgcgcagttcgaacatggttaactctcccacgtggtaagtgagtaagcggccggatcgagctctatacgccccagcacatttactgcgagattgggttgcagctctgcaaacgagagcaccggcacatagtggaactcttcctgaataagcccgcgcatcgggctgcgcaaatcctgggcgaccagcagcaccgcgctttccggggtgtcaaccgggaatgcgttggcgatgagcgggagaatggcgctgatctgctcatgggttagcgcaaagaacagatcgttttgagtctgacgaagcgagtcacgcaactgttcttccagttccggtgtcagcagccagacatgcaggccgtccggacgggcatactggtaacagagatgattttttaacgagatgcgcacctggtcggtcagcagccagatgtcgcgctcatgctgcccatgctcgatcagcgcttcggcaattgcccgaaccgatcgcagcggaatgcgttctgaaaccagtttttgcaggacgctggagaaacgtgagaggggcatcacgcgctgtaactcctgcgacagctccggctgctctgattccagccagctcaccagcgcgcgggtttcctgcaggccaataaaatgcgggctgctggcatgaatagcgttctccatgcgctttaccaggatttcgcgcgccgtccagcgctcgacctcttcgttttgcagcagcggatgatccgccgccagccagataagatcgccttcctgacgctgctcgtcgccctctgccacgctttccctgtcggttgacgcgatctcgtccagccagcggcgtttcaccgcccgatgcgacacgttaaatgtcccttttactttcgggatttcataaaccgagaagcgaaactcatcttccgtctgctggtcgagaaactcgatatcgaacgctggcagggtaaagccgaagtggtaaacgatacggttacgcagccggcgaatatcctgcaccagctccagcatctccggatggccgcgccatgaggacgagaaattgatcagataaggtcgtgttgggttgaactgacgtaaatcctccttgccgttcagctcagggggaatgacctcattttccatttgcggctgcgcaaggctcagggtctttctgacacgccagatctgaaaaccgccgctaatcatcgtcagcgcggccagcagcaaaaaaattgccgttggcatacctggcagcagggcaaagcccaccatccccattgaggagagcagccaggctttcggctggctggttaactgctcggcaatctcgcggccgatattattgtcagccgtctgctcattgtcggacgagacgcgggtaatcagcatcccggcggtcagcgagatcagcagcgcagggatctgtgcaatcagtccgtcaccgatggtcagaatcgagtagatatgcatcgcttcgccagcaggcatgcccagctgcagcacgccaatactgatgccgccaatcaggttaatcacgacaatcaccagcccggcgatagcgtcacctttaacaaacttcatcgcgccatccatcgccccgaataactgactctcttttgccagttcattacgccggtttctggcctgtaccccatcaatcagtccggcgcgcagatcgctgtcgatggacatctgcttacctggcattgcatcaagggtaaaacgcgcagccacttcggctaccctttcggaacctttggtaatgaccaggaagttcaccacagtcaggatcaggaacatcaccatccctaccgcaaggttgccgcccaccacaaagttaccgaaagccgccaccacatggcccgcatcctgctgaattaagatctggcgggtggtggagatagagagtgccaggcggaacatggtggtgagcagcagcacggcgggaaaggttgagaacgccagcggcttaggcagatacatggccagcacgaccagcagagatgacaggcagatattcaccgctatcagcgcatcaattaatggcagcggtaagggaataataagcataaacaccagcgccatggcaaaagccgcaccgaccacttcggagcgttgcatggcgctgatcgcgattcgattcaatatctgaaacagggtattcatctttgttgcctcacgacgcagcgttccggttgcggcgttgctgttgctgctcagttttagtgacgtccgtaatcatgccgcgcagcagttttaacgcgttgtcacgattttcctgagcgggccacagcgaggctggcacgccgtgcaggagcggaaaaagcgaactaaaaaagagcggcagatgttgcctgttctggccgacaatctcgtctgccagcccggtaaaatcactctgataagcgccgttatggctgatttgcaacatccggcgtgccagagtcaggctgttcatggcaacactgggcagtttgctgcgcatacgctgcaaaaaggcagtgctgtcgctcagcgtctggcttatcccggcagcatcgcgcagtccgcggtggatacgtccgagggtaataacgctgattgagggggcaagtgcggcgatatcatccgccagcgcgcgctgcagagtacgcagcgtcgggatcagattacgcgagccgatcagctccagcagcatatccagcatcctggttgcggactgctggtggacgatgccgtcgtaatagaggttgcgcaacgactgtttacgctgcggatcgcgggtatacccggcgatggctgacgccgtgttgttgcctgcacgaatggtctggccgtgggtctgctgtagcttatccagctgggccccggccagcccggccagttccccgtcgcctttatcctgtgcctgttcgccgatcacacgcagtagcagggcggtgcgcgccggatcgccgccggtcttttccagaagtgtgtcgctatccggcggcggattctggcgcagggcggcacgtagccacgccatctgctccagcgtttgttgttcatcgccgccgtcgagtagggaaaatagtgcattcagctctccgactttgctgagcgcatgcttgccacgctgctggttccgtgacgcattacggcggtcctgcgccttttgcctgcgttccatcttttcactgaacgcggcgcccatttcttccatcgcgtcattcagtgaggtttcacgcgcgcgaacattatccggcacgtcgtttttacctgctgtctgtggcgtgtttttatgcagagcttttagcgagtgcgccagcgccggtatcgcatgttgtattttgagcatcgccagccatcctcaatggttattactctctttctgtgtcaaataacgcttaccggttccgaaaaaagcggtaaaaaaaagtggaaataatttcatccggaaatcagtgcaattttttgcattattcatcgataaggaagggtaaaaactgtctcagataattctgtatggagaattaattgttttcataaacagcagcttatttgttgagcagcagatggcatatctcttgctatgtaacgaaatcaattgctactaatgagagagataagaaaatgattaattcaacgctcgtatccgctgtcgcagagtcacccttagcaattaacgtaaactgggatgagatcttcgttacgcataataagaagctgttaaatttcattcgaaaacgtattgccagccatgaagatgctgatgacatcctgcaaatgacctgtctggaagtgttgtgtaatcgccataagtttcgcggcgcatcccgtccggaaacgtgggtatttggcatcgcagttaatttgattcgcaactactacaaatcaaaacagatccactatctgtttgataatcttaatgatgaagttatcgccgatctgctgctggataatgatcccagcgatctgacggaaaacaggcaattactgagtcatacgctggcatccctcgaaattttaccgaaagacgtcagggtgatgctgtctatccttgtggaggaggagggcagctatcaggatatcgctcagcagttagaaatcccggtaggcaccgtgcgctctcggctctcacgcgcgcgggaaacattaaaggggagaatttacgcctgaatatgggcctgcgaaaaatggcaatttaactgctaagcttatcagctcgttaatatttagcgggttatgactatcatgccgtcggaacgttattctctgcggcttgataaatccgtggagggaataatgcttttacagggtgtatctgaccagaatgacaatgaaaaaactactatcaccggtttatcaaatattgccttaaacaaaattcatgatgcgatatatttgatagacagccagctgcatatcaaatatgtcaatgaaaaggcctgccagttgacgggatattcccgcgaggcattttcgcagctcagctttgacatcattgataaagaaactgcgcgacaatgatgtttttgccctgtggtggaaactcagtacccgccctgaaggtatacaattcacttcacatcataccggccggcatgacgtttttcccgtagaagtgagttgtagcggatatcaccaggacggtgagctgcatatcttatgcattgtgcgcgatatgcatgaaattcgccggcaaaaagagcagcagcaacttcgggaaaaacagctgcatcaggtagtggaaaattctcccgacctcattttacggtttgatttgcagacccgctgcctctatgccaacctggcggtccgcagctggtttaatcttagcgaaaacgatatcagtcgggtgccgctgactgaaagcgtgcagcgcggggggattggactgagcctgtttaagctggtctcacgcacgatggttgatgagaaagtggccgaagatgagctggtggtaaagcatcagggtgataaacgtaccctgcatgtgcgctgcgtgccggaatatgatttacagggcgagctggttagcgtgctggcggttgggcgcgatatcaccgcaatccgcaagaccgaagaggagttgcggcagttaactcataatctcgagcgggcgcgggaagcggaaaaaaaacagctggcgcgtgatattcatgacgagctgggccagcatttaaccgctctgcgtacagggttgtcgctgctggcgatgcgtaaagatcagcctgtcgatgcgcagcaggcaaaaattcagcagctgatggtgcatctggacagcacgattcaggtggtacgggatgtctcgacccgcctgcggcctaacgttctcaatcttggtttaattccggcgctggaatggttgcgcgatcagtttataaaaaacaatggaatccgctgcattttactggcacctgatgaacataccgtggtgctggatgaagcgacgctgacggcggcgtttcgcgtggtacaggagtctctcaccaatgtcgtccgccatgccagagccagcaatgtttatatcttcgtcaaactcacgccggatgcgctgctcatcgaagttgtcgataacggtaaaggttttcatctgaatcgagtgaagaaagggacgtgtgggctgcacggcatcagggagcgaggacgcatgctaaatggagaagcgaccatcgatagtacacctggtaaagggacccgggttaaactgaaattccccctctctgtaagcgctaaatcagtcgcatcctgtccgaaaaccgggagtattaaccgatgagtaaatgcatacgtctgatgattgccgacgatcatgccattatgcgcgagggcctgaagcaaatttttgctcttgatgacaatatcgacgtggtatgcgaagcatcggatagcggccaggtgctggagcgcctgcggcagcacgaagtcgatctgctgctgctcgatatttcgatgcctggcatgagcggagaagatctgattacccgcctgatgcctctctatccccggctgcgcattctggtattgagtatgtacaacgaaccgcaaattacccggcgggtgttaaataatggtgcgctgggctatatcaccaaagacaagtcgccggatgttttactcaaagcgattcgtaccgtggcgcagggatcacgctatatcgatcacgatctggcacaggagattatcttctccgactaccagagcaataatcgtgcgcctcatgagagcctgacgatgcgcgaaacggcaaatcatgatcatgctggcccacggggagtcgattaatgcgatagccgatgcgctctccatcagtaataaaaccgtcagcacctataaatcacgcatgatgaagcgaatgaaatttaccaataatgcccatatcgtgaaatattctctgcagcataacctggtgcaataacgtcttaaggctccgcctgataagcctcgggcggggtcgatctgaaagtgttttgcagcacggctaatgggaaggacgtgtccgcctgaattttaccccgaccgaataataaaaaatccacgccatggcgtggattttagggagtctgtcagacttcatggttttgatgtaacccccatgagacaacaatctttaatcagacgttgaacaggaagttcatcacatcgccatctttcacgatgtactctttaccttctgaacgcatcttgccggcttctttagcaccttgctcgcctttataagcgatgaaatcttcaaacgcgatggtctgggcgcggataaagcctttctcgaagtcggtatggattttaccagcagcctgcggagccgtcgcgccaaccgggatagtccatgcacgcacttcttttacgccagcggtgaagtaggtctgcaggttcagcagggagtaaccagcgcggataacgcggttcaggcctggctcttccagtcccagctctgccatgaactcgtcacggtcttcatcttccagctcagcaatgtccgactcaacggcggcgcacactggcaccacgactgaaccttccgcttcggcgatagcgcgcacctgatccaggtacgggttgttctcgaaaccatcttcattgacgttagctatgtacatggtgggtttcagagtcaggaagctcagatagcggattgccgctttgtcgtcctcatccagattcagtgaacgcagcatgcccgcttcagaaagatgcggcagacacttctccagcgcagccagctcggctttggcatctttgtcgccgcctttggctttcttctgcacgcgctgaatcgcacgttcacaggtttcaagatcggacagcgccagctcggtgttgatcacatcaatatcttcagccgggttcactttacccgccacgtggatgatgttgtcgttttcaaagcagcgcaccacgtggccgatcgcttcggtttcacggatgttggtcaggaaactggttgcccaggccttcaccttttgacgcgccttttaccagaccggcgatatcgacgaattccatggtagtcggcaccacgcgctgcggcttaacaatctcagaaagctggtcgagacgcaggtcaggcatcggcaccacgcccgtgtttggctcaatggtgcagaaggggaagttagccgcttcgatgcccgctttagtcagcgcgttaaacagagtggatttaccgacgttcggcaggcccacgataccgcatttgaatcccatggtttgataccctttataactggatggacagtgcgccagaaggcggactgtcggagacgaattgaaaaatttcgcgcattatacacggaatcacgacgattcgggcgtttaagcaggcttgaaggcgtgcaaccggttcatcgccttgatacgatcctctttcagccacagttcggtgcagcgcgccgcctcatcaatggcatcatcaatcagcttctgctcactggcgggcggcttgcccagcacaaatccggtcaccttgttgcgatcgccgggatgcccgataccgatgcgcagccgatggaaattgttgttgttgcccagtttgctgatgatatctttcagcccgttatggccgccatgcccgccgccctgcttgaacttcgccacgccgggtggcagatcgagttcatcatgcgccaccaggatctcttctggcgcgatgcgataaaaggtcgccatcgccgccacggctttcccgctcaggttcataaaggtggtcggcaccagcaggcgcacatcctctccggctatcgccaggcgcgcggtatagccatagaatttgccttcctctttcagtgactgattgtggcgctcagccagtaaatccagataccaggcacccgcattgtggcgcgtggcggcatattcagcgcctggattggcaaggcccacaatcagtttaatgctgctcacaatgattatcctgctgttatcgcgaaagggcgttagtttacttcgccatggccgagatgacaaagtacaagcaccgaaatggttcatgacggtgattaatcattttccatctgaatcaacaggctgcaatcagggccagttaattatttatggctgatgtgtgatccagtccgcaacgttatcttcacccattgcctaagcttatggcacttaacattgtgtgcggttattgactcatatggatggaggtgcagcatgaaacatcaacactgccgcgtagcgggtaacagcttgatggtactgggattagtcacaatggtgctgggcgtgggtttctcaattatgaaccagcttccctcgcttgatctgccagatgcgctggcgcagggcgcaatcttaggcatctttgttggtgcaatgatgtggctggtcggggcgggtctgagtggtcgtgaaaaggttgaagatcgttattactggcatcgtcactatgacaaacgttgtcgccggtcgcacaattctcaccattaactgatgccagcagtgaccggatgctgcgcgatgcggttccggccgctggccttggcgtgatagagcgctttatccgccagtgcgagtaaatcgtcaaaaccctgctgctgatgtgtgaccgtggcaaacccaatgctgaccgaataggcaattgaattgggttgtgacgcacagacctcccgccgaatcgtctcgcaccaggcctctgcctctgttgccgcagccggaattattgccgcaaactcctctccacccagtcgcgcaaaacgcccctcagccggtatcaatcctctgacgatgtcgcaaaagtgaatcaatatctggtcgccctgttgatgaccataccgatcattaatgctcttaaaatgatccagatcgaacagtatcgcgctaaaaggtcggttctgacggcggcatcgcgccacaatcttctctgcttcattaaataaagcccgacgattccagacgctggtcagaggatcgtgcatcgaggcatgctttaagactgactgcatccgttcattcaccatggccaggatagtaaatgtcagaccaatgacaaacagaatcgattccaggatgacgtaaatcgagaagtttgatccgccaatggcgccaggcagcgtgctgggaatcgcgctatccagaaacaggcgagccagatgaaacagcagatggatccacagcagcaactgcgcaggccagaaggtcacctttagcgtggcacgcgccagccagaccagctggatcagtgcggcggtataggcgatgcaggcgatgcagagcaccagcacccgtttgggtaagctgtaatagaacgccgggaaacagcagaggagtgcccagagcagggcgcccaatagccagtgagtgccgatgggcttgccgcagaagcgccggaacgcatttaacaatccgccgtaagccagcatcactaaaacgttacccactgcaacgggcaggaaatgcaggtcactgctgcgcaggctacttaagaataccgcaatcagggtaaaaaccagcgacaggcaggtgaagccgagaacgcgatcatactgcgatccgatccaggcaaaaaacatgatgatgctcagaaaccccagcacataaagctcgcagacaaataacgtatagatatcgaggctcatggcggtcagggttcttatgaaaagtgcgctgcaaattaccacttaacggcacagggcagaagcggggaacgcggcgttttatcaaaagagtgggtggcgttgaaaataggcgattttggggaaatttatcgcgaaaatatcagaaaaagaagcgcgttaatcgggcgcccggcaggcataaaaaaaccgggcacagggcccggttccgcgaagattaatgctcgaacattgccgagattgattcttcgttactgatgcggcgaatggcttcggccagcatgccagataaggtcagcgtgcgcacattcggcagtgacttaatctcctgagagagtgggatggtatcgcagacgattacctggtcgagcacagatttacgcaggttttcaaccgcattgccggagaaaatcgggtgggtcgcgtaagcaaagacgcgtttagcaccacgctctttcagcgcttcagccgctttgcacagcgtgccgccggtgtcgatcatgtcgtcgaccagcacgcagtcgcggccagcaacgtcaccaatgatgtgcatcacctgagaaacgttcgcgcgagggcggcgtttatcgatgatggccatatcggtgtcgttcagcagtttagcgatagcacgggcacgtactacgccaccaatatcgggagaaacaacaatcgggttttccagaccgatctgcatcatatcttccagcaggatcggactgccaaatacgttatcaaccgggacgtcgaagaagccctggatctgctcggcgtgcaggtcaaccgtcagaacacggtcaacaccgacgctggaaaggaagtctgccactactttagcggtgataggtacacgcgcggaacgcacgcggcgatcctgacgggcataaccaaagtaggggatgactgcggtaatacgaccagcagaagcacgacgcagcgcgtcgaccatcacaaccagttccatcagattatcgttggtgggggcacaggtggactggatgatgaaaatatcaccaccgcgtacattttcgttgatctgtacgctcacttcaccatcactgaaacgtcctacagcggcgtctcccaggctggtgtaaaggcggttggcaatacgttgtgctagttccggggtggcgttaccagcaaatagcttcatatcaggcacgagaagaacctcaggctttgcgtccagagaatgaacggcatgactgtaaccggcgcgtacggtcatgtgcgttcacacgggtgtgttgatgcgaaacgtgcagtgtccggaacgtggtgacactgtcacgcattcgctaatcgcctcgcagggtacgctgtagcggcgaaacatttacgccccgggctacaaatgcgcgtaccccattcggggcaagctccagcacctggcgggcagcagactcggtgtcgaattcagcaaacacacaagcgccggtgccagtcaggcgtgacggcgcgtattctagcagccaggaaacaagctcatcaacctcacgaaaacgttttcttaccactgcttcacaatcattggtgaagggtgatgctaaaagcgtcgataaactgcgcgatggagtatctcgcgtcagtttcggggtcgttgaatactactggagtgctgatattcacgccgggatgggcgacaagataccacttttcttccggctctgcgggatgaagttgttcacccaccccctgggcgaaggccgcgaagccctggacaaacaccggcacatccgcgcccagcttcacacccatcgacgccagctcatccggcgtgaagccggtttgccacagatgattcagcgccaccagtacggttgccgcatcagaggagccgccaccgagaccgccacccatgggcaggtttttctcaacggcaatctgcgcgcccgcgtgagcggacaggcgattgttatcctgcgccgcctgtttcagcatgtttgcggcgcggacaatcaggttatccgcatccgcaacgcctgccacgggcgttaacagtgtaatcgagccgctttgatcgacggtaatctgcagttggtcaccgtaatcaagaaactgaaacagcgtctgcaggttgtgatagccgtcgggacgacggccggtgatgtagagaaaaagattcagttttgccggggcaggccagtgggtgatcattgaacggtccagccgtccatacgcagtttaatccgctggtcaccctctttcagctccaggctcgacggcagcggcggggtgactttgctgtcgtagcccgcaatagagacctgccagttctgaccgtcgcggctgtagttcaggctgctcagctgatagctctcattgagctgatagtcggtggcatcgcctggcagacccatcatccactggcgcagattcgccagcggaatgttcatgccggtcagctgcgaaatcattttctgcgcatcgttgctgacgtaacgcttgcctttgttatcgacgatctgtaccaccgagccttgcgcatccagctgcagttcggtgctgccgagcggattggtcagcagcaggcgatagcgatcgggcgcggtctgctgccagttaaagcgggcatagactttctgcttgtcagaaagataggcaaaggcgccgcgggtctgatagtgcgtgacctttgagaccgcctgctgatgctgttgccactgtggcgcggtaacgctggggcccgggccttgcggtttgttgacgctacaggctgccagcagcacgctggcaaggggcaaaaggcgcaacagattgcgtggtgaattaagcatcaagtggtcatctcctcggacacatttattattcgtaacggataacgctaaccgtcccggttttaaccgtcaatgctgttatgcagcaaattgagcacgatcgggttaatcttattacagtcatagcctttgtatggcttttcttgatctgccgcatcttgtagaatgcgcctcacaaaaccctgacattattgggacatcccaaccaaaaccgctatgacgctgctcgctctcggaatcaatcacaagacagcccccattgctctgcgcgaacgcgtctcgttcgggccggagacgcttgagcaggcgttaaacagcctgttatcacagccaatggtgcagagcggcgtggtgttgtccacctgtaaccggactgaactctacctgagtgtagagcagcaggccgacttacaggcgcgtctggtgagctggttatgcaattatcatcagctggatgaagaggatgtgcgaaacagcctctactggcatcaggataacgaagcggtcagccacctgatgcgcgtcgccagcggactcgactcactggtgctgggcgaaccgcagatcctcggtcaggtcaaaaaagcgtttgccgactcctcacgcggtcaggcgctgagcagtgaactggaacgcatgttccagaaaaccttctcggttgccaaacgcgtgcgtacggaaaccgatatcggtgccaacgcggtgtcggtggcgtttgccgcctgtacgctggcccgtcagatcttcgaatcgctctcttccgtcaatgtcttgctggttggtgcaggtgagaccattgagctggtggcgcgtcatctgcgtgaacatcaggtcaaaaatctgatcatcgccaaccgtacccgcgaaacgcgccgaaacgctggcgtcggaagtgggtgcagaggtgatcaccctggcggagatcgacgcccgtctggcagaagccgacattattatctcgtcaacctccagtccgctaccgattatcggtaaggggatgatggagcgcgcgctgaaagcacgacgtaacaaaccaatgctgctggtcgatattgcggttccgcgcgacgtagagccggaagtgggcgacctgcctaacgcctatctctacagcgtggatgacctgcaggcgatcatcgagcagaacctggcgcagcgcaaagcggccgcggttcaggccgaaagcatcgtggttcaggaaagcagcgaattcatggcgtggctgcgctcacagggcgcggtgaatacgatccgtgaatatcgttctcaggcggaagagatccgcgctgagctggaaggccgtgcgctgcaggcgctgcagcagggtgccgatccgcagaaagtcatgcaggaactggcgcacaagctgaccaaccgtttaatacacgctccaaccaaatcacttcagcaggccgcccgcgacggcgataatgaacgcctgcagattttacgcgacagcctgggtctcgattaggcacaccgctgtcgccacctgttacgggaatcccacatttaaatgaaaacctctatagttgccaaactggaagccctgcaggagcgccacgaagaagtggaagcgatgctgggcgatgcaggcgtgatcgccgatcaggagcgtttccgtgcgctgtcacgcgaatatgctcagctgaccgatgtgacccgttgcttccgcgactggcagcaggtgcaggaagatatcgaaaccgcgcagcagatgctcgacgatcctgaaatgcgtgacatggcgcaggaagagttgcaggaagcgcgtgagaagagtgacgtgctggagcagcagttgcaggttctgttgctgccgaaagatcccgacgatgagcgcgcctgttttatcgaagtgcgcgccggaaccggcggcgatgaagcggcgattttcgccggcgatctcttccgcatgtacagccgctatgccgaagcgcgtcgctggcgcgtggagatcatcagcgccaacgaaggcgagcatggcggttacaaagaagtgatcgcccgcgtgaccggcgaaggtgcctatggacgcctgaagtttgagtcaggcggccatcgcgtgcagcgcgtgccggagaccgaatcccagggccgcattcatacctcagcctgtaccgttgccgtgatgccggaaatcccggaagcggaactgccggaaatcaatgcgggcgatctgaagatcgatactttccgctcatccggcgcaggcggtcagcacgttaacaccaccgactccgctattcgtattacccacctgccaaccggtatcgtggtggagtgtcaggacgaacgttcacagcataaaaacaaagccaaagcgctggcggtgctgggctcgcgtattcacgctgcagagatggcccgccgtcacgccgccgaagccagtacccgacgcaacctgctgggcagcggcgatcgttctgaccgtaaccgcacctacaacttcccgcagggccgcgtgaccgatcaccggatcaacctgaccatctaccgtctggatgaagtgatggaagggaaactcgacagcctgattgagccgattgttcaggagtaccaggccgatcagctggcggcgctggctggtcaggattaatggatattcgtcactggctgaaacaggcggtcgccacgctgtgcggtggtgacagtccgaagcgtgacgcagagatcctgttaggttttgtgaccggcaaatcacgcagctggttaatcgcctttgatgaaacggtgctcagcgaagaacagctgacgcagctggatagcctgctggcgcgtcgcgcccgcggtgagccggtggcgcatctggtgggcgaaacgcgagttctggtcgctgccattgcgcgtcaatgacgccacgctgatcccgcgcccggataccgaactgctggttgaacaggcgctggcacatctgcccgcgacaccggcaaccattctggacatgggcaccggcaccggagcgattgcgctggcgctggccagcgagcgtcccgattgtcaggtcaccggcgtggatcgcattgaagccgccgttgagctggcgaacagtaatgcgcagcagctcagcctcaccaacaccacctttctgctcagtcactggttccaggcgctgacgccacagcgctttaccctcattgtcagcaacccaccctacatagatgccagcgatgttcatctggagcagggtgacgtgcgctttgaaccgcgcagcgcgctggtggcggatgaagcgggactggcggatctgcgtacgctgatcgagcaggcacctgcgtggctgttgccggggggctggctgctgctggaacatggctggcagcagggcgaggcggtggccacgctgatgcggcaaaaaggctatcacgccgtggaaaccgtcgatgattacggtggcaatccgcgtgtgaccttaggccagttcccttcataaaagcgctttgaaaaggattcatgatgttcgccttttatcccctgattaaaaatctgcacatcttaacggtggtgcttaccgtgacgctgttcctgctgcggttttactggctgcgccgtggatcggcaatgatgacgaaacgctgggtgcgcatcctgccgcacgctaacgacaccctgttactggtgaccggcgtctcgctggtgatgattacccacttctatcccttcacaccgcaaggaagctggctgacggagaagcttttagcggttatcatctacatcgccttaggatttgtggcattgagtcgccgtccacgcactgatcgcacccgctggatcgcttttctggtagcgttaatcgccatggtggccatcattaagctggcgctgaccaaaatgccgttatggggatagcatgacctcgaccgaacaattagatttcagccagacaccgctgtgtgaagcggtgattggtgccacgcttgccatccgcgccgatttcccggcgttgtcggtggaagcacaacttgcggcgttagtcgccgaagcacgtgactatgtcagccataccgaagatgctgacatgcagctcgaaaagctgctggagctgttctatcgccagtggggattttgcggtgccagtggcgtctacaatctttctgatgctctctggatcgacaatgtgctgaagacccgtcggggcacggcggtgtcactgggcgttatcctgctgcacatcgccgccgagctggaactgccgctgatgccggtgatcttcccgacgcagctgattctgcgcgccgactggattgatggtgataagtggatgatcaacccgtttaatggcgaaacccttgaccggcacacgctggaagtgtggctcaaaggcaatatcagtccgacagcgcgtctgtatgacgatgatctcgacgaagccaaaaccgtcaccgtgatgcgcaagatgctcgacacgctgaaagcggcattgatggaagagaaaaagatggagctggcactgaacgtcagtcaggtgctgttgcgtatcgatcctgacgatccctacgaaatccgcgatcgcggtttgatctatgcgcagctggagtgcgaacatatcgccctgaatgatttaacctacttcgttgagcagtgtcctgaagacccggtcagcgaaatgatcaaagttcagattcacgcaatcgaacaaaaacaggtcacgctgcactaagcggacccactgaaaaggaaagggcatgacacagaaagtcgtgagtattggcgatatcaaagtcgcaaacgatctgccatttgtgctgtttggcgggatgaacgtactggagtcgcgcgacctggcgatgcgcatctgcgaacactacgttaccgtcaccagtaagcttggtattccttacgtattcaaagcgtcatttgataaagcgaaccgctcctctattcactcctatcgtggcccaggcctggaagaggggatgaagattttccaggagctgaagcaggctttcggcgtcaaaattatcacggatgtgcatgaagcgtcccaggcgcagccggtctctgaagtggttgatgtgatccagctgcccgcgtttctggcgcgtcagactgacctggtggaagcgatggcgaaaaccggcgcggtgatcaacgtcaagaaaccccagtttcgtcagcccgggtcagatgggcaacatcgttgataagttcgctgaaggtggcaacgagcaggtcatcctgtgcgatcgcggcagcaatttcggctacgacaatctggttgtcgatatgctcggctttaacgtgatgaagaaagtcaccaaaaacagcccggtgattttcgatgtcacccatgcgctgcagacgcgcgatccgtttggcgcagcatcaggcggtcgtcgtgctcaggtggctgagctggcgcgtgccggtatggcggtcggcattgccggtctgtttatcgaagcgcacccggatcctgaacacgccctgtgtgacggcccgtccgcgttgccgctggataagctggagccattcctggtgcagatgaaagcgattgacgatctggtgaaaagcttcccggaactcgataccagcaaataagtttgctgcaaaaaaaagagcgatgattcgctcttttttttcgcctgaagacgggtgacgttacagcatgatggtcatcagataaccgataaacaacgccagatgcgcggctccattcagtacatttgtgcgtccggtcgagaaggagagctgacagagaatcagcgacgccatcataatcaccatctgcggcggctccagaccaaatatcagctcctgtccggtcagggtggcgataatggttaccgccggtaccgtgagtgagatggtcgccagcactgaaccaaagaaaaggttcatggcgcgctgcacctgattcatcagcacggccctgattgcccccaggccttccggtgagaggatcagcagggccaccaggaaaccggtaaactgtgccggtgcattcagatccgtcagcaggctttccagcgtattagcattcatcttggtcacggcaatgaccgcaatcagatgcacgatcagccagctggtatgccagaagctgctgtgggcagacggtttgccatgatgcgggtcgccatcatcgctctcatcttcatgctcatagacaaacaggctctggtgggttttggtctgaatcagcaggaaacacgccatacatcgccgctgaaatcgccgcgatcagcagtgcctgagtgacagagaaattaccgcccggcagtgcgttgggaaacaccagcaccagaatcgccaggggaaagatagcgatcagatattgcttcacgcccgccagattcacgtattgcgtcgcaaacttattaccgcccagcagcagcgcaaagccaaccagtccaccggttacaatcatcacgatcgaatagagcgtatcgcgcatcagcccgggtgcggcatcgccggtcgccatcagcgccgagatcaggctcacttccagaatcaccacggagagactcaggatcagagagccatagggctcgcccagccggtgcgccagcacgtcggcatgtcgtacaacgctaaaggcgctgctcagaatggcaaccagcgccactaagttgataccgactacaatcggaaatgatgtggttgcaccaaaaaaatagagtatacccagcgtgataaggggaagtatcagcgagaattccttgtgacgtgttttttcatgtgaaggcattcaccatcctctctggttaatgattatccggacacagcgagtgctgctgttagaaatataatcagttttagggcagggcgcagtttatcttttcaccggtccgaacgggaaaaatttactgctttttactcaaatgcaataaatggtcgaagcggtattaacctgaagttatctcaaatattgcaatattaatcaggccacaacaatttctctttaaccatctatctgaccgccaaatgccgtaaaatctgtttatcattgtaacttgtgtggcctgtttctggtttttaatttgaaggggagataagtggctgtttgtatttttgttctgttgcgccaggcttaacaggaatccataaactgaggagccgttatgccttactctaaacgaaaccgacttacctgacaacgtaaaacacgtgcttcccgcgcatgcgcaggatatctatcagcaggcatttaacagcgcgtgggaagaatataaagaggctaaggatcgacggggcgatgattcgcgggaagaggtggcgcacaaagtcgcctgggcagccgtaaagaaagagtatgagaaaggcgatgacgataagtggcatcctaaacgttaatgccgtcgctagcctgttcacgccaaagggccaggattatctggccctttttttcatcttcgctataaggtttatctggttttttttgacctgcgaccggaatcacgcttgtaaccccgcgcggaaatagattaatgtcaatttgatgaacgaaacgcagcgccgttttggagatcatgttacaggagccattctgcaggacgccgttgacgttgaggaggtcgcattgcttacccgggaatttctattaaaagcggattgtaaaacgtcgttcggggatatcgaagaggcgttgctctggagttgcgagcagcgcgcggcctcgctggcagccacgctggcctgtcgtcccgatcacagcccggtatggatctttggttacggctcgctgatgtggaacccgatttttgaggcggatgaagtggcgtccggttcgctggagggctggcaccgtgctttctgcctgcggctgattgccggacgtggcaccgccgcgcatcccggtcgcatgctggcgctgaagcagggcggcagaaccacgggtctggcgtttcgtctgccggaagagcggctgcatgaagagctggcgctgctgtggaagcgtgagatgatcaccggctgctatcttccaacctggtgtgaattacagctggaggatggtcgcagcgtcactgcgctgacctttattatggatccgcgtcatccgttgtatgaatcggactcctgcccggaggcgattgcgccattgattgctgcggccagcggcccgctgggctcgaatgcgcaatatctgtttgctctggaagaggagctgacccggcgcggcatggaggaggagagtctgagccggctggcccatcaggtgcgaacgctgcagcaagcctgtctgaagcaggcctgaaccggggcataagcagagtaaaagggcgcgacagtgtcgcgcccttttacgatccggctgcgggttaccgggcttagttacccggattaatcagccaggtaccgggcttatcgatggtcagggattgtgtgtgcgtctcactgccattcttaacgtcaattttgtactgtcccgccgccagattcagtgcggcaaatccgctgctgcccggttttacctcaaccggctgtccgttaagcaccacgctttcactgctctccagcttaagatagacggtcgccagcgcggccggaacggcagcggctgacggaatcgatgcgggcgcctgcgtcatggctgagctattgttaaccacttccggtgtggcactgtggcgattcgccagccagatggcgacaaccacggccagaatagccacggcagccaggcccagcaatccaggcgacagtttacgcaccgtgcgcggcgtcaccggctcggcggatgcggcggcatgattcatcgccattaccaccggcgcagcagcctcaaccggctcctcgaccggcagagcaggcgactcgcccggcaccgggaagctgtttaccaccgcttccacatcactgaccggcagatcaatcaacgcggcaaaggcatcaatcgtttgtgggcggtcgcctggcttcattgccagcgcgcagtcgatggcatgcagcagcggcagtgagtagccttctggctggcgttccaccagcggctgataattatcttcaatgcagcgcaccacgctgaccggcggcggattaccggtaatcaggttatgcagcaccgcgcccagggcgtagatatcggtccacggcccctgttcaacttcaccctcttcgctgtactgctcaattggcgcaaagccaggtttaagcatgatttccgtttcgtcagagaggttgccaatctctttacgagccgagccaaaatcgagcagaaccggcagctggttctcctgaatctgaatattgtcgagcgagatatcgcgatgcagatagccggcctgatggatggtgctgatagcacccagcagtggtggcagcaggcggcggatccaggcttcagtgatcgacgccgggctggttacctgccactctttcagcgtcataccgctgtagtagagcgtgcccatataggctgtgccgttctgctcccagaagcgcagcacgtgcagcagtcccggatggttaaagcgggccagcagacgcgcttcctgaataaagctggtgagcccggcattaaacagcttctggaaacgctcaccgcgcagctccagcgttaagtcggcggcacggactgccagcgacaccggcatgtactctttgattgcaatagtgcgttcaagctggtgatcccacgcgcgatagacgatgccgaagccgccgcctccgatcacttccttgatctcaaactcattgaaacggtatccgtcaggcagggcattcggaacggttttcggattatcatttgccgacatagtgaactctctgtacacggcctgctcgccaggctgcgcggtaattaattgatgttacgccaggcaccaatggcaggatcaaccagatccgcgtgcagggtgtcgatgagtaacacattcactttttgctgtggcatgaaatagggcgcccagtggctgcgcaacgtatcaactcgcgatttcacagcgtcagcatcctgctgcgcagcattcttatccatctttatcaacagggcaccattgaagcgccagacatgttgtttggcatcaaagggaagcaccagccagctatcattcgcatccgggcgtgtcacaatcatgcgctgattgttcgcggcgataacctccagcttgctgtccgggatcgtcagattggcgatgggatagccctgataaaaggtgactgccaccggcgttgggtggtcaggggtcgccagcatcagctcacttttgccttctgcccagccatccggtgagcactgctgcttgctgacatccgggataaacagggtctgggcattttcatcccaggcggtgcgaaaatggcagccgctggggagatcaaaatgttgcagcggcgtgctgttggcgggccgagacaggtcaagcggtgtagcattactctcactggcgctggcggtggcatctgccatcacgataggacgccagtttctgcaacttactggcgctgccgctggccagtacgccaccctctttactggtcatctgccagggcagctcgtccagtaatccgcactgattagcaagcagggtgccgacgcgcggtaaaaaggtggtcagcaccgccgaatccttacttttgccggagacgatgcgcagtggcagcgtctctttgcaccagtcgtcaggcgctttactcaccacattatcgatatagacctccagcgccaggctgggggagtagacaacccgataattttcagcctgggcgtgaaaggcaatcagcagggtgatgatgccgggcaaccacagtttcataaggatccttggaatcaaaaacgaggcggcagaaagcgtgccgaatcagccagtgaatagagcagcgttgcctcctccggctcaccaatccagaccgccagtgcgctgagattatctttcttaacgttgcggctcaccgcctgttccatcagagccagccactcttcgcaggcattcaccatgcgcagcgcctgttccatttcatgactggccagattcagccagaagccatcggtgcagaccagaaacgcgtcgccatcctccagcgcaatctcctgcgaaaagcttactaagcgaggcggttcagcgccgagcgcattatagagtaaattactgttaatgccggtattttcatagcccgcttctttcagctgctgggccagactgtgatcgcgagtgacctcatgaagcacgccgcggcggaagtggtaaacccggctgtcaccggcatgcgcccaccatgcgcgctgtttttcgcggtcgataaacagggccgccagcgtggtgctcatgcgtgaatatttcggatttttaccctgtgcctcatgcagcgctaagcggcactgttcaattgcctgatgggttatttccggcgtcaggtcggcgtgtgcctttaactggctcagcagggtgtcacgcacgagctgtgccgccatctcgccgccgggcagaccggccacgccatcgcagaccacaaaacaggctttacgctcatccagctctgcgccggtgcgatcctgattctcatcgcgtagcccctgctggcagcggctggcaaaaacgattttcatggttcatctacccgcgtctgagagtccttatactgattcacctccatgtcataggcatggagaaaggcctcgccaaacagcgtatggaaatcatcttcgatctctccggccgtacgctgataattacgggtgaagtagtcccacagcgccgccttcttcatggcggaaaagggcatttttgacaccacgccatcggcacgcgcctgctcctccagccgctgcggattaaaggattgcagcatcgccgcaataatggcgcggataccggcaatcatccccagctggtgggcctgcaaatcgaccagggcatcgcgtaccgcctgttccggcggcataaacccgggcatctggctctggtacatctgcatcagcacggttttgccggagggcaggatcttgaacgggttgttggcctcattcaggatcatcgtcatgtccgctttgacaccacgcttgagaatggatcgcgaagagagcagcgcgacggtgccctgggaaaagaggctcagcatccggccagtaatgcgcatctgctcttcatccaccggcgtggcgtgaccgttgctcagccccatcccctccagcagtgcggcgatcagccgatcctgatccaccggctgcgccggctgcgcccgacgcggctcgctggcctgggggtcgatagccagtcgcgcatcgttgtggcgctcgtggcgtgagggcgtgacctcactgaccagcagccggtcctcaacctcatgatgttcgtggatgcccagcggatttgcgggctgagcgctgtcgccagcaaacagcgccagcggatcgctctgcgtgtcgtggcaggcggggtctcgtacttccagcgcatagtcaccgatgcgcagcgcatcgccatgcttcagcacgacctgcatgccgcgacccagggtaatgccgttatgctccaccggggtcacgctgccctggttcgtcagacggcactccccgtcatgcgacaggtgaaccagcgcctgcagacgcgaaatggcccgagtctcatctggcagcaccagatcgttgtcctgactgcggccaatggtgccgccaggcggttgaaacgcgacgcttctgaccggaacatccgtagtgcattgcacaatggtaaattgcatgagttatcccagattgaacggcaaacgcttccggcctcactcgaacatgggaggatagaggccattacgtcccggctgtgaacctgccgccgggttaaacagtaacgaaaacagttgcgcggtgaggttgccgctgtgcttgtgggtcgcgtgggcaaaaccatcactgcgattactccaccagtagctcatatgctgctgaggatcgaaacgttcagccacttcacgccagctcagcgtgcagggcagatcctgaaaaccgatcacatccatgatttcagagggcttcctggccgggaccagcagcggtggcaaagcctgtatctgctgctctaactgctcgccgttcagcggtgtttgaaccgcccgtaacagtgtcgcgcccagatcctgaaaccagtcaccggaaatggtcagctgagcaggatgccactgagccagcgtgaagctgtgcagggccagcagcggccaggcgcgtccgacgcggtcacaggagggcagcagacagcccatctgtatctgcggccgggtcgcggtaaccggcagcacaaagttccacaccggcgcgtggagaaagtccgcactgtaggaatacgcctgctgatgccagtgcattaatccctgctggaaccagtgattccacggactaatctgttgctcgctcagtcgatggtgcagaaagtcaccggtcgacggcagcttgccataccagccgggggccgtataagcagccatgttcacctcaccattactcgctatgcgagtttgattgcggggccgggtgccgcggcgctaccgccagcatgccgcccgcctggtccgcaattttcagattctctgcaagcttgcgcatcatcagtgcattatcacgtgcataaggcgacgactgaatctgctgatccagcagctggctcaggtgccagtcaagctgctgcaggtcgcgggcgcttaccgtatcgggcagggagcgctgtaaattttgcagcagccaggcccgtaaaaactcgccatcataattacgcggttgatagagcatctgataggcgcgcagcgcattgcggctgtaggcgttatcatcacccgggtcgttgcgcaggatattcgtgatctgctgcgccacacgcggcagcaacaaagacttaagcgcattttgataaagcacccaggcagcatcgctaatctgattaccccggtataagcccgcccgcatagtaagcggcggattatcgagggaaaagcgcgccgagagcggcaacttcaccaggttattcagaaagggtagcagatcaaaaatattatcagcaggctgatgaatcacctgctgactttgctcacggataagtggtacccgcgcggcaacctgctgcagatactgttgattctggtagtaactgatgccccacaggctggaggcgatcagcagggcgcctgccagcacgccgtagccaatccagtggaacagctgattacggtactcccagcggcgattactgccggccaggccgctctctttgaatatcagatcgctgagcaggtcacgaataaagaagctctggcctttgttgccgggaatcggactgttgcgattaacgctgtcccaggccgcgatcgagtgatcgcccgcctgacgcaactgcagtttgcggctcagttcacccatcacccgatcaaacggcaggccttcctgggtgccgctggtgaagaagaggccgcgcgggctccaggcgaccgcatcctgatggtcagaaaaaacgatatccagatattcgttcagcagtggacgcagcgaggcgaactcctgcgggaagaggaagcactcagcgcgctcgttcaggtcgcgctcatgggtcatctgctccgccagttgttgctggagctgctgttccagccgctgaaactgctggccaaaatggcgatgccagtcatctttgtgcggcttgcccagctcccagttgaacgtgaagccccagatagcgtcacgccgcgctttatcaatcgagccgaagtagctcataaagcctttcagcagatcggttttggtgaccatcacataaaccgggaagtgaataccggtctgctgatgcagttctgccatgcgctcacgcagcgcgctggcctgggcgaaacgcgcctcggctgagtcactcagcagatcggcgacgctgatggtcatgatcacaccgttaatcggctggcgggtacgatagcgtttcagcaggttgataaagctgtgccattccgcggcatctcgcacgcgctggctctcctgcaacgcataacgaccggcggtatcaatcagcaccgcgctgtcagtaaaccaccagtcacagttgcgggtacccccgacaccgcggaccgcatttttgcccagcgtatcggtcagcgggaaatcgaggccggcattaaacagtgcggtggttttaccagcgccgggcgcacccatgaccaggtaccagggcagctgatagagataattagcgttaaagcgtgagagcaggttcccgctgtgacgacggccaaactgggtgcgtttcagctgcatcgcagcttcgctgaagcgctggttgagccgctcttcggtcatctgacgttccgccgggtcgtcgttgcccgacagctgaagctgggtcagtaagcggctgttgaaccaggcacgatagagcgacgggatcagttggaacaggatccagagaaaatagagagcgctcacggtaagctggcgaggcagtacgggttccagggggcgcgattcgccccatgaccagaacggtcccagcatccagaccaggcagctcagcgccgtgacgccaataaagctccacagcaggcgatgcgttagcagcaggcgaagggaggcgcgcattattgtgctccttgatgattactgagcgtttcaggcgcggcaaacagggtgatttcaacgcggcggttgcgggtgcggttttcgctgctgtcgttgggcagcagcggatcgctgtcgccgcggccttcagagcgaaccgtatgaccgtcagccagttgcagttgtaacaactgggtgatggcgcgggcgcgggcaaatgagaactcatagctggaggcaaagcggctgttatccaccggatgatcatcggtaaacaccgacaccagaatggtccctttgacatctttcatcgcggttgagacgcgggccagcagggcgcgccccaccggattgatcaccgtgccctgttcggcgaacagtttgtccgcggggatgatcactttgctgccaaaggcaccatcgctgacctcaagctgcccggctgcaatcacatcattcaggcgctgacgcagatcgagcagcgcctgcggggaagagggacgacggcccgcggtaatctgcggcagcggcgtctgatagatggtacgcagcagcggttcggcggcattaccgagacgccagttcaggccgctgtagatcaggcagccgaccagcgcgaccagcatggcacaggcccagagcggcaccatcgggcgggcgagggtgctcactagcggatgcacttcaaccagtggcggttgcgctgtctggcgctgtgcgcgcgtttcgtcaatcagggttttcaggcgtttacggataccatcgcactgggcgcgaccattttcactgccgcgatagcggccttcatagcctagcagcagacagtattgcaccacttccagcagccagaggtgttgttgcgggctttgtgaaatgcgcgacagcagttgaaagaatttttcgccgccccagctttcattatggaaggtcaccagcatgccattgccagaccagacgccgcgcgtgccccatggggtttgcgccgccgcttcatcgagcgcgctgcagatgcagtaacgcgcgccgataatcatttcaaacggcagccctgcctgtttacagcgttgttcaaactggcggatttcatcgatcagagactggcgcagacccgcagggtcatcatgggtggctgcctgacgaatttgcaccaccgcgttcagcagtggcgccgcagcctgaagtaagagattctcattgcctgagggggtcgcctcacgcgcaggggattccacagtcattaattcgtgatcttccagccaatggcaaatccctgtacccgcagcccgggacggttctgcgggcaatatgcgccggatttcatattcagtctaagatccaggtcgcggtatcgttagtccggcaggctttgctggcgccgccgacggccacacagacctgtttagttttgcggggacggggacgatcgctctgcacggtggcatcgtaacggctgctctctacacccgcttttaatggcacataaccgatcagcgggccgtcagcctggtcagcaatcgccagccagctgtgttccacattacctaatacttcgaacggtttacccgtttcgagatagcgaaccactttgccgccgtaatcaggcgaggtcatgacggatgcgccataaagcgcccgccaggtctgattgaccggctcaaattcagtcggtgccgcgacagcgtgtcgatggaccagtttgacgccgttaatttcgctggtaaccagcgtatcgtcagtgacgggcggcggcggggccttacagcctgccagggtaagaaccgccagcagcgttaacgcaagactctttttcaccatgttcctcgtgatctcatcaaagtatctgcatattgccaggcccgatgccatggggcgatctttatcgcgccgcatcgtgccgaaattctgtttttaaaaaaagggtcagattacatcgggatagtaacgcattcagtttacctaagacttttgagaattcaaaccattgcacccgctgctgatgcgtgatagcaggcgctttacgggcgggtttcggtataagaaaagcgccaggtaatgtgatagttaaagcgaactgaattatcgcagagacaaactggttgagaacagtgccgcgcattctgacatgcaatgaatccgattggaaactattaagatttactaataacttgttgccgaaaaaatttatcagtttgcgttaagaaacttatcaaaatcagattttacgcccctgctcagaccctcttttttcaggaaagcggcacgccttttgcttctgaaaggttttaaccgcactgaggtgagcaatgagggacgccctgacctggctgcaggcatcacgcgcgagcgatatcgccagcctgcaacgtcttctggaaaccggcgagctgatggctgccgtcagtgaactggtccatcggttgcagcgggaacgtggcgcaaacaatctctggatctgctctgacggagcgctgttcagcgccgaacgtcatgcccgccagcaggaggtcagcgccggcctggagcatttttatcaggcgctgccggccgccatagcgcagcccggctacagccgcttctgcaacctgattgccgctgccctgcaggcgctggccggactgcctgcgctgcgccagcaaatcagccagcgtgagcttgatcaggccgcggcgatggccgcctttaaccaggttatccgtactttactcaatctggtgtttgaggcggccgacaccgccagctatcccggcatctcccgtgcactgatcgccctgttcagttttatgcagggcaaagaactggccgggcaggagcgggccatcggctcagccggctttgcggcgcgtcagttcacccccgaccagcgcagccagatggtcgccctgattgcggcacaggagcagagctttatcaccttccgggagtttgctgacagcgccgcgtgtgaatcctggcagccgctggctcaggccagccgcgacatcgaacgccttcgtcgcatcgcctgcaccggcggccgttgtgatgagaccggcgcgctgcactggttttccctgctctctgagcggctggatcagatgaaaatgctggaggatgccctgacggcgacattgatgcagcgctgccgggctgccattgatcaggcacaacagcaggcggcaggaacagtggtgcagggcgacagcaatttttcgctttacgtctccggggcggactggctgcctggcgcggcggcgctcgacagcgacggtctggccccgcagctggggcgctcggtgctatcgctgattggcgaacagtcgcagcgtttgcagcagcaggcggatgaactggcggcgatgcgcgcctcactggacgagcggcgggtgatcgatcaggccaaacactggctgatgcagcagcagggtttcacagaagaggccgcctggcaggcattacgcaaaagtgcgatgaatcagaataagcgggtactggagatcgcgcaggcggtactggcggtagcgaagaccctgagcaactaacccggatgaggtagctgcacaacctttgtgcgtgatctgcgtcagaaacgtgcaaaaacggttaatttttcaacagtgcgtcaccgcagatcggcattaaggctgtttcggcgatctggcacatcctttgcttaatccctatagagagtacgcattgctcccgccaatggcggtggggtcagtgctttggataaaggcgtccatccgcaggcttcggcttgtcggaggacgcctttttttatttctgttcaggggcaacaagatgagcaaaacgccattttcactgacacgacgtcaggcgctgatctccggcgccgcgctgggtgcggcctggatcgttccgggattacgaaatgcggtctgggcagcgggatcagatgcgccagaaaaagcgcaggtgcgggtcggctttatcccgctcactgactgcgcgccggtggtgatggcctctgtgaaaggcttcgacaaaaagtatggtctcacattgcaggtcagcaaagaggcgagctgggcggcggtgcgcgacaaactgacctccggtgagctggatgcggcgcatgtgctctacggcatgatctacgccctgcaactgggcgtagcgggtccgcagcacgacatggcgaacctgatgacgctcaaccataacggccaggcgatcaccctgtcgaaccagctgaaagccagtggggtcaccgatgcggccagcctgaaaaaggccattgatggcagcgccaaaggcagctttaccttcgcccatacctttccgaccagcacccatgccatgtggctctattactggctcgccaatgcgggcatccacccgtttgatgacgtgcgcaccgtggtcgtgccgccgccgcagatggtgatgaacatgaaaattggcaacatgagcggcttctgcgttggtgagccgtggaaccagcgcgccatcagcgacaacatcggttttaccgccgccaccagccagcagatctggccggagcatccggaaaaagtgctcggcacccgcgcagagtggatgaaagagaaccccaacacggcccgtgcactcaccgccgctgtgctggaggccgcgcgctggattgatgcctcggacgacaaccgccgcgaaaccgcgcaggtgttagccggccgcgcctggatcaataccaaagtggagacgttacagggtcggatgctcggtcagtatcagaacggcctggggcagtcgtggcaggacgctcacccgatgcgcttctttgacaacggcaacgtcagttttccctggctctcagacggcatgtggttcctgacccagatgaaacgctggggcctgcttgccagcgatcccgactacctcgcggtggcgcgccagatcaaccgcatcgacatctacaaacaggccgccagcgcagtcggacaggttgcactgcccgccagtgaaatgcgcagcagtaccttcatcgacggcaaggtctgggatggcagcgatcctgccgcctatgccgccagtttcgctatcaaacgttaagagaggttgctatgaaaactgacgcgcgcgccctggcgcagccggtgcagagtcacaacagtgccaccgttattccgttacaggtcaccccgaaagccgcagcccgtccggcgcgtctgcgtccgctgttgcagcgcgccattcccgccaccggtggcctgttattaatgctgctggtgtggcagatcgcggcgctgtcgcaaccgggtttcccttcgccttacgccacctggcaggccgctcaggtcctgttcgctgacccgtttctacagcaacggccccaacgatcagggcatcggctggaacgtgctggcgtcgctgcaacgcgtcggcattggattcggcctggccacgctggtcggcattccggcgggctttttaatcggtcgctttagctttatggcgcagatgttcaatcccgtcatcgccctgctgcggccggtgagtccgctggcctggctgccgattggcctgctgctgtttcagcgcgccgagcctgccgccagctggaccatttttatctgttcgatctggccaatgatcattaacaccgccgaaggggtacagcgtattccgcaggattacctcaacgtggcgcgggtgttacagctttctgagtggacggtgatgcgccggatcctgctgcccgccgtgctgcccgcggtgctgaccggggtccgtctctctatcggcatcgcctggctggtgatcgtcgccgccgaaatgctgaccggcggactgggcatcggcttctggatctggaatgagtggaacaacctcaacgtggaaaatattctggtcgccattctggtcatcggcgtaatcgggctgctgctggaacaggggctgatgctgctggtccgtcgttttagctgggataaataaggagagcacgatgcaacagatcattcgcgtccagcaggtcagccagcgttttgccaccgccagcggcgagtttctggcgctggacaatgtcagttttgatattcacgaaggggaaaccctgagcctgatcggccactccggctgcggcaaatcgacgctgctgaacctgattgccggtttaacccggcccagcagcggcgtgctgctgtgtgataaccgcgaaatcactggccccggtccggagcgcgcggtggtgtttcagaaccattcgctgctgccgtggctgacggcatttcagaatgtcgagctggcggtgcaacaggtgtttaaagggcgcttcagcaaagcggagatgcgtgactggatcgagcacaaccttaaccgggtgcagatgagccatgccatgcacaagcggcccggcgaaatatccggcggtatgaagcaacgcgtcggtattgcgcgggcgctggcgatgaagccacgcgtgctgctgctggatgagccgtttggcgcgctggacgccttaacccgcgctcatctgcaggacagcgtgatgcgcattcagcaggagctgaacaccaccatcgtgctgattacccatgacgtggatgaagccgtgctgctgtcagaccgggtgctgatgatgactaacggcccggcggcgcaggttggcgagatcctcactgtcgatctgccacgtccgcgttcacgggtggcgctggcggatgagccgcgctaccaccagttgcgacagaaagtgctgcatttcctctatgaaaaacagaccactgcggcgtaaggaacagaccatgaagcaacggttgctggtgataggtaatggcatggcgggaatgcagatggtggagagcctgctgcaacgtgcaccgcagcgcttcgccatcacggtcattggccgcgagccgcacggcaattacaaccgtgtgctgctctcgccggtgctggcgggtgaaacgccgttcagtgaaacgctgatccacgatcgcgactggtatgagcggcacggcgtcacgctgctatccggcgaaaccgtgctgcaggtcgatctgtcggcacgtacagtgcagaccgattatcgccagctgggctgggatcggctggtgtttgccaccggttcacagccccgtttgcccgccattcccggcatcaacgcggattgcgtactgggttttcgcagtatcgccgacgtccggcaactcctggcgtgccagggaccggtggtggtgttgggcggtggttttctcggcattgaagcggcggcggcactctgtgcccgtgggcgtgaggttacgctggttcatcacaaaccctggctgctggatcgccagctggatgcaaaggcgggcgagctgttgctgacggcactccagcagcgcggtatccgctgcgtgctgaacagcggactcacggcgattgacgaggcgggtgtgacgctgaccagcggtcgtcactgcgccgccacgcaggtggtgattgccatcggcgttcagccggagataacgctggcgcaggcagcgggtctgccgtgtcagcgcggcattctggtcgatgggcagttacgcacagcggtcccgtcggtgtacgccgtaggcgagtgctgcgaaattgccggcgaaacctttggcctggtcgcaccctgcctgacgcaggcgcagattctggccgcacagctggcggggtcgccactggcggattttgtcagccagccgcaggcgacgcggctcaaagtcagtggcatttcgctgttcagcgccggggatgtcagtgaggcaccctccatcagcagttttgatccgatctccggcgactaccgccgtctgtttcttcgtcagggccgcctctgtggcgtattgctctctggcgacacccggcagggtcccgcgctgctggcgcgtctgctgcacaccgaagctgtcacgctcgaagccctgttcgattcccgtcaacctgaaccgcagccgcaggctgcagagagtcctgagatgagtaaaccggtattagccgtggtgggtcacggcatggtcagtcaccactttcttgaacagctggttgcccgcgaactgcatcagcactaccacatcgtggtttacggcgaggagcgtcagcaggcttacgatcgggtgcatctgtcggactatttcaacggcaaaacggccgacgatctgtcgctggtcagcgcggacttttttaccctgcacggcatcgaactgcgcagcggctgcgcagtcgtagcgatcgatcgtcagcagcgcagtctgcgtgacagcgcgggcaatgagctggcgtgggataagctggtgctggctaccggctcgcgtgcttttgtaccgccggtaccgggccacgacgacgaaacgctgctttgtctaccgcacgctggatgaccttgatgccattgctgcctgcgcccgcaatagccagcgcggcatcgtgattggcggcggcctgctgggtctggaggcggcgaatgcgctgcagcagctcgggctggaaacgcatgtggtggagtttgcgccacgcctgatggcagtgcagctcgatgagggcggggcgctgatgctgcgccagaagatcgatgcgctgggcgtcacggttcacacctcaaaacagaccgaactgattgagcgtcagaccgacggtagcgtggtgctgcgctttgctgacggcagcagtttacccggcgatctggtgctgttctccgccggtatccggccgcgcgatgagctggcacgtgaagcgggcctgacgctgggaccgcgcggcggcattgagattaacgatcgctgccagaccagcgatgaagaggtgtttgccattggtgaatgcgcattgtggaacggtcagatcttcggtctggtcgcgccaggctatcagatggcacgcgtgctggccgggcatctggcggctgaatccaccgccttcagcggcgcggacatgagtaccagactgaaactgctgggggtggaggtggcgtcgtttggtgacgcgcatggccgcacgccgggcagtcagcactatcactggaccgacgggccaaaaggcatctacaagaaaatcgtggtttctgccgacagcacccggctgctgggcggcgtgctggtcggtgacagcagcgactacgccacgctgctgcagatgatgctcaatgagttaccgctgcctgccgcgccagaaagccttatcctgcctgcgctgtcgggggcgccgaaagcgccaggcgtcgcggcgttgcctgacagcgcccaggtctgctcctgtcacaacgtcagcaagggcgaaatctgcgcggcggtgaaaggcggatgcggtgagatgagcagcatcaaaagctgcaccaaagcggctacgggctgcggcggctgtgcggcactggtaaaacaggtgatggagtttgagctggaaaacctcggtgtcgaggtaaaaaaagatatctgtgaacatttcagctattcgcgccaggaactttatcacctggtgcgggccggtgagttcagaacctttgatgcgctgctgacgtcacatggtcgggggcagggttgtgaagtgtgcaaaccgctggtggcgtcactgctcgcctcatgctggaacgactatctgctaaaaccggcgcatctgccgttgcaggacaccaacgaccgctatttcgccaatatccagaaagatggcacctattcggtggtgccgcgcgtcccggcgggcgaaatcacgccgcaggggttgatcgcgattggcgaggtggcggcgcgttacgatctttacaccaaaatcaccggcggtcagcgtatcgacctgtttggcgcgcggctcgatcaactgcctgatatctggcagacgctactggcggcgggttttgaaaccggtcacgcctacggcaagtcgctgcgcactgtgaagtcctgtgtggggtcgacctggtgccgctacggcgtgcaggattcaaccgctttcgccattgcgctggagaaccgctacaaggggctgcgcgccccacacaagatcaagatggcggtatcgggctgtacccgcgaatgtgcggaagcgcagagcaaagatatcggggtgatcgccacggaaaagggctggaatctctatgtgtgtggcaatggcggcatgaagccgcgccacgccgacctgttcgccagcgatctcgatgatgccacgctgctgcgttatgtcgaccgcctgctgatgttctatatccgcaccgcagacaggctgcagcgcaccagcgtctggatggacaatctggaaggcggcctggactatctgcgtcaggtggtgattgaggatagcctcggtctgggcgagacgctggagcaggagatgcagcgggtggtggacgcgtatcagtgcgagtggcagaccacgctggcggatccttcacgacttgcgctgtttacccctacggtcaacagcgatcgcccggatgagacgctgcactacagccgggtgcgcggtcagcgtcagccggaggccgttaccgatcgtccgctgttaccgccgccagccgagccgtggagcgcggtgtgtacactggaggcgattcctcagcaggcggggatcggggcgcgactgggtagcgaacgtgttgcgctgttccgctttggcgatgcgctttttgcgctggaagaccgcgaacccggcagcgacgccagcgtgctctcacgtgggatccttggcgatgtgggcggcgagccggtggtgatctccccgctctataagcagcggatacggttgcgtgacggacagagcctggataacccgcagcatcagctgcgctgctggccggtgaagttggaagcgggtcagatctggctggcaaatcgtccgctggatcagctggcgcaggcatcatgaacagtacctgtccctattgcggcgtcggctgtggcgtctgcgtcaccccgcagggggcgcatcaggcaaccgtgatcggcgatccgcaccatcccgcgaatgcaggtcggttgtgcgtaaaaggcgcagcgctgggccagaccctgacgccgcaagggcgtttgctgaacgccgaggttaacgggcagcgcgtcagcctggacgctgcgctggatgcggcggcggcgggattgcgggcggttatcgatcagtatggcccgcaggcggtggcgttttacggctccggccagctgttgaccgaggattactacgtcgccaataagctgatgaagggctacatcggtgcagccaacatcgatacgaattcgcggctctgcatggcgtcggcggtggtcggttataagcgggcgctgggggccgatgcggtgccctgctgctatgaggatctggagcaggccgacctggtgctactggtggggtctaatgctgcctgggcgcatccggtggtgtggcagcggctgatgcaggcgaagctgcaacgtccggcgatgtgtattgtcgttatcgatccgcggcgtacggcgagttgcgatcaggccgatctccacctgccgttgcggcccggcagcgatacggcgttgttttccggtctgctgcactggctggcgcagcaggatggcattgatgccagcatgttgccgcacctgaatggtgtggacgagacgctgaccgccgcagcgcagtggggtgtggcgcgagtggcagaggcatgtgacttaaccgtgcagcaggtcgcgcactttttccagcttttcagccagcacgatcgggtgctgacgctatggtgcatggggattaatcagtccgccaccggcagcgacaataaccaagcgattcttaatctgcatctgctgacgggcaaaataggccgcgcgggctgtggtcctttttcgctgaccggacagccaaatgccatgggcggacgggaggtgggtggcctggcgaatcagctggcggcgcatatgaattttactgaagcggattgcgaacgggtgcagcgtttctggcgcagtccggccattgcccgggaaccgggactgactgcactggatcttttccgggcactggcggatggcacggtgaaagcagtgtggattatgggcaccaatccggcggtgtcgatgcctgagggcaaccgcgtcgcgcaggcgctggcggcctgtccgctggtgattgtatcagatgtgatggcgcagaccgataccagcgcctttgccaatattctgctgcccgcccaggggtggggcgagaagaacggcacggtgaccaattccgagcggcgtatttcacgtcagcgcgcttttgccgccgcacccggtgacgcccggcctgactggtggttgctgtcgcaggtggccaggcgtttagggtttgatgaaggctttaactggcagcatccggcagagattttccgtgagcatgcggcgttgtcaggtttcgagaaccggggcgccagggcgtttgatatcagcggcctggcgcaattgagtaatgctgactgggatgcgctgcgtccggtgcagtggccggttaacgcggcctgtccgcagggctgcgcccggctgtttggcaatcgtcggttttttcatccggatggtaaggcccggttgcgggtgccggccacgccggttgtcgccccgcgcgaaccggcgtatccgttgttgatgaataccggacgggtgcgcgatcagtggcacaccatgacgcgtaccgggctggtgccgcgtctgatgcagcattgcgatgaaccgtttgtcgcgctgcatccggcggatgcggcaacgtatggcgtgacggcgggcggactggcgcgggtgcagtctgttcagggctggattagcgtgcgggtgcgtgtcgatgccgggatgcggcgcggcgagctgtttgtgccgatgcactggaaccggcagttcagtcagcagagtcacgtcgatttactggtggccgcccgcgcctgtccgttttcggggcagcccgcgctgaagcagacgtcggtgcggattctgccgttgagggtgagctggcagggctggctatggcagcgcgagatagcgcagcccacagggttgcgttactgggcgcgtaccccctatccggcggtgcagcgttatgcggtggcgggcgagggctcgccgcaggtctggctggacgggcaggttgttctttcaggctgtcacaggcaggttgcgaccggcagcggcaatgattaccggttgctggcatggcgtgacggcgagttgcagctggcgttttatgccggctccgtgttgccgtcgattgatagtgcgtgggtcgccgaggcctttagtcatgcgccgcaggatgcggcagggcggcacagtgtactggcaggacagcccgcgcagggcgcggccacgggacggattatttgcagttgtagggcggtgggtgagcagacgattttacaggcggtggcgcaggggtgtcgtacaactcaggcgttgggcgaaaagctaaagtgcggcacgcagtgcggctcctgtattccggagctgaagcagttgttgctgtccgaagtgatgtcggaggaatgatgacacgagcaattgattctctggataagttactggccccggtggatgccgtgtcgcaacagggcgcggtgtggctggtgggtgcgggccctggcgatgtggaactgctgaccgttaaggcgttgcggttgctgcagcgtgctgaggtggtggtatatgaccggctggtgagtgacgcggtgatggcggaggtgccggagcaggcgttgtgtattgatgtgggtaagcagccggggcagcatggtctgaagcaggcgcagattaatcagttgctggtggaactggcgcgcagtggacgcaatgtaatccggctgaaggggggcgatccgtttgtttttggtcgcggaggcgaggagatggtgagcgtgcagcaggccgggattcgctgtgaggtcgtgccagggattacggcggctgtgggctgtgcggcagccagcggaattccgttgacgcatcgggattgcgcgcagtctttgcggttgattaccgggcatgggcggaacggcgagccgcagctggaggcggctgcgctgacggcggtgaatcagacgctggtgttttatatggggttgagctggagtgcgtcgatcagtgcgcagttgcaggcgcagggacgtgatgcggagatgccggtggcgattattgagaatgggacccggcccgatcagcgggtgttgattaccacgctggggggattagcggagacggtggcgcgggataagccggtgtctccgtcgttgctgatggtgggtgaagtggtgcggttttatcgggcggatttgcaggtgcggggtggggagacggtgagccggtgcgtcgtgcaggaaagacctgcctgatcgcaaagggatcccgcatccctgcggactgagctcgccatccctggctcgcacactttgctcttcaggcagggcttacctgcactgttggcattggtgcggggttttgcgggatcaggtctggattgagtgggcgtatgtcttggtggtaaggccggaacggtgcggcaagacggtgcggcaagacggtgcggcgtgcaggaaaggcctgcctgatcgcaaagggatcacgcatccctgcagactgggctcgccatccctggctcgcacactttgctcttcaggcaggcccttcctgcccggctggcggcggtgcggttttttttgggatcagatctggattgagtgcggttgatgagagtggaagtgcccgagcaggacgaaaagagcagtccagtgtgggaaggcaggtgagggttggtaagacggtgcgtcgtgcaggaaaggcctgcctgatcgcaaagggatcccgcatccctgcggactgggctcgccatccctggctcgcacactttgctcttcaggcaggccttacctgcacgattagcgatagtgcgtgcttacagtggaggcaccatcgtgcaggtgcactgtataaaagacgatggagctttagctggctttaaagctcctcccacacaggcaggttgtgaaccttttttcgatatgcgtgaaacagtgccattgtcgtaccgaagaacagacctgcgatcagattgggtatcagcgaatagttgtcgtcagacacgcccggaagagaaggcaataagagcagcagtggcatcataagcgtgtacatgctggcaaacaccacaagattgagccagaaaggagtgaaactcgggggtggaagatggatattcattttccataacaaacgatgtaatggcggagcagagtgactcggccatattttcttcgctgccatcagggctaaagcccgcgctttcctgcgctcgaaaatctcgtttttcatcgttttatcatccgttacatccctgcttagcattcgctctggagcgtaacttaatcctgtggctgtctgatgacaacgagtggctgaatcgatgttgtttcaacaagcattacatcgcccgcttcagcggcagcggggccactagcactttcacgcctagtgcttcaaacgctttgacctgcgcagtgctgatgccgctgtcggtgatcaggtagtgaatattgctccagtcacagggcagcgcgaacatcgaaaccttgtcgattttgctggagtcagcgaccacgtaaaccgtgctggcggatttgatcatcgccagctttaccttaatgtcggtttcactggggaagctcaggcccagacgtggcgagatgcaggcggtcgccaggaagagtttaccggccagcacgttttcgaagaagctggccgccttttcgccggaggtagagagcgtcggaaatttaaaggtaccgccggtcagcaggatgttgatccccggctcgccgcccagtttcagggcgatattcaccgcggttgtcacgaccgacaggcggcggatgtggctgatggcatcggtgatcgcggtggtcgtggtgccggaatcgaaaatcaccgtgtcgccattttcgatatgctgcgccgccagccggccaatcgcctctttctcttccagatgcgtctgccgctccagcagcatcgccccggtattctgtttgcccgtcatcagcgtcgcgccaccatggtagcgctgcacaaagccctgtttttgcagcatgcgaaggtcgctgcgtaaggtggcttcggtcagtccaaaggtctccgtcaaagctttaaccgtgaccgtgccatcctcacggatcatctccagaattttctcgcggcgttgctgcatgtcagcgaactgctcacttttgcttttcaatcgaaatgctcccttttccaataacctgagaagtcgggcgaacaaggtctttgtggctgagtttaacgcgccatttttatgaatgcgagatagcctgatctgcctttggttttcgaacgaaaatataaaatgtgcaggttattgaatctctcacgctttccggattacaaccagctgcctttatttcgggactggaagccagatcacgtcttttcaatcagataagccgctttgcagggcagatggtcgaaatttgatctgctccacacaacatttcttttcgatagcttatatttttgttcgaaaatgagtgagtcaacggcatcggcaaaaatctgaggggaagagtgggatgagtggtgaatatgacgtaaacctgcgctacggcgtggataccgcaatgaatctggctggcaaagtggccgtcgtaaccggcgggctgggcggtatcgcgatggcgaccaatggcatgttgctggagaagggagcgagtctggcactactctatccgccgtttgaagcagagaaggtggccagcctgagggcagatttccccgtcgagcgggtgcagtttgtctgctgtgacgttaccgatcctgcgtcggttgaacaggcttttgacgatgtggtttcccactatggccggatcgatatcctggtgaaaactgcgcaggctacgtgatgctgcagccggtgatcgaaaccgattttgacgagtggcagaagcagattgcggtgaatctcaccgggccttttctctgctcacaggccgccgcacggctgatgatccgtgccggtgcgggcggcaaaattattaatatcgcctcccaggcggcatccatcgctatcgacaaccatgtcgcctatacctcagccaaagcgggcctgctgggcatgaccaaagtgatggccaaagagtttgccccgcatcgcattaacgttaacaccctgtcgcccaccgtggtgctgacgccgatgggcgaaaaggcctggcgcggcgagaagggcgagcagatgaagaagctgattccgctcggacgctttgcctataccgatgagatcgccgctgcggtgctgtttttcgccagcaacggcagcgacatgatcactggcgccgatttgatgatcgatgggggctttaccatctggtaaggccaatccagcacccgggaattcataccctgccataacgataagagagaacatcatgaaaaaccgtaccttgctgtgcactgccgtggctgcctgtctggtttcgcaggcggcgtttgccgccgaaaagggcaccattatgattctggttaactcactcgataatccctactacgcctccgaagccaaaggcgccaatctcaaagcgcaggagctgggttacaaaacgacagtgctgtcgcacggcgaagatgtgaaaaagcagagcgaactgatcgacgccgctatcggtaaaaaagtgcagggtatcgtgctggataacgccgactccaccgccagcgtggcggcgattaaaaaagccaaagatgccgggatcccggtggtgctgatcaaccgcgaaatcccggtggatgacgtggcgctggcgcagatcacccacaacaacttccaggcgggttcagacgttgccaacgtctttgttgaaaagatgggcgaaaagggcaaatacgccgagctcgcctgtaacctggcggataacaactgcgtgacacgctcgaaatcgttccatcaggtgctggatcagtatcctgatatgcagagcgtggcacgtcaggatgccaaaggcacgctgatcgacggcaagcgcattatggacagcatcctgcaggcgcatccggatgtgaaaggggtgatctgcggtaacggcccggtggcgctgggcgccattgctgcgctgaaggcagccggtcgcaacgatgtcatcgtggtggggattgatggcagcaacgacgaacgcgatgcagtgaaagcgggcacgctgaaagccactgtcatgttgcaggcgcaggcgattgccgctgaaggggtgaccgatctcgataacttcattcagaagggcgtgaagccggaaaaacagcgggtgatgttccgcggcattctgattaccccggaaaacgctaaaggtgtacaggactttaactacaagtcgtaattaaacgctgtcgcgcctgcgaaagcgggcgccagggagaagatgatgtcccgaagagtctggctgacgctggtggtcttgctgttaagcggctgcaaaattgtgtcgcagcaggagctggctgccctgaaaaatccccccaatccgaaaatggcgaacatcgaccagctctggcagcagaaactggtgccacaggttcaggcagaggctaaaccgctggcgacgctgatgaagtcgctgcagtctgctaaagacttcgacagtgcctgtcagagctacggctatcgcagtcaggctgagaatccctgtgtcttcagcgtctcggttagcggcgaggtgaccgccgtaaataccacgtcacgcagtggaaagatgaccgtgaaagatgaatcaggtgacagtgtcacaattcaggtcgggccaatcattcgtggcaccgctttgcgggatgtctacaaaggcgtgagctatcaggacttcaatgaccaggtgctgtttggtgattacggcaaggcgattaaccagcacgcctccactctgatgcagcagtttgcgccgaaggtgggcgataaagtgagggtttccggcgtgttcagcagctgggacattccgcagcagctgccggatatcactccggctgcgatcaaccggcaataaggagcggcagatgcaaaatcctcaaccgcaacagtccggcgacgtgattatcgaaacgcgcaacgtgtcgcgtctttatcccggcgtgaccgcgctcgatcaggtcagttatcgggtctaccgcaataaagttaacgtgctgatcggtgagaacggcgccggtaagtccaccatgatgaagatgctggcgggtgtagagacgccgtcgtcgggcgagattctgctggatggcaaggtggtgtcgctgaactccacgcatcaggcagagaagcaggggatcagcatcatttttcaggagctgaatctgtttcccaacatgaacgtgatggacaacatctttatcgccaatgagtatttccagcgcggggtgatcaatgaaaagtatcagtacgcgctggcaaagtcgctgctggagcggctgcagctggatgtcgatccttacgcgccgctgggtgagctgggtattggccatcagcagctggtggagatcgcccgggcgctgtcgaaggatacccgggtgctgatcatggatgaaccgaccagcgccctgagccagtctgaagtgaaagtgctgtttaacgtcatcgatcagcttaagcgacgcggtgtcaccattatctacatctctcaccggctggaagagctgatggagattggcgatcacatcaccattttccgcgatggccgttttatcagtgagcgcgaggtacgggacgccagcgtgccgtggattatcgcccagatggtgggtgacaagaaaaagcagttcgactatcagcctgcgacacagggggaaacggtgctggaggtagagggcctgaccgcgctgcatcagaaacggcggttacaagctgaatgaggtcagctttacgctgcgcaaaggcgaggtgatcggcatttatggcctgctgggggccggacgcaccgagctgttcaaggggctgattggcctgatgccctgtcagtcgggccgggtacgtttagcgggcagggatctggcgaaacgcagcttccagcagcggctgaaaagtggcatagcgctggtgcccgaagatcgcaaaggcgaaggggtgattgaactgatgtcggtcaccgccaacatgacgctctctgacttcagcctgcgcggttttcgacgtgcgctggggctgttaaatcctgccagggagcagcagcgggtcagtgagatgatcggccatctggcgattaaagtcagcgatcccgacctgccggttacggcgctgagcggcggtaatcagcagaaggtggtgctgggtaaagcgctgatgaccgggccgcaggtggtgctgctggatgagccaacgcgcggtatcgacgtgggtgccaaaaccgacgtctatcacctgattggcagtctggcacagcaggggctggcagtgatgttctcctcgtctgaactggatgaggtgatggcgctggcggaccgcattttagtgatggccgatggccggattactgccgatctgccgcgcgcagcggcgacgcgagaacatctgattgcggcatcaaccccgcaggattaagagcctgacccatcaggctattttatttgtccgtctgaacctgggcagtggtcacacaggctgctttagcaacctgaacgcccgtcagggcggccctgaaggggcgagcacagcgagtaatcctcacgtactgcgtgtacgtgccggttgttccgcgctgtccgtgtccagactgcctgaaaccattacgctggcgggccagactctaagctggccggagaatttcatgaaccaaaaatatctgctctatatgtacctgctcaaggcccgcacctttattgcgttgttgattgtggtcggctttttcagcgtgatggtgccgaactttctcaccccctctaacctgctgatcatgacgcagcacgtggcgattaccggcctgctggccattggtatgacgctggtgatcctgaccggcggtatcgatctctcggtgggcgcggtcgccgggatctgcggcatggtggcgggcgcactgctcaccaatggcatcccgttgtggggcggcaatacgctgtttctcaacgtgcctgaagtgattctggtggtggccatctttggcgtgctggtggggctgattaacggcacggtgatcacccgactgggcgtcgcaccctttatctgcaccctgggcatgatgtatgtggcgcgcggtgcggcgttgctgttcaacgacggcggcacctacgctaacctggtgggagtgcccgcgctgggcaacaccggcttttcgctgctcggctccggcaccgtactgggcgtttatctgccaatctggctgatgctcggctttttactgctcggcctctacctgacgcgcaaaaccccgctgggtcgttacatctacgccattggcggcaatgagtccgccgcgcgactggcgggtgtgccgattatcaaggtgaaagtctttgtctacgccttttccggcctatgcgcggggcttgtcgggctggtggtggcctctcagttgcagactgcgcacccgatgaccggcaacatgtttgagatggatgccattggtgccaccgtgctgggcggcacggcgctggcaggtggacgtggccgggtttccggctcgattattggcgctttcgttatcgtcttcctggcggatggcatggtgatgatgggcgtcagcgatttctggcagatggtgatcaaaggtctggtgattgtgactgcggtagtcatcgaccagttccagcaacgtctgcaaagcaaagtggtgctgctgcgtcgccatgaaaaaaagcagcaggcagccccccttactgatattcgtcacagttaacaggagcgattatgagccgcgaacaacgtggaaaaacagtggtgataaccggtgcctgtcgtggcatcggggccgggatcgcggcgcgtttcgcccgcgacggggccaggctggtgatggtgtcgaatgctgaccgggtgttcgctacagccgaccagcttcagcagcagtatggcagtgagattctggcgctgcaggtcgatatcacggatgaagctgcggttcagcagctctatcagcaggcctttgaacgctttggtcagatcgacgtctcgatacagaatgcgggtgtgatcaccatcgaccgcttcgacaccatgccgaaaagcgactttgagcggattctggcggttaacaccaccggcgtctggctttgctgccgtgaagcggcgaaatatatggtgcagcagcgcagtggcagcctgatcaacacctcatcggggcagggacgacagggctttatttacacgccgcactacgccgccagcaaaatgggggtgataggcattacccagagtctggcgctggaaactggcgccgtggaacattacggtcaacgctttttgccctggcatcattgagagtgagatgtgggactacaacgatcgcgtctggggcgagatcctcagcagcgaggagaaaacctacggtaaaggggagctgatggcggagtgggtgaaaaacattccgctgaagcgtgccggtcagccggaagatgtcgccggactggtggcgtttctggcatcagaggatgcgcgctacatcaccgggcagacaatcaatgtggatggcgggctgatcttctcctgatgcggtgagagatcgcaggcctgctgtaaacgcaggcctttttctgacccggacttttctgttatatgcacaattcgccgctgctgtcctgcatcgccgtcacaatatgttaaggtaatagctgatgatttttctttaattgcagctacgaactaatcaatgtgccgggtgacatgatacggaaaacaggggttctctctttgattgcgctgtcgctgactgccacgcagagcgcccgcgccttccagactgaaacagcggtgtcagagacgccattcgacaatcctgcgcgctacagtcagtcgctgccgacgctcggcggtgccagcgatcaggatgaagagtggagcaaaaagctggcggccgtggccaaaagtatcggtgaagcgagtaacaacagcgacagcaatgtcacgtttggtcagcaggcgggcgtctgggcgttcaatcatctgcgcgatgaagtggccgatcgggttgagagcgaagggcagtcactgctttccccttacggcaccgcgcagctggatctgaaagtcgacatgaacggaaactttaccggcaccggcggcgatctcttcagcgcactggccgacgaaaacagccggctcaccttcagccagcttggtctgcacgataccggcgatggcctggttggcaatgcaggactggggcaacgctgggatgccggtgactggctgctgggttacaacggctttgttgaccgcgtgttcagcagcggcctgcagcgcgcctctgtgggtacggaagcgtggagcgattcaatgcgcttctcggccaactactatcagccgctttccggctggaaaaatctgggcgattcgcagcagcagcgcatggcgcgcggctacgatattaccagccagagctatctgcccttttatcgtcagctgggcgtttcggtgagctatcagcaatatctgggtgagaatgtcgatctgtttaacagcggcaaccgctatcacaatccctccgccatgtcgtttggcctctcttacactcccgtgccgctggtgacgctgtccgctacccataaaaccagcagcgccggtgagagtcaggatcagctggggctgaaactcaactatcgctttggcgtggcgctgcgacgtcagctcgatgccggaaacgttgcggaggcgcactccctgcgcggcagccgttacgataccgtcacccgcagtgatacgccggtgctcgctttccgtcagcgcaaaacgctgtccgtgtttctggccacaccgccctggcagttaagcagtggcgagagtctgccgctgaagctgcaggtgcgcgccagcaatgctatcaaggcggtaagctggcagggcgatacgcaggcgctgagcctgacacctccggccaataacgccgatccgcagggctggagtgtgatcttaccgcagtgggatccgtcgccagacgccagcaacgaatatcgcctgtcggtaacactggaggatagcaagcagcagcgtgtgacctctaactggatcaccctgaaaattcagccaccgatgaccgtggacgaggccccgcagaacgatcgttatgatttgatggcacccggcggcaccacactttagttgggatgctttactgcacagaaaggataggggggagttaatagcggtggtggtgtgcagacggcgttgttaacgtctgcaggcccgacagcggttactggcagagataagttgtcgggatgacgaaggcgcggcagagtgacatcactattgatcctgaaatgagagcgggaaccactgggtgaaagcaggaacgacgctgcgcagcgggcagggtatttatattaagaaggcgcgggcagcgccgccgtttagcacagcggcccggttatcagttaaccatgctcatcacaatacgcaccgctctggcgtagacctctcgctgaccgtttaccgaccgtgcctgctgatgctgcaggaatgcaattatgtcctgtaagcctgccgtcttgcctgacttcagcaggctcgacacggcctgccctacaacggcatggacgtcagccatatctgccggtttatcggtactcaattgaaactccagcgcaaccgtttctgttgaatagcacctgaagaggtaacactcaggcgattcagctttatcagcctggtcacaggttttttataagccagcatcatggcagggccttaagcagcttttcacgcagcgttgccacctgggttgtcagctcaccgagttcactacaggcggtatccatcaccgagatcatatcagccgggacgtcagccgccgcgactttaagctggtggccctgttctgtcagggagatcagcacccggcgctcatcatttcccgtgtcacgctggcggcagataatgcccgcgctttcaagccgcttcagaagctggctgagcgtgccggaatcaagccggacgcgtgcaccaatatcagagacggtcaggcgatctttctcccacagcaccagcagcaccagatattgcggataggtgagtcccagcggttttaaccgcgactgatagagctttgtcatggcaagtgaggcggaatagagcgcaaagcagagaaactggtcgatagtttcaggcgctgcactggcgggaggcgtatcggagatccccgcgggttcgtcattcatatctttactcattctgagtccggggtgggacagccagaccccaggctgttggtcagccgtgaagtctcgcgaatagtatctcggggagatgttgatttcggcagcatctctttctggtgtaagacaccagacttttaagcgctatcgcagcgggagaaaaagcctttagctgcgtcgccgattgaaagtcggcacagtattgagtcaaattaaattgaagtcaacataaccggtcgcaacccttgcgcacaacgtgcgccgggtgcaacgcagctaagatcggcaggacaatttcagcatttaacccaggctgaagccgcccgccgatacggcttatacggtgaaggtctctaccatgccgcgcaggtcgcgcgcctgggccagcagtgactgcgatgcagaagaggactcttccaccagcgcggcgttattctgcgtgacgccatccatctgactcaccgcaatactgacctgggagatgccctgcatctgttcaccggaggagagggagaggttgtccatagcatcggccagttcaccgacgcggctgacaatcttcaggatgcgctcacccgttccggccgctacggttacgccatcctcgacctgcgtcacggcctgctcaatcagctgcttgatgtcgcgtgctgcggtggcgctgcgctgggccagcgagcggacttcacccgcgaccacggcaaatccgcggccctcttcaccggcgcgcgcggcttctacggcggcgttgagcgccagaatattggtctggaaagcgatgccttcaatcaccgacgtaatatcgcgtacccgaacggcactcagcgaaatgtcatgcatggtttctgacaggcgctggacatctgcttcgcccgcctgggccagggtggcggcctcgcgcgctgaaccggcagtctgctgcgcgcccgcggcgttgctttttaccgtcgcggtgagctgctccatgctggcggccgtttcctgcaacgcagcagcctgctgctcggtacgggatgaaagctcggtattgccctgcgaaatctcatcggccgccagcgccaccgaggcggatgcccctttgatctgcgtaaccagttcgcgcaggttggtctgcatgccgctgagcgacgcaagcaggctggtgctgtcgccacggcgcagcgtgaccggcgaggtgagatcaccggcggcaatcgcagcagccagcgtctgagcctgcaccggttcgccgcccagctggcgcatcagtatccgcacaataaacgcgcaggtgacgacggcagccagcacggagagcaccgccaggatgatcagtatccaggtggtgcgggcgatagcgatgccgttatccactaccgcatcccggctgctgcgcatctcaagctccgtcagatcgtttatcgccttcagcaggctttgctgagccggacgcgccacctttaacagatagtcggtgacctcctgctgacgattttccatccccagtttcccggcggtcatcagcgtggagagagcggcctcttcagtggactcgattctgctcatcgcctcccgtcctgcctgtccggggtcggtctgcatcatgcctgagagtacttcgcggttgctgatataaagcgcgcgctgtttttgcagacgttcccattctggcttcatggcaacgggatcggtcagcagagcaaggttacgcaccgcgattgccatatcccgcacgccaccgcgcatatccagcaccgtctggtactttttcaaacggacattaaccacctcgtccataccatcgcgagcgctatccagcgcgtgaatcgcggtgccggtacagataataaacagcagaataagcaagccaaaacctgcgctaaggcgcgttgaaattttcatctctcgttccgaaagagttcattgggtaaaccggtatcggcaggagagagaacttctggagagttacgtttaactaaattgttcgctatttaatttaacgaaattaaaaattgcacgtatacccaccccgttatgccacaaaaatcgtaacgggagtgataacgaaattccggccaatatcctgataaatcgctttttatcgcctgacgagtgtgcgccttttcgcgcggtgcagccgcgcgatacgccagcgtcataacccgtcaaaaacaccggaatgcacaaatttaaccgggcgggcctgttaatctggctgctgctgccgatagaacactattcgacattgatgacgtaaccgacacgcatcgggctccgcagaacgtctgcctcactgccgtaaggcgagtgagaacgtgcgaatgcgatgagtaaaaatagcggaggggtgataattgtcggcagcttagcagacattgtatgagaagtacgccccggttttttactgaaaattaaaacaaaactctgacactttccatcaccgggaactaacgcatgcgcctgaaacttttctggctcgcaatgctgaatattgcgaccatcattttactctccacgctgtgggaattcgggctcgaggcgtggatctccagcctgctgggcctgagctatgatcccgattttgaaaccagtgagcggctgcggtttatcctgacctccacctcgtttgccggactggcaatgattattccggcgctgcttattgcgggtctgatccgcaacacgctgcgtgcggaaaaaaacgcgctcaggctggccggaactgatgcgctgacgggggtcatgaaccgccgatcgttcacagcacacattgcttcgcttgatgccgacgggacgccctacaccctgacgctgctcgacattaatgactttaagaatatcaatgacctgaacggtcatcgtcagggcgacgccacgctggtcgcgctggccaatctgctgatcgcttcggcgggtaccgggagtcaggtgtttcgcatcggcggggatgaatttgccattgttgcccaggcttcacaggcagatcaggcgctggccgccgccgaaagcttctgccagcatgcggcatccatccggaccggtccgcacaccttcctgagcctttcagcaggcatcgccagctcatcctgcacgggtcaggctgatgtcgtgcgggcggcggatctggcgttgtacgaggccaagcaggataagtgcgcctgtctggcacgattctctccggacatggagctgcgctttcgccagcgggaaaggctggagcaggaggttgttgccgctataagcggtcacgccatcgttccctttctgcagccgctggtttcactgcgcaccggtaacattaccggctttgagatactggcgcgctggatcactgcgtccggtcagacggtttcacctgcagagtttctgccagtggtggagcggctggggttgatggacagcatgaccgtggcgctgctgcaggatgctgtcagtgcaacccgggcatggccagccgggctctgcctgtcgctgaacattaccccggagcagttgctgagaccgtcgctgaccagctgtttgtccagcattatgcagcatgccgggccggtaatgctggaacttgaaatcaccgaacagaatgtcatggccatttctgacgatgcccgccaggcgatccgtctgctgaaagaggccggtatcggagtggtgctggatgattttggcaccggctactccaacctgtcggttttgctggggctgggtattaccaaaatcaaaattgaccagacgtttatcgccggaatcgtgaccggatctgagcagcgaaaagtggtggaaacactgctggccctctgtcaggggcttaatgtgatcattactgcagagggcattgaggatgtcgccacgctgaggtggctgagaaagcgcggctgtgattatggtcagggatatctcttcagccgtccggtacctgccgggcaggccaccacgttgctggcgtctgctaacgtggaggaattgatgcaggaagaggcgatggccgttagcttagtcaggtcgctgggctgaaagcgcgcaacactctctgtggccgggattaaaacaataaacgggcccggcggtcagagccgggcccgctgtcacatcagaactggtaaatcagacccagggctgtgatgtcgtcggtcgccaggcgaagcggattgttatctttcaacaggttgatgcgatattcaccatagaccgacatgttcttgttgaagtagtaagtggcacccactgcggtgtatttaatgatgtcggcatcgccgatattctcaatttccttgcctttggatgagacgtaacccacggacggacggaagccgttcaggaactgatactgcgccacggcttcaaagttctgcgctttgttagcgaaaccgccagtaattggcgtggcgttcagcgtttcaccgtacatggcagccagatagacctggttcgcatcatatttcaccgaggtcgcccagtgctgggctttttcgccttctccgcgtgcggcagcgttctgcgccgtggtgcgatccaggctggcaaacgcgccggcaaaactcaggccgaaatcgaagtcataggaagcggagagggcgaagccgtcgccgttggaacgacgcacgccgtcaatgttactgctgcgatcgtttttgccctgatactgcgcggcaaggtttaagccgtcaaccagaccaaagaaattgctgttacgccaggtcagcacaccggttgagcggccagaaagaaaggcgtcggtataaccggagtcgccgccgaagaacggcagcatatcggtataactcagcacgtcatagaccaggccgtagttacgtccgtaatccagcgaacctgcctcgccaaacttcaggccagcatagcccagacgggtacgattggtggcctgggcgtcactgccctcggagttatgcagactgtactgatactgccagaaaccgtagccggtaagctggtcagtaatcttggtctcgcctttaaagccaaaacgggcataagaggaggtatcaccatcgttgttgttatcgtcagaaaagaggtgtgacacgttaatcttgccgaccagatccagcttattgccatccttgttataaacttctgcggcctgcgcggaggagagaccgatcagtaacggcatgacagtcgccagtaaagtgcgcttcatcatttaattattaccctgtattcattaattattattcccctgatatggggtgaaaagaaaatgacacaaaaagataaaactacaaagtgcaataaaagtaacaaaatgtgatgtctatattcagctgatggataacagcgaggaacagaagattaaattgtaaagtaataagattttcttctaataagtaatcatgagttatctgattttatatctctatttatcaatggattatgtttgtatgtagtggtcttaaatgggctttttttgtacatttttaaatcaatataacccctgatttaattatgggtgattatccgctaagaatagccttataaggcttttatcctaaccattagtctgcgtattaatatttgttcatctttatagaatattctttctggcccgataatcacctccggaataatagtcagagttgctgattaaatattgatcagcctgtttataaaatagcctggaaaagatacgcggattaatgtgtctgcaggggaaatgaaaaaatttgttaaataaagccagggtgttctaacattttcgggcgagttccccgcgtaatcgctgcaccagcgcgaggcaaactgcgctaaaacagggcagtggaggggcttttctggagagataatttatcagcgatcacaaaagcgatatttcatcccgtgaatgcataattctgctgtttaaaacccggttctggcgctgcaatcagacaactattcactatatatgcaaattaagtgaatattgtcagcatctaactcattgatattacgtcgtgaagaccattttatgcattaattctctggctggcacgttaactgcactctacagtagggctgcattacaacatcttttaacaattttaaaacataagctttacccggccggtaaagtaaagcaggagagtgggttatggcactgcacgtttcacgtcacgatttcgatcaatggatgatgccggtttatgcgcctgcgacttttataccggttcgcgcggaaggctccaccgtctgggatcaaaacggcaaagattatatcgacttcgccggtggcatcgccgtcaatgcgttagggcatgcgcatccggcattacaacaggcgctgcaggaacaggccgcacgtttatggcataccggtaatggctacaccaacgaaccgatcctgcggctggcgaagcagttgatcgatgccaccttcgctgaccgggtgttcttctgtaactccggggcggaggcgaacgaagcggcgctgaaactggcgcgcaaggtggcgcatgatcgtgtgggtccgcataaaagtggcatcgtggcgtttaagaatgcatttcatggccgcaccctgtttacggtaacagccggtggtcagcccgcttactcaaaagattttgcgccgctgccgccagagatccagcatgccccgtttaacgatctggcggcggcggctgaactgattaatgaccatacctgcgcagtcattgttgaaccgattcagggtgaaggtggcgtgctgcctgccgatccggcgtttctgcgtggattgcgtgagctctgtgataagcatcaggctttgctgatttttgatgaagtgcagagtggcgttggccgtaccggttcgctttatgcctacatgcattatggcgtcacgccggatgtgctcaccagcgccaaagcgctgggcggcggcttcccgattggtgcgatgctgacgcgcgaagatctggcgctggtgatgggcgttggcacccacggcaccacctatggcggcaatccgctggcgggcgcagtggcaggtaaagtcatggagctgatcaatcagcctgaactgatggcgggtgtaacagaacgtcaccagtggattgtggcggcactggatgagatcaaccagcgtctgcacctgttcaaagaagtgcgcggtcttggcctgctgattggcgcggtgctcagcgacgattttgctggtaaagccaaagcgatcaaccttgccgccgcggaaatgggcgtcatggtgctgattgcgggtgccaatgtggtgcgttttgccccggcgctgaatatcagcgagcaggaagtgaagctgggcatggcccgctttgccgaagtgtgtgaaagcctggtgcgagggtcaacatcatgatggtaatccgtccggttgaacgcgatgacttaagccagctgatggcgctggcgggcaaaaccggtggcgggctgacctcgttgccggttgatagcgcgacgcttcaggcgcgtatcgatcgatcgctgcagacctgggaggattctctgccacgtgccgaacagggctatgtctttgtgctggccgacagcgaagataaccgcgccgtcggtatctgcgccattgaggtggcggtgggtcttcaggatccctggtacaactttcgcgtcggtacccaggtgcacgcctcaaaagagctgaatgtttatgccgcgctgcctaccctgtcgctgagtaacgaccataccggcagcagtgagctctgcacgctgtttctcgatcccgattaccgtgatggcaaaaacggctatctgctgtcgaagtcacgcttcctgtttatggccagtttccgtgaacgtttcaccaaccgggtggtggccgagatgcgtggcgtcagcgatgagcagggccattcgccattctgggagagcgtcggcagccgcttcttctctatggaattcagcaaagcggacttccttagtggcaccggacagaaatcgtttatcgctgaactgatgccgaaacatccgctctacatcgactacctgacaccggaagcgcaggcggtgatcggacaggtgcatccgcaaaccgcgcctgcgcgggcggtgctggaagcagagggcttccgctacctcaattatgtcgacatttttgatggcggcccgacactggagtgcgacatcgatcatatccgcgccgtgcgtaaaagccggctgcgcagcgcagaaacggggcgaaaacccggctgatggcccgctctgtctggttgccaatagcgattatcgccagttccgtgtagcgctgattccggcaaaggctgacagcgacagcgtgcaactcacggatgaacagatgcgggcgctccattgccagccgggcgacagcctgcgcgtggtgacgctctgcaaagaggagaaaacagcatgacacatctgataaatggacaatggctggacggtgatgctgagattctgacgaaagcggatccggtcagcggcgagacgttatggcagggccacgcggcatcagccgctcaggtcaccgcagcctgtgaggcggcgcgcgacgcatttccagcctgggccagacgcccgctggcggaacggcaggcgatcgttgagaaatttgccgccgggcttgaggcgcataaaacggcgctggcggaaaccatcgcccgtgaaaccggcaagccgcgctgggaagcgctgaccgaagtgggcgcgatgatcaacaaaatcggcttttcggtgaaggcataccatagccgcactggtgaacagcatgaaggcgaaagctcgctgcgccaccgcccgcatggggtactggcggtgtttggtccctataacttcccgggacatctgccaaacggccatatcgttccggcgctgctggcgggcaactgcgtggtatttaaacccagcgaactgacgccgctgaccgccgaaaaaaccgttgagctctggctggctgcgggcctgcctgccggcgtgctgacactgttacagggcggacgtgagactggtcaggcgctggccaactgtcagcagattgatggcctgctatttaccggcagcgcccataccggctatcagctgcatcgccagtttgccggtcagcctgaaaagatgctggcgctggagatgggcggtaacaatgccctgattgttgaagatccggcggacactgatgcggctgtcaacatcacgttgcagtcagcctttattaccgccggtcagcgctgcacctgcgcgcggcgtctgctggtcaaacgcggcgatgcaggggatgcgtttctgcggcggctggtggaggtggcggggcgactgcaacccgccgcctggaatactgaaccgcagccgtttatgggcagcgtgatctccaccggcgcagcagagaaaattatgagtgagtggcaacggcgggttgaggcgggcggcgaggtgctgctggaaatgcgctggccggatcgccacagtgccatcctgacgccaggtattatcgatttaaccggcgtgcagggcattccggatgaagaggtctttggtccgctgttaggcattgtccgctatgagacatttgaagaggcgatagcgctggctaaccagacccgttatggcctgtcgtgtggattgatctcgccttcacgccagcagtttgatcagctgctgcttgaagcgcgtgccggtatcgtcaactggaacaaaccgctgaccggcgcagccagtaccgcaccgtttggcggcattggtgcctcgggcaaccatcgcgccagcgcctggtatgcggcggactactgcgcctggccgatggcctcgctggagacgcctgacctgacgctgcccgccacgctgtcgccgggcctcgatttctccacccaggagacgacgtcatgaaggcaaccgaggccaactttgatgggctggtggggttaacacaccactatgccgggctgtcgtttggcaacgaagcctcgacccgcaatcagctgcagccgtcgaatccccgtctggcggcaaagcaggggttgctcaagatgaaagcgctggccgatatgggctacgtgcagggggtgatcccgccgcatgagcggcccaatattgcggcgctgcgccagctcggctttggtggcagcgatgagcaggtgctggctgcggccgggaaaactgcgccgggattactctctgccgtcagttcagcctcggcgatgtgggtcgccaatgctgccacggtctcgccgtcagcggacagccttgatggccgggttcacctgacggtggcgaaccttaacaacaaattccaccgtgcgatagaagcgccggaaacggcctggctgctgcgttccatcttccgcgacgatcgccattttgcggtgcatgatgctttgccgcaggtggcgatgtttggcgatgaaggtgcggcgaaccataaccggctgggcggcgcttatggtgagcgcggcgtgcagctgtttgtctatggccgcgacagcagccatgagggcaaaaccccgcagcgttatccggcacgtcagacccgggaagccagcgaggcggtcgcccgtctgcatcagctctcaccggaaagcgtgctgtatgcgcagcagaatcctgcggtgatcgatcagggcgtgttccataacgatgtgattgcggtgagtaaccagcagatgctcttctgtcaccagcacgcctttgttaatcagcctgaactgctggcgcagcttcggtcgcgcgtccccgattttgtggcgctggaagtgccggaaaatcgggtgtcagtgaaagatgcggtagagacctatctgtttaacagtcagttgctgagccgtcccgacggcaccatgatgctggtgctgccggaggagtcacgtcagcatccgggtgtctggcgctacctgtgtgaacaggttgaggctgacacgccactcaaagccctgaaggtgtttgatctgcgcgaaagcatgtataacgggggtggtccagcctgcctgcgtttgcgggtggtgctgacaccacaggagcagcaggcagtgaatccggcggtgctgatgaatgatcggctcttcagcacgctgaataactgggttgaccgtcattaccgcgatcgcctgacccaggccgatctggtcgacccacaattgctgcgtgagggacgcgacgcgctggatgaactgacgaagctgctagacttaggaaatgtatatgcatttcagcagtgaaggagggggcagcacaggctgccgcctgctcagggcgaaaaggaggaacgatgcaggactttttacagcaaacgctctccggcgaggtgccgcgtaagcgtagtggtgaaacggcgcatcttcgctggcaatggttgtatcacggcatactgttgatggagccgacggtgccggttaaacaggcgctggtgctctctgccgggatccacggcaatgaaacggccccggtagaaatggtgaaccaactggttaatccgctgctgcggggcgaaaagccgttacagcagcgcatgctggtgattctgggtaatccctcagcgctacgcaccggtaagcgctatgtgcgttatgacattaaccggctgtttggcggacgctggcagcagattgatgatggtgatgaggcccgccgcgtgctgcggctggagcaggcgctggagaccttctggcagctgggcgagtgcgatgaaacgcgctggcatctcgacatgcacacggctattcgtggctcttatcatcctcagttcggcgtaatgccgcacaatgaacgcccctggccgcccgcgtttcttgactggctggccgctgccgggctggaagcgctggtgttccatcgctcgccgggcggcacctttacccacttcagctgcgagcacttcggtgcggccagctgtaccctggagctgggcaaagcgctgccgtttggcgaaaacgatctcagtcagttcagtgcggcacagcaggcgctggcgtctttactctatggcgaagcgctgcctgcggcggcggttagaccgcgtcactatcgggtcgcgcagcagatcacccgactgagtgagcactttacgctgcatatgtcgccggaaacgctgaactttaccgcgtttccacaggggacgttgctggcggaagatggtagcacccgctattacgtgcagcaggcgcgggaatatgtgctgttccctaaccccaacgtggccgccgggctgcgtgccggactgatgctgattgaagagagcgaacagacccaggcgctgccggtctgatagcggttgttaacagcgcagaccctcggcgctaaaaaaccgacaggaaaagtggaagatcggcttccgctttcctgtcgtaacccttacactcctccatgatttctgccaaattcgctttaaattcataaacattttcaattcctcacgcctttcttcttattctcttcatgattgcccgatttttatcttttatgctttcacggctttactcaggctctgagtagttgacgttcagcgtcgtatgcttgtttccgaagacgcgacagagtgctgtcgtcattatcatgaattataaggacactattatgcgcaaactgacttcccttttactggcttcctcgctggcgtttggtgcagccagcgccgtccatgcagccgctgacaacctgactccaccgccagcaggcagcgaaaaagcgatgcacaagccgccaatgcgccacggcatggagatgatgtttaaaggtctgaacctgaccgacgtgcagaaaactcagatgcgcgacatcatgaaagagagccacaaagatatgaaacgcccgtcactggacgagcgtcgtgcggcccacagcattattgcctctgacagcttcgaccagagcaaagcagaagcacaggcagagaagatgtccgccaatgccaaagagcatgcgctgaagatgctggaaacccagaacaagctctataacgtgctgacgccggagcagaaaaaacagtacaacgctaactttgaaaagcgtctgactgagaaaggcccgcacgagggcaaaatggcaccgccagcagaaccggctgaataacactcgttaagcgaacggtctgagaccgccggcgctgtccactgaaggtgagtgggcagcgtcggcggtttttttatagcggcagaatagggtaggcacctgacagaatcgggcggcagaggattttgtagccgtcgtgatcaaaaccgcctttgggccgctgcagttttctggcctcatccatgctgctgaccgaaaccgagatagaaccagtggtcgataacgtggatctgcgtcatctctttgccttcctccaccagccccacggcaccctgccacggccagcagaacacccgcacgttttccagcgcctccagcagtcgatcctgatgatcgctgaccggctcttttccacagcaggccccggcgcaacggcgcagtgccgagcggaagcagcctcgccccgcactcagcgcttccagacccagcaggccatgacagagctgatactcatccgcgagctgcttgagccgttccagcgcggcgaagcgactgcgatagagcccaaacaggttgggggactggctgaaatcgaggtcttttgcgtagaccacattcggtttgccgtcggtaatctgcaatgaacagagctgccggtttttgcgcaatcgcttattgaacagcggctgctgggttttgatcatctgcgcttccagcagcagcgcgccgaggtcacccgcggtagggatccagcttacacgccgcgactggcgcagcattttcgcctcatccggggtgcggaaatgggacatcacccgcgaacgcagattcacacttttaccgatatagagcggcagcgactcactttcgccatgaaaggtatagacgccaggatgatttggcaggccttccagccactcacgcaggtgttcgggatattgataaattgcattcgcgtcgggttcggggcgaagtatggcagaacgtctgaccaagatggactccatttactggttgtccatacagcataacaggcaggtgaaatgatcgccagccgtctggttacagagaccgtgttgcccgccagcagatcagcgagccgagcgtgatcatcgccacgccctgccagaaggccagcggcggcgtcaggccgagccacagtgatcccatcagggccgacagcaccggcgtaaagtaggaggcggtggccagcagcgtcagattgccctgctgaatcccgtgattccaggcggaataggcgatggcggtggagagcccgacaaacagcacctccagcagcggcaccagcgtaaaggccatcggcacagtgtgatcgctgaaggcatatttcagccacagcaccagtgcagtcaggataaaaaacagcgtgacgccattagaaccacgggcaaagcggcgggtgagattattgtagagcgcccaggtcagggcggcgataaaggccaatgcataggcgaccgggttgcgcagcatattctgccacaacagcgtcggcgatccgctgccgctgcctttcattacccagacgatccccagcagcgacagcagcagtcctggccacagccagacacggaaacgctgctgattaaacgggatcgccagcacgatggtcaggcagggccagagatagttaatcattcccagttccagcgactggctgcgatcgctggccagcccgatggccagcgccagacagatttcatagccgacaaagagtacgccccccagccacaggtagatagcgggcattgcgccaggtctgggcaggccccggctcaggcaaaggagacacgccgtagtagtgtagatcagcgccgcaccaccggtggcgccaaaggcttcactgacgctgcgcagcaggccaacggtcgtactccagagcagaatggcgacaagcccgatgagggtcgcgcgcgaaacggtggcaggcatgcagcgatcaacaaagtcagtgagagaagcctcccttgccacggcaagggaggggcaggattacttccagaaatcgtcgaataccgtgatcggcggacgacgtttgtgctcggttttctgataccagccttcgatgatacgggcgctgtcaggattgatgcttttgccttccaggtagtcatcaatcatctcataggtgacgcccagcgccacttcatcctgcaagcctggacgatcatcttccagatcggcagtcggtttcttcagatagagatgctccgggcagccaaggtgtttcagcaactgcttgccctgacgcttgttcaggcggaacaggggattgatgtcagtgccgccatcgccatacttggtgaagaaaccggtcacggcttcagccgcgtgatcggtgccgaccactacgcctttggtcatgccggcgatgctgtattgcgctttcatccgctcacgggctttttcattgccgcggacaaaatcggaaagcgtaatacccgcctctttcagcgcgcgctcactggccagcaccgactctttgatgtttaccaccagcgaaacggtcgggtttgataaaggccagcgcgtcctgacaatcctgctcatccgcctgcacaccatagggcagacgcacggcaataaaggtgtagtcgttatcaccgctctcctgacgcagttcggtgatcgcccgctgcgccagcgcgcccgccagggttgaatcctgaccgccgctgatccccagcaccagcgttttcaggccgctgtggcgtttcaggtaggctttaagaaaatcgatgctgacgcgcacttcctggtcggcgtcgatagtgggcttcacacccagggcttcaataatttcctgctgcagtgacatgaacttctcctcaggtcagtggcctgtcggctcgatgcgaacgttttattaaagctaacgtgcctttgcgaaaacaacaagccaaagcggtaactgattgccgtgaaacgttgcgaaatcagtgagtttttacctgcggcagcggttttttcgccagcacgttaaacatcagaatcgccgtcataaagcagccaaaaatggtggcgcacatgctcagcaccgaggtgccgccgatgccggtaatcggcacggtaatcgcacccagcgtgaacatcgtaacgcctatcactgcagaggcgctgccagcgcgatggccctgactctgcatcgccagggacgaggcggtggtagcgataacgccgttactggcaatggtaaagaacagtgccaccagcagcagcgctaagggagcatgcagcaacgcggccagcagcagcagactggaggcgacaaaggccagcgtcagtccgcctttcagcacctgatattcgccccacaatggacagaggcgggcactggtctgtgaagcaatcaccaggccaaacccgttggccgcaaagcagaagctaaaggcctggggcgaaagaccatagagttgctgcagcacgaacggcgaggcaccgatgtaggcgaacatgccggacatcataaatccctgggtcaggcagaagcccatgaaggggcgatgggtaatcacctgacccaatgccgcgtaggcggagaatattgatcctttactgcggcgtgcctcaggcagggtttcatgcagcttccagcgcgccagcaggatcagaagaatggcaatgccgcccagcaccatgaagatgccgcgccagtttaaaatcgtcatcagcacgccgcctaataccggtgcgccgatcggtgccagaccgttgaccagcatcagcagagcgaagaaccgcgtcagctcgtggccgctgtacatatcgcgtgcaatcgcccgtgacagcaccgcaccgcccgcacctgctaacccttcgaacagccgcgccagcagcagctggttaatatcctgcgccagcgcacagcccatcgaggcgataaacagcaacaccagtgacagggtcagcgggcgcaggcggccgaacttatcactcatcgggccaaagagcagctggccaaagccgagacctaacaggccagcggtcagactcagctgcgcggtagcggtttcggtgtgcaggtcctgggccatttgtggtagtgcaggcagatagaggtcgatgcagagcgggcccagcgcggccagcaggcccagcgtaatggcataaaccaggcgattggagtgtacaggggtcatttatcctcgggattgtcagcgatggggtaaacagaaagcgggtaaggctgcgaaaaacagcgtccggtaacgcgacattcacgccgatctgcgtctgcgcggatgacggtgcggtctctgaaaacggggcgctatcgggtgcctgttttgccgggcagtatacgtctgcgttgacagcaaaacagccttctttacgaaatcctgacatttgacaggccactaattgttcgtcataaacttgataaatcagcatttatgttccaggcttgtttccacatggacaataaatgaggaacaacaagatgaataaagtgatgggatgtatcgctgcggcgctgacgctggctgcactgtctggttgtacgacttacgatcgtgcggaaagctacgtgactaagccagtggtaaaggatgttaaaaagggtatgacccgtgatcaggttcgtcagatcgccggtacgccttctactgaaatcaccatggttcacgcgcgcggcacctgccagacttatgtactgggtcagcgcgacggtaaagctcagacttacttcgtgagctataacgacaccggccgtgtcatgaactacggcttccagagctgtgcggaatatgacaccgatccgcaggttcagcagtaactcatagcacccttgaatagcaaacggcccgtcattatgacgggccgtttttcgttgtggcactgactacaaacctgccgggcgcggcacctcaacataatcgccatctatctgccgctggtagaagtggccagcctgcacatagaagcgtttgccgttaaagtcgagtacccgcatttcactgctgacccgcgactctgcaggcggctctgccaccacatactcatcgccgtgacgctgataataattgccgttgagcagatagtaggtcagtccgcctatcagcaccgcggttgcggcttcaggcaaaaagcgcaccggcccgggtccgccccagtgtggcccgtggccgccatgtcgaccccatccacccggcggtccccagtcgccaggatgggcgaaagccagagcgggtgtcaaaagcgtcagcgtcagaagcgaggcgattatctttttcatcaggtgttctcctcataagactggatgcagaattcgctttttacccggcaaagacaagcactaaagcggcgatttttcgcctgtttaccatgcttaacgctttcttaacggcgtcgccattaatgggggagattatggagaggaagggcgggaataacctggcgcgggcgcgccaggttcaaagcagattagcggtgcgccagttcggcgttgtcgtcgctttccaggacgcgcttatcggtcatacctaaccagcgactggtcagagaaccggcggtcatggaaccgttgacgttcagggcagtacgacccatatcgatcagtggctcaatggagatcagcagcgccaccagggtgaccggcaggcccatcgcaggcaggacaatcagcgccgcgaaggttgcaccaccgccgacaccggcaacgcctgctgagctcagcgtcacgatcccgaccagtgtcgcaatccacagtgggtcaaacgggttgatcccgacggttggcgcaaccatcactgccagcatggttggatagagaccggcacagccgttctggccgatagtggcaccaaaagaggccgcgaagctggcaattgactcaggcacgccaagacgacgggtctgggtctcgacgctcagcggaatgctggctgcgctggagcggctggtaaaggcgaaggtaataaccggccacactttacggaagaagcgcatcgggttgataccatttaccgacagcagcagggcgtggacaccaaacatgatggccagaccgaggtaagaggcgaccacaaagctgcccagcttgatgatgtcctgcaggttagaaccggcaaccactttggtcatcagcgccagcacaccataaggcgtcagcttcatcactaaacgcaccagcttcatgacccaggactgcagcgtatcgatcgcgaccagcacgcgctgacctttaacttcatcatctttcagcaactgcagtgcagctacacccaggaaggcggcgaaaatgacgacgctgataatcgaagtcggactggctccggtcagatcggcaaacgggtttttcggaataaaggagagcaccagttgcggcacggtcaggtcagccactttgccgacatagttgctctggatcgcactgagacgcgcagtctcctgcacgccctgaaccagaccttctgcgctcaggccaaacaggccggtcacgaagacgccgaccagcgccgagatcgcagtggtaaacagcagtacgccaattgtcagtacgctgatttttcccagcgacgaggcgttatgcagacgggcgaccgcactcagaatggaaacgaacaccagcggcattacgaccatctgcagcaactggacatagccattaccgacgatgttaaaccagctgattgactctttgaccactgcgctgttttcgccgtagatcaactgcaaaaccaggccgaacagcacgccgatcaccagaccggtcagcacttttttcgacaggctccagttctgacggctgaagcgagagagcaataccagcagcaccacaaaggctacgatattaagcgtaagaggaaggtccatactgaaactccagagtaatgcggcctttcgctcaggaaaggccgcataatgttaatcacgaattaagacagcaggaatggtaacagcaggcgaagagggtgccttatatccaaatggcatggtttataacttaaaggcattttatgctgatttattgcgcattatgactggagatcaaccgtccgacgccattttgtagcgtatcgaacagctgtgacggccagccgtttgcaccaaaagatggcatgcccaccggaaaccagagcgcatatcccaccagtcccagacacaatgcccgctcaagctggttgcctttctgactgcgcagaatcggcagccggaagcgccagcggcagggccacagtagcggaaccccggcaggcgtcagcatatcggccacaatatggctaaggtagcccagcgtcagaccttgtaagacatcaggcggtatcggcgacgaccggggcaggtttatctgaaaaagccacaaaccggcggctatcgccagcaaactgtgggtaaagccgcgatggccgaaacgcgcgcgcaataggatgagagagccagcgcagtcgctgtcccagcagagatttagggtgatcgatatcgggcaacagacatgtcagcagggctgagggaactagatgccaccagtcggcttgcgccagcaccggtgtcagctcagcacgcttcgcaaagatagcgctggcaatggcaaaaatgatgtggccttcgcccgtcatgatagaacctggttgcaaagaaaactgtcgatgcatccagtatagggatttatccagtaaatgagaacatgtgacgctgtaacgaagcatgaatattattaacaaggcggacagcgatgaaacactgtccgccagtaagattaacgcgccagccagccgccatccaccgccagggtgtagccattcacgtagtcagacgcggaagaggccaggaagaccaccgggcccatcatgtcatccggcacgccccagcggcctgccggaatacgccccagaatctcttcactgcgcgactcatcattacgaagctgttccgtattgttagtggccatgtaaccgggagcgatggcattgacgttaatgccatgttttgcccactcgttcgccatcagacgggtcagtcccatcacggcacttttcgacgccgtataagagggcacccggataccgccctggaatgagagcatggaggcgatattgatgattttgccgccattaccctgcgcgataaactgacgggcaacctgctgcgacaggaaaaacaggctcttgctgttaagattcatcacgtcatcccagtcctgctcgctgaaattcagtgcgtcctcacggcggataatgccggcattgttgaccagaatgtcaattttaccggcagcggccagcgcctgttcaaccactgaggccaccacgctggtctgcatcagatcggcctgcaccggccagaaccggcgacccagcgcctccactttactttgggtatcatccgggccatcacggttaacgccgacgatatcacaacccgcctgggccagacccagcgccataccttgccctaaaccggtattacagccggtcaccagcgcgactttaccttccaggttaaacgtactcagtaccatggtatttctcctctgctcagcgcagttcactgattttgacgtggtccatgtcatcaaagacctgattctcacccaccatgccccagataaaggtgtaacgctgggtgccgacaccggcgtgaattgaccagctgggtgagatcaccgcctgctcgttgtgtaccagcagatggcgggtttgctgcggttgccccatcatgtggaagacggcgcactcttcgctcatatcgaagtagaaatagacttccatgcggcgttcgtgggtgtggcagggcatggtgttccacaggctgccttcatccagtttggttaagcccatggtgagctgacaggtgggcaacacatccggcacgataaatttgttaatggtgcggcgattggatgtcgcggcatcacccagcgtcgcggtggcggcttcctgcagcgtgattttcttgtccgggaaggtgctgtgtgctggcgcactgttgtaatagaatttggccggctgcgcagggttcaggctgcggaaactgcaggttgcgcgcacctttgccgatgtaaagtgcctcttcgtgaccgatttcccacgctttaccgtcaacttctaccagacccgggccgccaatattgatcatgcccagctcgcggcgttcaagaaaataagcgacgcccagctgttttcccatctcatcaccgatagtgaccggattattcaccggcatgacgccgccaataatgatgcggtcgatatggctgtaggtcagggtgtaatcatcggcagtaaatatcttctcaatcaggaactcgcggcgcagtgcttcagtgtcgagttgcttagcgtgatcgctgtgaatgctttgacgaacgtccatctcaggcctctctgcaggtcaggttattcatgccccaaacggggacgcttttggcatcttaggcagagcgggatgggaattcaataaaaatgaaacgttgttttattttttgcgggtcagatcaagtgacaggtgcaacaggcaataaaaagcccgccataagcgggctgatattatccctgcagatgctgcaggctaagctgggtcagattgtccagccggacatccgccagcgtccagcggggatcgtcacggtgttcagcggcgggcaccacaatcgatcgcattcgcgctgctttggtggcgatcatgccgttaaacgaatcttccagcgtgacgcagttgagcggatcgatcgcaaggctggcggcggcgttgagatagacctgcggatggggcttgctgtagggcagcgcttctgctgaagccagtacgtcgaaataagggcgcagattgaagatctccagcacctgttccagcatctttagcggtgatgcggaggcaaggccgattttcagcccctgttcccggcacagttgcagcgccgtttccacgcccggcagcagtggccgcgtctgatccaccagcgtcatggcgcgcgtaataatccgctcagtgacctcctgctgagaggggccatgccagggcagcgtttcgtaccacatccgtacagtctgatcgatgcgcagacccagggtatcgggcatttcactgcgacgtgacaggtcaacatccagcgttgaaaagatatcgagctcagcctgatcccacagaggctcagaatcgatcagtaagccatccatatcaaacagggcagcaaggacagggcggtgataaggcatcagggggtctccttttaaagtcagctttaccttaacatcattctttgctggcgcacgctctgcccgacaggccacgctttatttgggaaatttcaccgttggcaggtaaactgacggcaaattggattccgggttcaggagatattatgacctatcaacaggctggccgtatcgccatcctcaagcgagtggcaggctgggtgctctttttagtggcgctgctgtcgaccattatttctgtattgagctttatgtttaagcatagcgaaaagcagccaggcattgatgccgtcatgctcgatttcgtccacgtcatcgtcgatatgctgcgctttaacacgccattcctgaatgtcttctggcataactcgccggtaccggaatttaacggtcagatgaacctgggtttctggctgatctatattctgatttttgtcgggctggcgctggagtcgtcaggcgcgcggatgggacgtcaggcgcgtcatgtcaaagaaggcattgaggatcagatgattctggagcaggcaaaaggcagtgaagggcgtagccgtcagcaactggaagagaaggtgcgcgtacctcgccacaccatcttcctgcagatcttcccgctctatgtcctgccggtggtgattgcgatagccggttattttgcgctgtcgctgctgggctttatctgaccgcgatctttgtcaggccggtctggcctgactggcgcccagcgcatcctcatccagcaactggccaatggcgaactgtgcatcgcctggccagtgcccgccaaagacgttagcccggttgagcagatagtagagctggtagaccggcagacgctgcgaaaaaccatccggtagcggccacaccgtctgataaccgtcgtaaatctggcgaggcaggtcagggtaccagctcagcatggctaaatcgcactcacggtcgccccagtagcaggcagggtcgaacagccaggggccactctcactgctggcgcagttagccggccagagatcgccatgcagcagcgacggttgcggatgatgtgacgcgagcacccgctgcacgcaggcaacgatcagctctgtatccccgtactgaattcccttttctgccgccagttgcagctgccagccaatgcgctgttcagcaaaaaaaaccgaccagcggcgcagccagctgttgggttggggcgtcgtggtgatgttattgtcgaaatcgaggccgaactgcgtctgctcgctccactgatgcagatgcgccagttgctgaccgagctgatatgcactctgctcatcaagcggctgtggcctgatatattccagcagcagaaagctctcctcgcgatgatgacccacaccatagactttaggcacccgaaccgtgccggtgcgcgccagcaaatccagctggtctgcttcccaggtaaagagcgacagcatatcgcggctgttacttttgacgaagacgtcgtgatcaccgtagcggatctgccaggtgggatggatatcaccccccgcgagggcgtgacgttgagtgatttcggcgttgcctaactgctcgcttaacagacgactaatggctgaccacattgggctatcctcgttattcgctgcgtaagttcgattgtattgcgtaaatattcaccaaaaaccgcgcaattgcaccctttattctggcgctgaggtggcagggcgatgatcggcagcatcgcgcagatactcttcgaaggtcgtgacggtcacctcgggtttcctgacccagcgcgctttcaccggccgcagtgacctgctgccgcagatcctcagcctccagcgtgctgacgatgccatagctgttcgtaccgagttcatgcggatggccgtcgtcatctgtcatcgtggtcgtgaaacctgcggcggtcattgcgctggtcagctccaggatgtcacttaagcccgactcctgatagtgaaaggtcacgatatagcgggttaaggtgttactcatgaggcacctccggggaagggaaactgaactgagcgtagaccatggtgaaaaatcaggcgaattatgaaggagatgctgcgtgtgtgacgtgatgcatagcgtaaattcgtgtcaggagccagcagcataacgtaaaaatcttctgccgttgcgtctggcttttcgtttgagcagcactataatgcgcgacgttaataagatgagtcccaattaacaggggttgtcagggtgattccaggcattttgtgtaagttaataattttttacaaaacttaccgtaaattgcattgaatgcccggcaaaacgcttcagactctccgttttttaaacagtcgcacggatcacatttaatgaaagcctataacaagctgtctgctgttcttttgctctccgccggagctttctgtcaccaggcaatggccgataacgccgtatttacgtcaatggatgacccttcaacagctaaaaagccgtttgaaggttctgctgctgcgggatatctggcgcaaaccggtaacaccaccagttcatcaatgacggctcagaccaatatgacctggtatcagtcatctatggcttacagcttgtggggtaacgcagccaacacctcgtcaaacgatgagcgctcttctgaaacttacaacatcggtggtcgttcacgttacaacctcaactcgtatgactacctgtttggacaggcgagctggttaagcgatcgtttcaatggttacgattcacgcgacgtgctgacagccggttacggtcgtcagattctgaatggtccggtgcactcgctgcgtgcggaattgggtccgggtgtacgttatgacgattatcacgcgggtggtcatcagaccaaagcgctgggctatggcgcagtcagctatcagtggcagctgaccgacaccactaaatttattcagggcgtgtcggtgctgagcagcttcggagaagacaccacggtgaactctgaaactggcctgcaggtggcgatcaacagccacttcgcgctgaagctggcttacaacgtcagctggaacaacaatccggcggaatcggcacctgatcgtaccgataccaaaacctcaatcatgctctcttacgctatgtaagcgcatttttgcagcagcattcacagcggcctgacagtgtgtcaggccgcttttttttgatttctccagggcttagcgaaaaaggcatgggtttttctcgccggggaaaactgctatcatcggccccgcactgaaatcctggcgacattccgacaatgtgggtctgatatcacgccgggtcactaattttacattacgttgcatgtaggctttcgtgtggcttaccactgcaaataaggatatgaaatgcctgtaattacgcttcctgatggcagccagcgcgtgtttgaccgccctgtcagtgtgatggatattgcgctggacatcggtcctggtctggcgaaagcctgtatcgctggccgtgttaacggtgaactggttgatgctgttgatcccatcactgaagatgccgccgtagcgatcattaccgctaaagatgaagcgggtctggaaatcatccgtcactcctgtgcgcacctgttagggcatgcgattaaacagctgtggccggataccaaaatggcgattggcccggtcattgataacggcttctattatgatgtcgacatcgatcgtaccctgacccaggaagatatcgacctgctggaaaaacgcatgcatcagttggctgaaaccaactacgatgtggtgaagaagaaggtcagctggcaggaagctcgcgacgtctttgcggcgcgcggcgaaatttacaagaccaccattcttgatgaaaacatcagccatgacgataagcctggcctgtatcatcacgaagaatatgtcgacatgtgccgcggtccgcacgtgccgaacatgcggtttctgccatcattttaaactgcagaagatctccggtgcctactggcgcggcgacagcaacaacaaaatgctgcagcgtatttatggcaccgcatgggcagacaaaaagcagctggcagcctatctgcagcgtctggaagaggcggcgaagcgtgaccatcgtaagattggtaagcagctggatctctaccacatgcaggaagaagcaccaggcatggtcttctggcataatgacggctggaccatcttccgcgagctggaagtgtttgtccgcagcaagttaaaagagtaccagtaccaggaagttaaaggtccattcatgatggatcgcgtcctgtgggaaaaaaccgggcactgggaaaactataaagaagcaatgttcaccacctcatctgagaaccgtgaatattgcatcaaaccgatgaactgtcctgggcatgttcagatctttaatcagggtctgaaatcctaccgtgacctgccgctgcgtatggcagagttcggcagctgtcaccgtaatgaaccctcaggcgcactgcacggcctgatgcgtgttcgtggctttacccaggatgatgcacacgtcttctgtactgaagagcaggtgcgtgacgaagtgaacagctgtatccgcatggtttatgacatgtacagcaccttcggttttgaaaagattgtggtgaagttatccacccgtcctgagaagcgcatcggtacggatgagatgtgggatcgtgccgaggaagatctggctgcggcgctgaacgaaaacaatattgagtttgagttccagccaggcgaaggcgcgtttctacggtcctaaaattgagtttactttgtacgattgtcttgatcgcgcctggcagtgcggaacagttcagctagacttctccctgccaaaacgccttgaagcaacctacgtgggtgaaaacaatgatcgtcagacgccagtgatgattcaccgtgcgattctggggtcaatggagcgtttcatcggtattctgaccgaagaattcgccggtttcttcccaacctggctggcaccgctgcaagtcgtggtaatgaatattaccgacggacaagcagaatatgttgagtctttgacgcgtaagctgcagaatgctggcattcgtgtgaaggcagacttgagaaatgagaagataggctttaaaatccgcgagcacacattacgtcgcgtcccttatatgttggtctgcggtgataaagaggtggaatctggcaaagttgccgttcgcacccgccgtggtaaagaccttgggtcgatggatgtcgatgtgtttgttgagaaacttcaacaagagattcgcagccgaaatcttcaacaattggaggaataaagtattaaaggcggaaaacgagtactaccgacgcgtccgaacaaaatcaacagtgaaatccgcgcaactgaagtgcgcttaacaggcatggatggcgagccgattggcattgtcacattacgcgaagctttggaaaaagccgaggaagcgggcggcgacttagtcgaaatcagcccgaatgccgaaccgccggtctgccgcatcatggattacggcaagttcctctatgaaaaaagcaaatcttctaaggaacagaagaagaagcaaaaagttattcaggttaaggaaatcaaattccgtcctggaaccgatgatggcgactatcaggtcaaactacgcaacctgattcgctttctggaagaaggcgataaagccaaaatcacgctgcgtttccgcggtcgtgagatggcgcaccagcagatcggtatggaagtgcttaaccgcgtccgtaaagacctgtgtgaagatctggatttggccattgtcgaatccttcccttcgaagatcgaaggccgccagatgatcatggtgctcgctcctaagaagaaacagtaggctttcaagtaacactaaccgcgcagcgttcgcgctgtgcggtgaactgttcgcctgtctgggtcatgttattaacaatgcgaagtggatatttttaaaatgccaaagattaaaactgtacgtggtgcggctaagcgtttccgcaagaccgcttctggcggcttcaagcgtaaacacgcaaacctgcgtcatattctgaccaaaaaatctactaagcgtaaacgtcacctgcgccctaaaggcatggtgtcaaaaggcgatctgggtctggtaattgcctgcctgccgtacgcataagtaattttttcattaaatcagaatattaaacaggagagctaaatggctcgtgtaaaacgtggtgtagttgctcgcgcacgtcacaaaaaaatcttaaaacaagctaaaggctattacggtgcacgttcacgtgtttaccgcgttgccttccaggctgttatcaaagctggtcagtatgcttaccgtgaccgtcgtcaacgtaagcgtcagttccgtcagctgtggatcgcgcgtatcaacgcagcggctcgtcagaaacggcatgtcttacagccgtttcatcaatggtctgaaaaaagcagccattgagattgaccgtaagatcctggccgacatcgcagtattcgataaagtggcattctctgcactggtcgaaaaagcgaaatcagccctggcgtaagtcagatggaaaagggagcttgctcccttttttattgcctgtaacttacgcaaaagattgacatttccggcgctgagcatttcaatagaccccctgtatcgcatgacaaggtaaccgcaagcatgaacgctgctattttccgtttctttttttactttagcgcctgacatccaggggcttttgcgcataagaaaagaaacgaaaaatcgcgctaaaagcctccctcgtggaggcttttttgtttctggcgctagcatattggaccggcaggtcccaacgagaaactgaccagcctgactggaaaaagaggaaactatgtcccaactcgcagaactggtggccagcgccacggcggccatcgacggggcgacggatatcgccgcccttgacgcggtgcgcgtcgaatatctgggtaagaaaggacatctgacactgcagatgactacgttacgcgagctgccagccgaagagcgcccggcagcgggtgcggtaatcaatgaagcgaagcagcaggtcaccgagcgtctgaatgcgcgcaaagatgccctggaagctgcggtgctgaatgcccgtctggctgaagagaccattgatgtctctctgcctggtcgtcgcattgagaatggcggcctgcatccggtgacccgcaccatggatcgcattgagaccttctttggtgagttaggctttggcgtcgtaaccggtccagaaattgaagatgattatcataacttcgatgcgctgaatattcctgcccatcacccggcccgtgccgatcacgataccttctggtttgacgccacgcgcctgctgcgtacccagacgtccggcgtgcagatccgtaccatgaaggctcagcagccgccgattcgcattattgcgccgggccgcgtctaccgtaacgattacgatcagacccataccccgatgttccatcagatggaagggctgattgtggataaaaatatcagctttaccaacctgaaaggcacgctgcacgatttcctgaacaacttcttcgaagaagatctgcagattcgtttccgtccttcctatttcccgtttactgagccatcagcagaagtagacgtcatgggtaaaaacggcaagtggctggaagtgctgggttgcggcatggttcaccctaacgtgctgcgtaatgtcggcatcgatccggaagtctactccggtttcgcctttggtatgggcatggagcgtctgaccatgttgcgctacggcgtgaccgatctgcgtgccttctttgaaaatgatttacgtttcctcaaacaatttaagtaagggcaggatatccaatgaaattcagtgaactctggttacgcgaatgggtaaatccagccctggacagcgctgcgctgtctgaacaaatcactatggccggtctggaagttgacggcgttgatccggttgccggtgcgttccacggcgtcgtggtcggggaagtggtggagtgcggccagcacccgaatgcagacaagctgcgtgtgaccaaaatcaatgtgggcggcgatcgcctgctggatatcgtctgtggcgcgccgaactgccgtcagggactgaaagtcgcggtcgccaccgtcggcgccgtgctgccaggtgatttcaaaatcaaagcggctaaactgcgtggcgagccgtctgaaggcatgctctgctctttctccgagctggggatttccgacgaccacaacggcatcatcgaactgccagccgatgcgccgattggcaccgacatccgcacctacctgcagcttgatgacaacaccattgaaatcagcgtcacgcctaaccgcgctgactgtctgggtctgatcggtatcgcccgtgatgtcgccgtccttaacggtttgccactgaacgtgccggagatgcagccggtcgctgcgacgctgaacgacactttcccgattcaggttgacgcgacagaagcctgtccacgctatctgggccgtgtagtaaaaggcataaacgttaaggcgtcaacgccattgtggatgaaagagaagctgcgtcgttgtggtattcgttctatcgatccggtggtggatatcactaactacgttctgctggagctgggtcagccgatgcacgccttcgatctcgaccgcatcgacggcggtatcgtggtgcgtatggcgaaagagggcgaaaagctgacgctgctggatggcactgaagccagcctgcagagtgataccttagtgatcgccgatcatcagaaagcgctggcgatggctggtatctttggtggcgaacattcgggcgtgaacggcggaacgcagaatatcctgttcgagtgcgcttactttgatccgctctctattaccggccgcgcccgtcgtcatggtctgcataccgacgcgtcacatcgctacgagcgtggtgttgatccggcgctgcaacataccgcactggagcgtgctacccagctgctgctgtcaatctgcggcggtgaagcgggcccgatcatcgatcagacccatcaggcagccctgcctgtgccagcgacgatcacgctgcgtcgtgaaaagctggaccgtctgattggccacgtgatcgcggatgagcaggtgactgacattctgacgcgtctcggctgtgaagtgactgtgggagaagggcagtggcaggccgtcgccccgagctggcgcttcgatatggcgattgaagaagatctggttgaagaagtggcccgtatttatggctacaacaacattccggatgtgccggtacaggcgggtctggtgatgactcagcatcgcgaagcgaatctgtcgctgaagcgcgcgaaaaacctgctggtggacaagggctatcaggaagcgattacctacagcttcgtcgatccgaaaattcagcagctgctgcacccgggtgaagaggcgcttttgctgccgagcccaatctccagcgatatgtcgaccatgcgtctctcactctggaccggcctgctcagcgcggtagtctacaaccagaaaccgtcagcagagccgcgtgcgcctgtttgagagcggcttacgctttgtgccggatacccaggcagatttgggcatccgtcaggatcttatgctggctggcgtcatcagcggtaaccgcgttgaagagcactgggatctggcgcgtcagacagttgacttctatgatttgaaaggcgatttagaatcgctgctcgatttaaccggcaaactggatgacatcagcttccgtgctgaagcgaatccggcgttgcatccaggacagagcgcggcgatttatttgcatgatgaacatatcggatttatcggcgtggttcatcctgagctggaacgtaagcttgatctcaatggccgcaccttagtctttgaactgctttggaataaggtcgcagaccgcgtcctgcctgacgcgcgcgagatttctcgcttcccggcgaaccgtcgtgatattgccgttgtggtggctgaaaacgtccccgcagcagatatcatcgcggagtgtaagaaagttggcgtaaatcaggtagttggcgtaaacttgtttgacgtgtaccgcggtaagggcgtttctgagggctacaagagcctcgcaatcagcctgattttgcaggataccagccggacactcgaagaagaggagattgccgcgaccgttggcaaatgcgttgcggcattaaaagagcgattccaggcaaccttgagggattgaacctatggcgcttacaaaagctgagatgtcagagtacctgtttgagaaactcgggctgagcaaacgcgatgccaaagagttagtagagctgtttttcgaagaggtacgtcgcgctttggagaatggagaacaggtaaaactgtctgggtttggtaattttgacctgcgtgacaaaaaccagcgtcctggcagaaacccgaaaacgggtgaagatattccgattactgcgcgtcgcgtagtaacgtttccgcccaggacagaagctgaaaagccgcgtagagaacgctacacccaaagagactgactgaatttcagcgtttcaaaaaggccgcgcaagcggccttttttcatggtttcagtacgcagtaatcccgcttcccgcgcccgttaatctccctgacggcaaagagcaaaccgcctcatctgcctttcttttttctgcaatccctctacaatcaaatctctgttttctcagctaatcccgcttatgtctctgctcgaccagctcgcgcgccaggccgaccagcgcggccagaaatggcttattgtgttagcacttatgctctctgcactgctctgtctcagcctgtgtgccggtgacagctggatcgcgccctcagactggttcacggaaagcggcaggctctttgtctggcagttgcggctgccccgcagtctggcggtggtgctggttggagcgtcgctggcggtatgcggtgtcgtgatgcaggcgctgtttacaaatccgctggcggagcccggcctgctcggcgtctcgaacggtgccggtattggcctggtgctcggcgtgctgctgggcagcggttcgctgtggagccttgggctggcggcgatggccggtgcactgataattacgctcatcctgctgcattttgcccatcgtcagctctcggtcacccggctattgcttaccggcgtggcgctggggattatctgtagtgccatcatgacctgggcggtctacttcagtaccagcctcgatctgcgccagttgatgtactggatgatggggggcttcagcgggattgactggcgctatggctggatgatgctggcgctgctgccggtgatgctggccctgggggcgaccgggcagattcttaatctgctggcgctgggcgagacatctgcccgccagctcggactgtctctcttctactggcgtaacctgctggtgctggccatgggctggctggtcggcatcagcgttgcgatggccggtgctattggctttatcggactggtgatcccgcatctgctgcgtatgagcggcatcagcgatcaccgctatctgctgccggcatcggcgctggctggcgcaggtgtattactggcagccgatattgtggcacgcctggcgctgacgtcggcggaattaccgataggcgtcgtgacggcgacactgggcgcgccgctgtttattattttactggtgaaatcttcacgctagcttcggctggcgactctgcatctacaacagcatccacaacaggaaacagcatgaacatatatcaaactgaactggttacgctcgatggggaaaaaaccacgctgtcacaatggcagggcaaggtactgctggtggtcaatgttgcctcgaaatgtggtctgacgccgcaatatgaagagctggagaacctgcagaaagcctggcaggatcagggcttcagcgtactcggttttccctgcaaccagtttctggagcaggagccgggcagcagtgaggagattaaaaccttctgcagcaccacgtatggcgtcacgttcccgatgtttgccaaaaccgaggtgaatggcgcaggccgtcatccgctctatgctcagctgattgcggcccgacctgacgcggtgcgcccggaaggcagcggcttttacgagcgcatggagagcaaaggacgcgcgccgaaagagcagggcgacatcctgtggaacttcgaaaaattccttattggccgtgacggcagcgtgatccagcgttttgcacctgacatgacgccggaagatccgatcattctggaaaccattaagcaggcgctggcaaaatagatgctgttgcgcctgcaacaggcagccgtccccggacggctgctgccactgaccggtgagcttgccgccggtcagctgctgcacgtggcaggcccgaacggtgcaggcaaaagcaccttactcagtgtgattgcgggactgcaacccgcctccggcacggtgctgctggacgaacagccgctgagtgactggaacggcgcggcgatggcccgggttcgcggctggctgcctcagcagcaggcaccgctgagtcagatgccggtctggcactatttgcgtctgcatctgaaacaggcggcggggcagacagacgatcgcctcagcacgctgctgaaacggcttcagctgcaggataagttatcgcgttcactgacccggctctccggtggtgaatggcagcgcgtcaggctggcggcggtctgtatgcagattgatccccacatcaatccacacgggcggctgctgatccttgatgagcccatgaccgcgctggatatcgcccagcaaaaagcggtggacgatctgattgccgacctgtgcgcggcgggcatcagcgttatcgccagcagtcacgacctcaaccacagcctgcaacaggcggatcgggtctggctgatggataagggagcgttgattgcgcagggtgaaccggctgaggttctgacgccgcagcgcctgacaccgatctaccagattgctttccggcagcttgaacttgaaggacgcacgctgctgaccgtattgccctgacacttgctacccggcgggctttaccgctacattaagccggttgcaacttctgataaggacatttggcgatgcgcctgggtttgctgattttagttctgctgctgacgggatgcagtcatcacgctccgccgattaatggccgtctttccgattcgatcaccgtgattgcggaactgaacgatcagctcggtaactggcgtgggacgccttatcgctatggcggcatgagtcgtaacggggttgactgctccggctttgtctatctgactttccgcgataaatttgcgctgcaactgccgcgcactacctcagctcaaagcgatatcggcacccgaatcagcaaagatgaactgctgccaggcgatctggtcttcttcaaaaccggtcgcggggagaatggcctgcatgtgggcatttatgacaccgataatgcttttattcatgcctcaaccagccagggcgtcatccgctcctcgctcgacaatgtctactggcgaaaagtgttctggcaggcgcgtcgtatttaaacgcaggtccggggaatcagacttaagtccaattttaaatagagttaaaacagagagtaaaaggtttattttaaatgacagttattgagcgtgggttttaataaatataataaacgcttatttaattccactaataaccgctgttttatcgctactatttggcttaagggtgatcgcctgctgccaaacggcaatggaagagtaaagaagttcgtctcttcaatgatttggcactattgcctgcgcctgaccattactatacgatatccccatcgccgcatattctggcattaaaatgaaaattcatctttcggccgactatcagtcggaaatctggttttatcctgtctgtgatgttaatgggcgactgaccgctgtcgagctggtcacgcagtttgtgcatgaaagtgcccccatcaccctgccgcaggatctgttgctgccgcagctcgatgagtcgcagcagctgcgcctgctgcaaagtcagattggattgctggagcagaatcgcggcttttttgaagcgcattccgtgtcagcatttatacgtattgatgaaggcatggcccggacgctgctggccagcgaattagtgatgcgcaaaataaagcagttgccattcattctgttgaatatcactgaaacgtttccgcaactaaaactgggaaaaaataatcccctgctggcaagcctgcatgctgagtttaatttagcgatttctcatttcggcgcgggtaagaccccctctaatgcggtctacgataatttattcagctgcatctgcctggacaaagagtttattcattcgctggcaaagcgcgcttcattcgtgccatttattcagagcattatcgataatttccgcgcccattgtgaccgcctcattatttgtggcattgatgacgacgtgctgctggataaagtcagccagctgagcggtgccgagtttcagggttcgctcttcccggtggtaaaatctgacgcgctgcattcactgatctgcgccgacgatcgtgtgccatccgcgcagcatcccggctgatacttcctgttaatccccgctatcagcgttacactagaggactaaccttaagtaacgctgagcatcgcatgggagaaacaatgtcctcaggcaaggcctctttcgacaacacctggttccgtgaacttaccgggtgttacaccgcgctgaaccccacgccactggcaggcggacgcctgctgtatcataacgcaccgcttgcagcctcaatggggctggatagcgcgctctttgccgataagggtcatgccgtctggcacggtgccgcactgctgcccggcatgcagccgctggcgcaggtctacagcggccatcagtttggcgtctgggcgggccagcttggcgacgggcgcggcattctgctgggtgagcagcgtctggaggatggcagcaagctggactggcatctcaagggcgcaggcctgacgccttattcccgcatgggggatggtcgtgccgtgatccgttccagcgtgcgtgagtttctcgcctcggaagcgctgcatcatctgggcattcccaccacgcgtgcgctgacgctgtcgataggtgatgagccggtctaccgcgaaacaacagagcgtggcgcgatgctgatgcgcatttcaccgagtcatctgcgtttcggtcatttcgagcatttcttttacagccagcagcaggagaaagtgcagcaactggccgactacgccattcgccatcactggccgcatctggacgctgaagcagaccgctatcaacagtggtttaccgacattgtgttacgcactgcgcgtctgattgcgctgtggcagagcgtgggctttgctcatggagtgatgaacacggacaacatgtcgattctgggtctgaccatcgactatggcccctttggttttctggatgattatcagcctgacttcatctgtaatcacagcgactatcaggggcgctacagctttgaaaatcagccaatgatcggtatgtggaatcttaaccggctggcacatgcgctgtcgggtctgctgaccaccgagcagttgcggacggcactgagcgcctacgaaacctgaactgatgcgggtctggggcgaacggatgcgggcgaaactcggtctgctgacgcagcagagcagcgataatgagattctgaccgatctgctggcactgatgacgcaggagcatagcgattacaccctgacgttccgcctgcttagtgagacgcaacaggctgacagccgttcaccgctgcgggatgagtttatcgatcgtgaggcgtttgatagctggtatcagcgctaccgcagccgtctgatggacgagcaggtcagcgatgcagaacgccaggccgtgatgaaggcggccaatccggcggtgattctgcgcaactatctggcgcagcaggcgattgaagaggcggagcggggagagcagggggagctggcacgtctgcatcaggcgttagagcaaccctttagcgatcagacagccgctgaatatcgtcagcggccgccagactggggcaaaaccctggaagtgagctgctccagctgatgcagactcagaggcggtgagaaaccgcctcggccagcagggcgagcaccttttcgctctcctgccagccgaggcagggatcggtaatcgacttgccatagaccagcggttcgccgctgacgactttctgattgccctcttccaggaagctttcaatcatcacaccagcaacggcctgcgatcccgctttaatctgttctgccacctctgccgcgacatccatctgacgacgatgctgcttcaggcagttaccgtgactgaagtcgatcaccagctgctgtggcagattaaacgccgacagactttcggctgcggcggcgacatcactggcatgatagttaggctgtttgccgccacgcaggatcacatgaccatgcgggttgccgctggtctgatagatagtcatctggcccagcttatcgggcgagaggaacatgtggctggcgcgcgcggcgcgaatcgcatccacggcaatctgtacgttaccatcggtgccgtttttaaagccgaccgggcaggagagggccgatgccatttcgcggtggatctggctttcggtggtgcgtgcgccaatcgcgccccagctaatcagatcggcaataaactggccgatcaccatatccaggaattccgtggcggtaggcaggcccagcgcgttgatatcaatcagcagctggcgggcgatgcctatgccgcggttcacatcgtagctcccatccagatccggatcggagattaaacctttccagcccactacggtgcgcggcttttcaaagtaggcgcgcatcacaatctccagccgatcttcatagcggcggcgtaacgcgttcagacgctcagcatattccagtgccgctttcgggtcgtgcagcgagcaggggccaatcaccaccagcaggcggggatcttcacccgtcagaatacgggcaatacgtttacgggcagcggtgacattgtcggcaattgccggagagacaggatgctcggccgccaggctggcgggggtaatcagactaccaatgcgtgcggtacgcagttcgtcggttttgttcatgggtttctcgaaaacggttcttcgcagcggtgaaataccgggaagtgatggtggtcacaataaaccattagtctgcgaattcaacccggaatttaataatgaaatcaaaagcgacggcagcgccgctttacagttcagcgccagttacccatcagtacatgcggcgagtcaggcccataatgtcgagaattttggtcgcaatctcctccacggagtagttggtgctgttgagatagcggatctgatgagtgcgaaacagcgcttccacttcgcccacctccagccggcactgacgcatcgaggcgtaacgggtattttccgcccgctcctgacgtatcgcagccagccgttccgggtcgatggtcagcccgaacagtttattctgatgcgcgcgcagcgcgggcgggagtttaaggttatccatatcgtcggcaatgaatggatagttggcggcgcgaataccaaactgcattgccagatagaggctggtgggggttttgccacagcgcgagacgcctaacagaatcacctgcgcatcttccagtccgcgcagcgagatgccgtcatcatgcgccagggtgtaatcgatggccgcgatacgtgcgtcatatttacccaggttactggcatccagtccatgggtacggtgtgccaccggcgcgggcgataaccccagctcctgctgaagcggggcgaccagcgcctggacgatatcctgacaaaagccgtcactctgtacgatgatgtcgcgcacttccggcgtcacgatggagaaaaagaccagcggccggacaccgctctgctgatagagcgcgttaatctgggctttaaccgccagcgcccgctgaacattttccacaaacggcagcgtcaggctggtgatattgaccggaaactgcgacagcaccgcatgacccagcacctcagccgtaatggccgtaccatcggagatataaaaaacgcttctgtcagttgtcataacgaaatcagcctcagacaagagtgagcattcagcatgggccatgcaattaaataaatcatctctgattttaatttctggaatgtctgtccggattatttgtctgtcgtttcatcacgatactaaaaatgaaagggtggctcgttgagccagcattctttttaatctgtcgttaagccgcaagtagccacgcagttgttgcgcaacaaaacagaatgcttaagtggctgaaaatctgccatttcctgtggcatcaatcatttagagaaaaaaggcgactttgcgcaacagcaaaataatgcgctcacaattccgaaactgtggctgaaattctgctttaacgattcaacagatcgttattgagagggtgatatgccaggctgaagacagattactccctgtgtccattcattgataattgataaaggataagctcaatgtccagtaaaggcgaacagccactcgtgctctggtataaccagcttggcatgcatgatgttgaccgggtggggggcaaaaatgcctctctgggtgaaatgattactaatctgtcgtcgctgggcgtttccgtgcccaatggtttcgcgaccacatcctacgcctttaacctgttcctcgatcaaagcgggctgaatcagcgtatttatgcgctgctggatgagaccgatattgatgacgttgatgcgctggcaaaagcgggtaagcagattcgtcagtgggtcgtggagacaccgttcctgcccgagctggagtccgccattctggacgcctataagcagctttctgctgatgatgatgccgcgtcgtttgccgtgcgctcctctgcaaccgcagaagatatgcctgacgcctcttttgccggccagcaggaaaccttcctgaatgtacagggcatcgacgccgtcatggtggcggtaaagcatgtcttcgcctcgctgtttaatgaccgcgctatctcctaccgtgtgcatcagggctatgaccatcgtggcgttgcgctctcagcgggaatacagcgcatggtgcgttcagacctggccgcctcgggtgtgatgttcaccattgataccgagtccggctttgatcaggtagtctttatcaccgccgcactggggctgggggaaatggtggtgcagggtgccgttaacccggatgagttctatgtccacaagccaaccctggcagccgatcgtccgtcgattgtgcgccgcaatatgggctcgaaaaaggttcgcatggtctatgccgattcccaggcgcatggcgagcaggtgcggatcgaagatgtgcctgaggccgaacgcgaccgtttctgcctgagcgatgaggaagtgcaggcgctggcgaagcaggcggtgctgattgaacagcactatcagcgcccgatggatattgagtgggccaaagatgggcacaccggcaagctttttatcgttcaggcgcgccctgaaaccgtacgttcaaatggtcaggtaatggagcgttatacgctgcaggggcagggcagcgtcgtcgtggaaggtcgtgctatcggtcatcgtattggcgcaggcgtggtgaaggtcatccacgatatcagcgaaatgaaccgcattgaaaaaggcgatgtgctggtgaccgacatgaccgacccggactgggaaccgatcatgaaaaaagcatcagcgattgtgactaaccgtggcggacggacctgtcatgctgcgatcatcgcgcgtgagctgggcattccggcagtggtgggctgtggtgacgccaccgaccggctgaaagaggggcataacgtcacggtctcatgtgccgaaggtgataccggctacgtctatgatcaactgctcgacttcgacgtcaccagttcgcaggtcgattcactgcctgaactgccgctgaagatcatgatgaacgtgggcaaccccgatcgcgcctttgatttcgcctgtctgcctaacgaaggcgtgggtctggcgcggctggaatttatcattaaccgtatgatcggcgtccaccctaaagcgctgctggagtttgaccaacagacgccggagctgcagcagcagatccgtaaaatgatgaaaggatttgatgatccggtggagttttacatcgctcgcctgactgaaggaattgccacgcttggcgccgcttttgcgccgaaacgcgtaattgtccgactttctgactttaaaaccaatgaatatgccaacctggtgggtggagaacgctacgagccggaagaggaaaacccgatgctgggattccggggtgcgggtcgctatgtcgctgacagcttccgggactgctttgcactggagtgcgaagcggtgaaacgtgttcgcaacgagatgggcctgacaaacgtcgagattatggttccgtttgtgcgcaccgttgagcaggcgaaggctgtggtggaagagctggggcgtcagggactgaagcgcggcgagaacgggctgaagatcattatgatgtgcgagatcccgtccaatgccctgctggcggatcagtttcctggagcacttcgatggcttctctattggctcaaacgacatgactcagctgacgctggggctggaccgcgactctggcgtcgtctccgcgctgtttgacgagcgtaacgaggccgtgaagatgctgctttcaatggccataagggccgcgaagcagaaggggaaatatgtcggaatctgcgggcagggaccgtcagaccatcaggatttcgccgcatggctgatggaagagggcatcgacagtctgtcactgaacccggacacggtggtggagacctgggtgagtctggcgcagttaaataaaacagcctgatacgggttgttagcactcttcagggcccgctatgcgggccttttctgtttatatctggtcagattcaggcaaaaaaaaagcccatcacaggggatgggcaaagactacacacagcaattctttactctactcaggggaatgagattgtctgaaaatcatcaggttgatttcgaacataggaaacatgttattcatacggctggctgtcgtctttaagaatcctcttattagtttaaagccaataatcttttgtgacctttacttcgccatttggcttaagaaacagtgcagaaagtaatcttttttggcccgaaaaggtcactttcaggccaaaggtggcttttttcttaaaaatcgctaatggaaaacagaatttatctgatctgagagaaggggtgcggttaatcatcattaaccgcactaatcaatgcttatgggggctagcggcgcagcgggttgttgcatctcatcatacagcaggcggggtatcctcgtgatccgccagggcatcagccacggccagttggtcactatccggggcaggcgcttcatgaacccagacggaaaccagacggtaggagaccgccagaaccaccggcccgataaacagaccaatcatcccgaacgcaaacagtccaccaataacaccagaaagaatcaggatcattggcagatcggcacccatacggatcagcatcgggcgcagcacgttatccatcgtgccgaccacacagctccagaccagcagcaccgttccccatgttgtatctccgctccagtagaggtagataatggcgggaaccagcaccagtagcgggccgagctgtaccagacagcagaggatcatcagtaccgtcaacagcgtggcgtaaggaatgccggagatcgccagaccgataccgcccagcacgccctgtaccagcgccgtcactactacgccaagcgccacggcacgaatcgactgcgccgccagcagtacggcggcatcaccgcgccgtcccgccatgcggaaagcaaagtgacgaatgccctgggcagcctgtttcgccacgccagtaaagcagcacgctgaacagtaacatcacgcccagatggatcataaagcgtccgaaatgaccggcctgcgcgacaaaaaagccggtggtacggccgatatagggctgtattttcgccatgacgccggcaccgccgctcgccaccagcgtgtcataactgacataaagcttcttgccgaccatcgggacatcgttgagccataacagtcgcggcatcatatgcccctgggtaacccaggcaatcaccggcgcgctgttatcaatcaggctgctgaccagcagggcgatagggataataaacagcagcagcagcagcagtgtcatcacgatcaccgccagggaacggcgtccccataacagtcgctggaatttcagcatcaatggccaggtggcaatcaccaccatgctggcccaggcaaagcccagaataaacggctgcacgacccataaacaggcgacaatcagcagcaagatgaacatcagggtgaagagtatttgcggtaaatccatatcccggtactggcttttcatcattgactcataacctcgtcttaatccttcattttcaggcattcggatgcccgtttttatcatgatctatttgctgaggtttaaacagagttgcggagaaaggtttttgccttttctgaaaaaagggcaggcgcaggaaaaatatgataaaacgagaaatcgctaatctataaacgcaaacgtttacaacaccttcggtcagacaatcatgatcccacagatttcgcaggcaccgggcctcgttcaactggtgctgacgttccttgagtcgttgaaagagcagggttttaccggtgacatggcaaccagctatgccgatcgtctctcactctccaccgataatagcatctatcaattgctgcccgacgcggcgctctttccgcgttcgactgcggatgttgcgctgctcgcccgcgtggccggagaagcgcgctttgccagtctggtatttaccccgcgcggcggcggtaccggcaccaacggtcagtcgctgaatcaggggattgtggtggatatgtcgcgctacatgaaccgtatcctggagatcaataccgatgagggctgggtgcgggttgaagcgggggtgatcaaagatcagcttaacgcctggctgaagccattcggctttttcttctcgccagagttatccaccagtaaccgtgccacgctgggcggcatgattaataccgatgcgtccggccagggctcgctggtctatggcaaaacctcggaccatgtgttgggcctgcgcgccgtgctgctgggcggcgatatccttgatacgcggccaatggccaccgcgctggctgaaaccctggcgcagacggcgacgcccgaaggccggctctatcagcaggtgctgacgcgctgccgcgagcatcgtgcgctgattctggaaaagtttccaaagctgaatcggttcctgaccggatatgacctgcgccatgtattcagcgacgatatgcaaacctttgacctgacgcgcctgctgtgtggtgcagagggaacgctggccttcgtcacggaagcgcggcttgatatcacgccgctgcctaaagtgcgccgactggtgaatatcaaatatgactcctttgactccgccctgcgcaatgcgccttttatggtggaagcgcaggcgctctcggtagagaccgttgactctaaggtgctgaacctggcgcgcgaagatattgtctggcactcggtgcgtgaattgatcgccgatgtacccgacaaagagatgctgggtctgaatattgttgagtttgccggtgacaacgccgcgctgatcgatcagcagattgaacagctttgtggccgccttgacgcactgatggcgcagcagcagggcggcgtgattggctatcagttctgtaacgacctggatggcattgaacgcatctataacatgcgtaaaaaagcggtgggtctgttgggaaatgccaaaggccgggctaaaccgattccctttgtggaagataccgcggtcccaccggaaaaactggcggactacatcgtcgagtttcgcgcgctgctcgacagccacgggctgagctacggcatgtttggccatgtcgatgcaggcgtactgcatgtgcgtccggcgctggatatgtgtgatccgcagcaggagatgatgatgaagcagatctccgacgaagtcgtagcgctgacagcgcgctacggcggcctgctgtggggtgaacatggcaaagggtttcgagcccagtacagtccggcattcttcggtgagacgctgtttaacgaattgcgccgcatcaaagcggcctttgatccgctcaatcgcctgaacccgggcaagatctgtacgccatacaacagtaatgataaaatgatgcaggtcgatgcggtgaagcgcggaacctatgatcgtcagatcccgttaacggtccgggatgaatggcgaggcgcgatggagtgtaacggcaacgggttgtgttttaactttgatgcccgcagcccgatgtgtccctccatgaagatcacccgcaaccgcattcactcgcccaaagggcgggcaacactgacgcgggagtggctgcggctgctggccgggcagggcgtcgatccgctcaccctggaaaagcagctgcctgaaaatcggctgtcgcttcgcaccctgattgcccgtacccgcaatagctggcacgccagcaaaggggagtatgacttctcgcacgaggtgaaagaggcgatgtcgggctgtctggcctgcaaagcctgctctacccagtgtccgattaaaattgacgtgcccgctttccgctcgcgcttcttacagctctaccatacccgttatctgcgtccggtcagcgatcacctggtggctgcagtggagggctacgcgccgctgatggcaaaagcaccgaaagtgtttaacttcttcctgcgccagccgtggctgaaagagataagtaaaacccatatcggtatggtcgatctgcctctgctttcggccccaaatctgaaacagcagctcagtggtcatcccgccatgaacatgacgctggagcagctggaagggctgtcagccgctgaacgcgcaaactgtgtgctggtggtgcaggatccttttaccagcttctatgaggcgcagctggttaacgattttgtcaggctgattgagaaactgggctaccggcccgtgctcctgccattctcgccaaatggcaaagcgcaacatgtgaaaggtttcctgcaacgtttcgcccgcacggcgtcccgcaccgccgatttcctgaatcgggtggcaaaactggggttgcccatggtcggtgtcgatccggccacggtgctctgctatcgcgatgagtatcgtcagacgctgggcgaatcacgcggcgactttaacgtcctgctggtgcatgagtggttagagcgtgcactggcagagcgtgacgtgcaggccacgggcggagaatcctggtatctgtttgcacactgcaccgaggtgaccgcgctgccctccaccccgaatcagtggcaggcgatcttctcccgttttggcgcgaagctggagaacatcaatgttggctgctgcggtatggcaggcacctacggtcacgaaagtaaaaacctcgaaaactcgctggggatctacgcgctctcctggcatccccagcttcagcgcctgccacgccagcgctgcctggccactggctattcgtgccgcagtcaggtcaagcgtgtcgagggcaacggaatgcgtcatccgcttcaggcattgttagagctaatgtaaaaaaattgtgcgcgacgtcacgccctggctggattagaatatccagcctgcgtgacgcatgaagtcactttgcagcgcagtggcctggttccactccccgaccattgccagttgatggcagaggcgggtcagggacaatcgcgccagttgataagcctgaaggcgaaacaggcgatcgcgatcgctgtttcccatctcctgcaccagtcggtgatgcagtttacccatggcatgcaggtaactctggtcgtcaccgttcaactggcagatttctgccatatcctgacaggcatcgttaaactgacgtagctgatgaatcgtgcagtcggcccggtcgagctttgcctgcgccatataaaagtcgacggtgatatcacgcaccgcaaactgatattcgtcgattttgtgctgcagccaggctgagacagaaagcgtcataacgccaccctgaatgtgaatgataataattatcatatttaattgagctgtgattgcaattggcgggcagaaaaatttatcgatttatcctgcctgtcggtataatcggaaataacaatctgtttacatcgcagaaaggcgtaacctatcaataagcatttttatcaaaaatggttatttaaaaaagagtgatttattaataggttaacactggcttatttatgctgacgcgctcaccacaaggtgagctgaagaggctatgcttaataattaagcaaataaaaccgcacaagatgattatccctgcaaaacaagaggttgaagtgattggtcagatcactaccatagggggatagcctgaaaaggtccggactcaagaggtatcaacatggcatccgttaatacagactctttctcacccgacgattttgtctggaaagggctgacgctgactgaaaccgcagcgcaacaaattctcaatctggcggctcaggaccccgatgtcaagggtctgcggctcggcgtaaaacaatccggctgcgccggttttggttacgtcatggatctggtgaaagagccagtcgaggatgatttgcagttctcattccatggcgcaacgctgtttgtgccgctacaggcgatgccattcgttgatggcaccgaactggactacgttcgtgaaggcctgaatcagatttttaaattcaataaccctaaagctcagcacgcctgcgggtgcggtgagagctttggcgtcgagtaagtgaaatatgtcacgacacagcgaaacatctgacgatgtacaaatctgggaaggcaagctcaactacaaagagggcttctttacccaactgcaaaccgaagaatttgccaacggcatcaatgaagatgtggtgcgggcgatttcggccaagcgtaacgagccagagtggatgctggagtttcgtcttaaagcgtttcgtgcctggcttgaaatggaagagccacactggctgaaagcgcactacgaaaaactcgactaccaggattacagctactactccgcgccttcctgcggcaactgtgatgacagctgcgcatcagaaaacccggtgcactgcaggcttcaggcagcgcgccagccagcgattatctgacacaggaagtggaaaacgcctttaatcagctgggtgtcccggtgcgtgaaggccgtgaagtggcggttgacgccatttttgactccgtttcggtggcgaccacctatcgcggcaagctggcggagcaggggattatcttctgttcctttggcgaagcgatccaggagcacccggagctggtgaagcagtatctcggcacggttgttccggcgaacgataacttctttgcagcgctgaactcggcagtcgcctctgacggcaccttcgtttatatcccgaaaggggtgcgttgcccgatggagttgtcgacctatttccgcatcaacgcagcgaaaaccggtcagttcgaacgcaccatcctgattgccgatgaagacagctacgtcagctacatcgaaggctgttcagcgccagtgcgtgacacctatcagctgcacgcggccgtggtggaagtcatcatccacaaaaatgccgaagtgaaatattcgacggttcagaactggttcccaggcggcgaaggtgaggggggtatcctgaacttcgtgaccaagcgcgcgctgtgtgaaggtgaccacagcaagatgtcctggacacagtctgaaaccggctctgctatcacctggaaatacccaagctgcattctgcgcggggactattcggtgggtgaattctactcagtggcactgaccagtggtcgtcagcaggccgatactggcaccaagatgatccacattggtaaaaacaccaaatcgaccatcatctccaaagggatttcggccggtaaaagtcagaacacctatcgcgggctggtgaaaatcatgccaaccgcgaccaatgcccgtaactttacgcagtgtgactcgatgctgatcggtcctgattgcggcgcacatactttcccgtatgtggagacccgcaacaatactgctcagcttgagcatgaagctacgacatcacgtatcggcgaagatcagatgttctactgtctgcaacgcggtatcagtgaagaagacgccatctcgatgatcgtgaacggcttctgtaaagacgtattctcggagttgccactggaatttgctgtggaagcccagaaattgttagccatcagccttgagcacagtgtgggctgatgccgtcacacgcgttgccggaagcaatgtgaaggaataagtatgttaagcattaaagatttgcaggtcagtgttgaagataaagccattctgcgtggcctgaatctcgaaattaaacccggcgaagtgcatgccatcatgggcccgaacggctcaggtaaaagcaccctgtcagcgacgctggcaggccgtgaagattatgaagtaaccggcggttcggtcagcttcaaaggtaaagatctgctggaactggcccctgaagagcgcgccggtgaaggcatctttatggcattccagtatccggtagaaattccgggcgtcagcaaccagttctttttacagacctcggtcaatgcggtacgcaaatatcgtcagcaggaagagctggatcgcttcgatttccaggacttcattgaagagaaaattgagctgctgaagatgccggcagatctgctgacccgctcagtcaacgtcggcttctccggcggtgagaagaagcgtaacgacatcctgcagatggcggcactggaaccagaactctgcatcctggatgagaccgactcaggcctggatatcgatgcgctgaaaatcgtggcgaatggcgtaaacagcctgcgcgacgaaaagcgtgcctttatcatcgtgacccactaccagcgtattctggattacatcaagccagacttcgttcatgttctgtatcagggcaaaatcgtgaaatctggcgacttctcgctggtgaaacagctggaggagcaaggttatggctggcttaccgacgaagagtgattctgcgctgcaacagtggcatcacctgtttgagtcgcgcggcgacgtgcgtttctctgcaggcacagcagcactggcagcaactgatgcgcgttggcctgccaacccgcaagcacgaaaactggaagtacacgccgctggacaccttactgtcacagcagtttgtactgcctgacgcgccgcagaccctgagcgctgaacaggttgatgcactggcgctgccgctggatgcgatccgtctggtctatgttgacggtcagttccagccagccttcagcagtcgcgactgcgaactgtttgaggttcagcacagcgtggccgccgagcgccgtccgctgcctgctgcggttcagcctgaagtcttcctgcatctgacagagagtctggcagaggaggtgacgaccctgcgtctggcgcgcggtaaatccgctgcgcgtccggtctatctgctgcacatcaccagcggtcagcagacgggtatgaacacagttcactatcgtcatcacctgcagctggaagagagtgccgaagcggaagtgattgagcactacgtttcactggatgagcgcgcccatttcaccggcacgcgctttacctttgcggtaggcgacaatgcaaaactgacgcacacgaagctggcctttgaaagcagcgccagctatcactttgcgcataacgatctggtcattggcaacgatggccaggtcagcagcaccagcttcctgctgggtgccggactgtcgcgtcacaacaccagtacccagctgaacggcgaaaacaccacgctggcgatcaacagcctggtgctgccggtgaaacaggaagtggcggatacccgtacttacctggagcacaacaagggccactgcgtcagccgccagatgcataaaaccatcgtgcgcgacaaaggccgtgcggtgtttaacggccacattaaagtggcacagcatgcgctgaagacagacgggcagatgaccaacaacaacctgttgctgggcaagctctcagaagtcgataccaaaccgcagctggaaatttatgcggatgacgtcaagtgcagccacggtgccaccatcggtcgtattgatgatgagcagatgttctacctgcgttcgcgcggtattgagcaggatgctgcacagaccatgattattcatgcttttgccgcagaactgaccgaaacactggaaaatgaggtgatgcgtcaggccgtgctgcagcgtatcgcgcaacgttttcccggaggcgacatatgatgaacttcgatctcgaacgcgtcagggctgattttcctatcctgaagcgtgaggtcaacggtcatccgctggcctatcttgacagtgcggccagcgcacagcgtccactctcggtgattaacgccgagagtcatttctatcagcacggctatgcggccgtgcatcgtggtatccatacgctgagccagcaggcgaccagcgacatggagaacgtgcgcgatcaggctgcccgttttatcaatgcgcagtcacaggaagagattgtcttcgtcaaaggcaccaccgaaggcatcaatctggtggcgaacacctggggcagcagtaacctccaggctggcgataacctgatcatcactgagatggagcatcacgccaatatcgttccatggcagatgctggcccagcgcaccggcgcagaagtgcgtgtcctgccattaaatgacaacggtgagctggcgctggagcaactggcggggctgatcgacagccgtacgcggttgctggcggtgacgcatgtttcaaacgtgctcggcacggttaatccggttaaggcgatcgttgctcaggcaaaagccgctggcgtggtaacgctggtggatggtgcccaggcggtgatgcatgacaaggttgatgtgcaggatatcggctgcgacttctacgccttctccagccataaactctatggccccaacggcgtgggtatcctctacggccgtaaagcgctgctggatcagatgccaccatgggaagggggcggttcaatgattgagcgcgtcatgctgcccaccggcaccacctggaacagtgcgccgtggcgctttgaagcgggtacgccgaataccggcggcattattggctttggtgcggcgatggcctatgtgcaggcgctgggactggatacgattcatcagcgcgagacggcactgatgaactatgcgctcgataagctgggcaccgttccggatatccagatctacggtccgcagtcacgagctggcgttatcgccttcaatctcggtaaacaccacgcctacgatgtcggcagcttcctggatcaatatggcattgccatccgcaccggacatcactgcgcgatgccgctgatgcagcattacaatgtaccggcgatgtgccgtgcctccttcacgttctataacagtgaagaggaagtggatcgtctggctgccggtttgacgcgcattcatcgtctgctgggcggctgaacagttttaacggagtcactgatggcgaatttgcctgaaaaagagaaactggttcgcaacttcaaccgttgcgctaactgggaagagaagtacctctacattattgagctgggttcaaagcttccggaatcttctgaaaccttgcaccagccggagaacgtgatttcgggttgtcagagtcaggtgtggatcagaatgaccccgcaggcggatggttccattgcgtttgaaggcgacagcgatgccgctattgttaaaggtttgattgctatcgtatttagcctctatcagaacctgccgcccgccgatatcctggcgctggatgtgcgccactggtttggagaactggcactgatgcagcacctgacgcccacccggtcgcaggggctggaggcgatgattcggtctattcgccataccgctcagaacctcagctaagttacactccacagacgccatccggcgtctgtttttttatctgacgagaaaattgcatgaaacctgctttacgtttagccggtgcattgctgctgacctgctttgggctctctgcacccgcgtttcgccaccgaatatccgctgccaccacctgacagtcgcctgattggcgaaaacgtcgtgactcaggttcctgacaataagcaacctctggaagcgattgcggcgcgctaccaggtcggcctgctgagcatgctggaggcaaatcccggtaccgatccctggctgcccaaagcgggcacccagctgacggtgccgctacagatgatcctgcccgatacgccgcgcgaagggattgtggtgaatctggccgagctgcgtctctactactatcccaaaggggaggataaggtcattgtctatcccatcggcattggccagctgggtgcggccacgccagtgatggtgacgcagatcagccagaagatccctaatcccacctggacgcccacggcgaacatccgcaaacgctacgccaaagagggcattacgctgcctggcgtggtccccgccggaccggataacccgatggggcagtttgccatgcgtctggcgcgcggcaccggccagtatctgatccatggcactaatgcgaaattcggcatcggcatgcgcgtcagttcaggctgtatacgtctgcgttcagaagatatcgaagcgctgtttaactcagccccgaaagggacgcgggtacagatcatcaatcagccggtgaagtacgctgtagagccggatgggaaacgctacgtggaagtgcatcagccgctgtcacgcaacgataaggacgatccacagaccatgccgattgcactcactgccggagtgaagcagtttatgaaaagtgagaagagtgatagtgcgctgattaaagccagcttagcgcgacgctcaggcatgcctgtgctggtcagcagtggggagccggtgcagagtgatacggtgccgcctgcagggctggagagcgcgtctgtgggggctgatagcccggtgacacaggctgatagcccggtgacacaggctgagggcaacgcggttcagccctgaacggataagtgcctgtgaagggcactgaattcggagcaaaaaaaatggcgccataaaggcgccatttttaaaccagaactcttacttacggtaagagtgagcctggttgtccagacgctggttagcgcgtgctgcgtcatctttagcagcctgaacgtctgaacgcactgcgttcacgtcgttgctcagctggtcaactttagcgttcagagtctgaacgtctgaagacagctggtcgattttagcgttgcttgagcaaccagccagcatagttgaagccagaactaccgcgcccagtaccagtttagtacgattcattatttataccctctagattgagttaatctccatgtagcgttacaagtattacacaaagctttttaagttgagaataaatttttgatgagaagatgcttaaatttgatcgttcgctcaaagaagcagcgaatcacagaatatgataaaaaaatttagcgaaaacagagagatttaatcggattaaccttaatattaagagtatttgaatagttattttcgattggaattttctgacatttggtttaagtagaaataaaaaaaagcgcccgataaaggcgcttcaaaataatggtcagagagagttttacagtacgtgtacagaagcggtgttggtagttccgcttggtactaatgcgcctgacaccagtaccacgacatcgcctttctggccatagccactttccagcgccgcttctttacccagacgatagaaatcgtcggttgaagcgatctcagtcaccagacgtgtctcaatccctttgctcaggatcagctgacgggcagtcatcggattggtggtcagcgccaggatggtcgcgttcgggaaatatttacgtacggctttagcagatttacccccttcggtagcaaccacaatcagtggcgcttccagcttctcagcggtctctacagcaccacggcagacggcttctgtgatacgcattttgcggttatcactctggctgtcgatgcgggacttcatcacgcgatcggtacgctcacagatggtcgccatgatggtgaccgactccagcggataacggcctttggcgctctcacctgacagcatgacagcatcggtaccgtcgagaatggcgttcgccacgtcaccggcttctgcgcgggtagggcgcgggttcttgatcatggaatcgagcatctgggtagccgtgataaccactttgcgtgctttattacattttttgatcatcatcttctgcgcgaagatcacttcttcaaccgggatctcaacgcccagatcgccacgcgcaaccatgatgccgtctgacgcttcgaggatttcgtcgaagttgttcaggccttcctggttttcgattttggagatgatctggatatgctcgccgccgttctgtttcaggtgctcgcgaatttccagcacgtcggaacgtttacggatgaaagaggcggcgacaaagtctacgccctgctcacaaccaaaaatcaggtcgcgtttatctttttcggccagtgctggcagctggatagagacgcctggcaggttaacgcctttgttttcgcccagatcgccgttgttcaggactttacacaccacggtattttcagtgacttcgatcacttccataccaatcaggccatcatcgaccagcaccgtgttgccgattttcaggtcagcagtgaagcccgggtaggtcaccgcaacgcgctcgctgttgccaatcacgctctggtctgtagtaaaggtaaaggtctgacccgctttcagagccgcatcgttgccgccttccagtttcatggtgcggatttcagggcctttggtatccagcagaatagcggcctgacggccggttttttgcataacggcacgcatgttggtgatgcgttggccatgctcagcgtagtcgccgtgagagaagttaagacgcataacattcatgccagcttcaagcagctgagtcagcatctcttcggattcggttttcgggccgattgtacaaacgattttagtctttttcatgacggattttctgtaagttgtgatggatgaataagggcggaatccgatggcagcgcatcgaagtgaaatttctgattgagactgaaatgggcagtactgagtaagaataggtgacgaaggccaggcgtgcagggaagttgtgcggttacggttggtaaccaccacgctgttgttgcgcaaatcatttgagttatcgcagtaagcacgtgatcgctgaaacctttcaagtaagcaacgcgggacagtatagacgctaagtatgcgaaaaccaatcaaaaagcagaagggggaagcgatgcagatcaataaaagtggagttgcgcaagctgaaggaattctgaaagtggtgcgctctaatggactcgaaccatcgacccccaccatgtcaaggtggtgctctaaccaactgagctaagagcgcatactgaatattggtgcgtccgagtggactcgaaccaccgacccccaccatgtcaaggtggtgctctaaccaactgagctacggacgcacttggtgcgctctaatggactcgaaccatcgacccccaccatgtcaaggtggtgctctaaccaactgagctaagagcgcaacatgctgtcagggcgacagcggggacgaatattaacggcagcgtgtgaggctggcaaggggaaaatagttttttcgccatgactgcacagcaactgtgctaaccgtcgtttttttcgtcattgcgggccatgaatgacccgcctcgaacgttatcgcgctgcacgcgtcaggataatttccgccggtgattgctgtaaccgtctgatgcgccatatcatcatcaccgcagccgaggtcaggccgataataaagccgcaccagaagcccgcaggtcccatgcgcggcaccacccagtcggtcagcgccagcagataaccggctggcagccccagcagccagtaagcgataaaggtaataaagaaaatcgaccgcgtatctttatagccgcgcaggatcccgctgccaatcacctgtatcgagtctgagaactgataaattgccgccagcaacatcagctgtgccgccagcgtcaccacttcagggttgtcgttatagagcagggcaatctgatgacggaacgtcacggtaaaaatggcggttagcgccgccatgctgatgcctacaccctgtgcggtccaggccgcgacccgtgcctgctcggtggagccctggcccagacgataaccgacgcggatggtggtcgcgacacccagcgacagcggcaatacgaacatcagtgaactgaaattgagcgcaatctggtgaccggccacgttaacgatgcccagtggcgaaaccagcagggcgacaacggcgaacagcgtgacctcaaagaagagtgccagcgccaccggcaatcccagcgtcatcaggcggctcagaatcggacgggaagggggtgaccagcggctctccatacggatatcgcgcatgctacccatccggcgcacccagaagcgcatgcagataaacatcacccagtagaccgaggcggtcgccacgccgcagccgacaccgcccagggctggcatgccgaagtggccatagataaagacatagttaagcgggatgttgaacatcaggcctaaaaagcccagcaccatgccgggtttggttttcgacagcccctcgcattgattgcggagcacctggaagaagaggtagccaggcgcgccgaaacagcagggcatgcagatagccttctgccttcagcgccagcactggatcaatgtcatgcatcgcccggataagataaccggcatgccacaacagcaccataatcagcagggagacgaaaaaggcgagccagtatccctggcggatctgttcaccgatgcgttcgcggcggccagaaccattgagttgcgcaacggtgggcgtcaatgcaagcagaagaccatgaccaaacaggatggccggtagccagacagaggtgccgacagcaacggcggccatatccgtggcgctgactgcgccggccataatggtatccacaaatcccattgcggtttgagccacctgagcaaggatgaccggaatcgcaagggccagcaattgacgcgcttctgttaaatacttctgcacgttaacacctgacttattgaatgaattaaaaggggcaggaagcccggggaatttcgcgagctagtgtaactggcgtaacagaattcgccaatctttgtcacacaatgcggtttgctccgctataaagcggcggtgcgggctgaaatctaacagccgacctgagctgtgataaactagcgtaaacttcgcagaggcaaagactatgtttaccggtattgtgcagggcaccgcagaaatcgtgtccattgaagagaaagaactgtttcgcacccacactgtccgcctgccggaagagctcttaccgggtctggcgctgggcgcatccgtagcccataacggttgctgtttaaccgtaacggcaattgaaggcgaccgcgtcagttttgatttaattaaagagacattgcgggtgactaaccttggcgatttacgtcagggcgatgtggtcaatattgagcgtgcagcgaaattcagcgatgaaataggcggacatctgatgtctggtcatattatgaccaccgctgaaatctgcaagattatccagtcagaacataaccgcgaagtctggtttaaaatccaggatgcggcgcagatgaaatatattctgcataaaggatttgtcggcatcgacggtatcagcctgacggtaggcgatgtgactaagactaagttctgcgtctatctgatcccggaaacgctggagcgtaccacgctgggggcgaagacctttggcgatcgggtgaatattgaaatcgatccgcacacgcaggcaatcgtggagaccgttgagcgggtgttagcacagcgcgatgccgcggcggcgatgagcatgctgaccggccagtcaacgacagagagttgataaaaggcgcgtaagcaccgcagacagcccaatcggttttactctgtcagcattataaaagcgcagggcgccgggtcagaagaggaaagcgtcccgccgcccggataaaaacgccgggagcgtttttgaacaacgcaaagcgttggcccggcaacgggcgtacctcagggatgaggtgcgtaatcgcgtgggccgggcgtgtcagggatgacgggttttgcgactttccgatctgaccccgttccttgcgcaacgctccctgttaaagcaaaacaggcccttcttttcaagtgttcagccggggcagcgccttcttaattgcccgctttttaacccctaccgcgccacccgtaatcccccctcaacaccgcgactgaacacgatctgccacagctgaatatcacgcgcccggaaggcaccggcacaggcattcagataataggagaacatccgtttaaagcgtttcgccatatttatcggccagctctggccaggcctgcaaaaagcgttcatgccaggccatcagtgttttatcgtagtctgcgccgaagttgtgccagtcttccagaataaaatggggttcgctggcatcggccacatggcgcaccgaaggcaggcagccgttggggaagatatatttatcgatccagggatcgacactcatatcggttttaatcgcgccgatggtgtgaagcaggaaaataccgtcaggctttaaattacgatcgaccacgtcaaaataggtcgcgtaatttttcggtccgacatgctcaaacatacccaccgacacaatacgatcaaactgctcattcagatcgcgataatcctgcaacagaatcgtgacgtctaatccgctacagcgctgctgcgccagtttctgttgttcggcggaaatcgtcacgccatgcactttaacgccataatgacgtgcggcaaattccgcgagtccgccccagccacagccgatatccagcagtgacattccaggttccagcgctaatttacggcagatcatatccagcttggcttcctgcgccgtcgccagtgtcgtcgcctctttccagtagccacaggagtattgcatatagggatcgagcatcagtgaaaagaggtcgttgcccaggtcgtaatgctctttaccgacaatccacgcccgtttttttgactgcagattggttaagcgtgcggcggcaatgcgcagcgtatctttgaagtgatgaggcagctgctgatcgagtttatgtttaagtacctggtggaagaaaatatccagccggtcacactcccaccatccatccatatagctctcaccgagcccaagagagccctcctgcagaacacgtttaaaaaaaccaggatgattaatatgaatatcccagggacgtgaaccattaatttcgatatccgctttttccagcagctcatgaacgatgcgataccaatggttttcttcgaggctcacttcttctgcataagatgaactcatagattttccaccacctgtccaatctgaacctgaacaaagagtagccaatttattcaggcaatgagaaacgatgcggatggctccgcaaaccggttatctgtgtgatacagaggactggaacagcctgcagcaggtcgggtaaggtgagaataacgcgcgcgaataccgtcccggcagcagagtgccaatcagattattacgttattatattgttgatttattacagatttgttgacccggatgagtatatgctcacgcgggtcaatattcaataacttattgttagggcgctaactaaaaagtcagtgtgtcactgattatcctggcaggcagtttgcgcagaggcaacaacagtttgtgcgcttgcggcacgctgcatggcgtaacccaacagcgccagcacaattgtcaccgtcatcatcagtgtggtggtaaatagcggctgagttaagccggccgacaccgccaggctggcagcgaaacagagtcctaactgcagtgtgttctgcaacgcagcggctttaccggtagcggtcgggaagggcatcagcgcactggacaccacaatcggatagatcgcgccgttagccagcgccataccgcagaacggtaccatcagactcaccagcgtgctgctgccagcaagcgcaacagcaaacagcgccagaatgctcaggctgtagacggccagcagccagggcagcaactgtgcgccgttaaagcggttgagcagggtgcgacagccgaagccgccaattaaaaaggcgagcgtctggggcacataactcagaccgatatcggcgggcgacagacccagatccgccagaataaagggcgatccggtcagccaggcaaagaagctggcggagcaggcggagtagatcagcacgttgccgctgtaaacccgggatttaagcagcgtgaaaaagccgggctgcgcacctttttctcccgcggccttgcgcacggtgggcagacgcagcgtggtcagaattaacgccaccgcaatcagcgtcagcaccaggaaaatcgaacgccagtggaagtggccgatcagccaggcacccagcagcggagccagcgccggagagagcgcaaccagcggcataatggtggcaaagactttgttagcgcgcgctgcagggtagcgatccaccaccagcgcctgccagcttacggcagcggcacagacgccaatcgcctggacaaaacgcagcgccagcatcagatagatatcattcacccacagcatgcctgcgcagccagcgccaaacatggccagtccggacagcagcaccggtttacgaccgatgcgatcggaaagcggtccccagaagagctgacccacggcgaagccgcccaggaagagactcatactggcgctgatcagaccgggtgaagtgttaaaggtttgctgcatcgcaccaaaggcgggcaggtacatatcagtggctaaaaagcccagcatgctcagcagggcaaggtagggcataaaccctttattcgacagcatctgattctcatttttgcaggataaacgcggcagagtgtaaaaggtgcgtttgctgctgtgaaacggtaatatttgccgattgctgttaaaatttttgaaggcagattatgtggtcagaatatgcattagaagtggttgacgctgtcgcccgtggggggagcttcagcgccgccgcgcaggagttacatcgggtgccctctgccatcagctatacggtgcgtcagctggaaaactggctggcggtaccgctgtttgaacggcagcatcgcgaagtggttctgaccccggcgggtgagcattttgtccgggaagggcgcagcgtcatcaaaaaaatgcttgccacccggcgacagtgtcagcagctggctaacggctggcgcggccagctaagcatagccgttgaccgtatcgctaaacctcagcgcacccgacaactggtcaaagatttctatcgccactttcccgatatggagctgattatcagctatgaagtctttaacggcgtctgggatgcgctggccgatggccgggtggaagtggcgattggtgccacgcaggcgataccggtgggcggacgttttgcttttcgggatatgggcacacttaactggcgctgcgtggttgcgcccgaccatcctctgacgcaggcgagccagatagatgatgacacgctgcggagctggccatccctggtgctggaagatacttcacgggcactgccgcgtcgtatgacatggacgctggataaccagcgccggctggtggtgccggagtggcaaaccgggctggattgcgtgcaggcgggattgtgtgtggcgatggtgccgggtcatctggccaggccactgctcgacagcggcgagctggttgaactgacgctgccggtggcgtttccggacagcccatgctgcgtcagctgggcagaggatcgcgcatcaccggcgacaggctggttgctcagctatctgggtgatgcgcaaacgcttaatcaggagtggttaagcgagcattaacggcgatagtcgcggaacgggccatcggccacggaacggcgctcaatcagcgtgggatggacctcaatcgtttgtgacacttcgcgtttactggtaatgcggtccagcagcatttccagcgctttctcacccagctgggctttaggctgatgcactgtggtcagggccggtgcaaaataacgggcgttgcgcacattgtcatagccgatcaccgaaatatcctgggggacgcgtaaacccatctcgtcggcggcgcaaatcgcgcccatcgccatgatgtcaccgccacagaacaccgccgtgggacgctgcttctgcgacaggatctgctgcatcgcctgatagcccgactccggctcaaagtcaccctgcacaatccactcggcgcgtggctgaatacccgcttcttccatcgccttcaggaaaccggcatgacgtccgccaccggtgttacgctccatctggccggggattgcaccaatatcccggtgtccgcgttcaatcagatagcgtcccgccagatagccgccctggaaagcattatccagtaccgtgtcggtgaagtcagcgcgcgactcgccccagtccatcaccaccatcgggatattgcggttctcttccagcatctgcagcagatcgtccggatattcagaacacatcaccagcagcccatcgacgcgtttctgcgccatcatgctgagataggcgcgctgtttttgcagatcgttatgcgcattacccagaatcagcgtatagcctttgtcaaagcagtgattttcaaccgcttcgataatttcagcgaaatagggcgcttcgctggaggtggcaagcaggcccagcgttttggtgtggttcactttcaggctgcgcgccacggcgctcggcgagtagtgcagttctttaatcgcctgccagaccgcgttgcgcgtctcttcagccacaaagcgggttttattgatgacgtgcgaaacggtggtcgttgagacgccagcgcgtttcgccacatctttaattgttgccatgaaaatcggactccagtgcttatctaactctatgataagcgtagtgttaaacgtttgcgtctgctcagggttttttccgcaaaaatgcagcttttaaggccagtcaacaggccgctggcggcgtaaaaacgcctgaaaacgtgcgcaaacggaatcagggttgcgcgcgttgcgcaacaaaggcgggattctaacaaggctgaacggataaaacgagatttttaccgggccctgtgggaaaatgcgatacccctactgattgtgtgactaaggagcaagcaatgagtaccgatcttaaactggctttaatgaccaccgcgggctgtctgctgatgattgtggcctttagttttaccgctattctgcactaaaaaaaagccgggattatcccggctctcttctggttgatctgctgctcagcgtatggtttttggcgtcatcacccgacgggcaccaatatagtgacgctgccagtaatcttctcctaacgcgctgatctgaatatctttgccggtgcgtggcgactggataaactttccatcacccaggtaaacgccgacatggtccgcagtaccgcgtccattgatacggaagaagaccagatcgcctttctccagcgactcacgcttgatcggggcggcgtcacgcaggtggtacatctcgttagcggtacgtgggatcttaaacttcaccagatctttataggcgtaccagaccaggccgctgcaatcgaaaccggtatggggagaggtgccgccccactgatagggtttacccaactgacccatcagcttggtcatcgcggtttcgcgggccttctgatagcgctgacggtgagatttgctcatcttaatcgtgccggtctcgctggtggtgacctcagcggttttcagcaggcgctgatgaccatagcgtttcttctctttgttcttactgagacgggcggtttttagcgaggtcttcttagcaggcgtctgttttgcggtgagttcgacttttttcagtttttttgtttttagtttttgaaccgggctgaggcgagtctttttcgtcaccgttttgaccgggcgacgcttgcgacgctcatcgtcgcgcgcactctttttctctgctttatgcgtactgacgttcaccggtgcgtgaggcgacgcagcggcgatgttgaaaaacagttgcgcaaaggccagcatgaaaaacgtaatgattaaacgcatagtccgttgattagttaagttgtcagggccactacgcaccgcgacaaagttgagattaatctgatccaggatcagcgcccaggccattctagtccagttcttttaaaaactgtaatgccttttaatattaatctttgcaacccacgcaattgtgctgaaaatgaacattttcagcgtcttatatcaacgaaattattacgaattattaatctgttacctgctgttaataatcaggaattcaggtgtcccggagcaggacttaacaatgatggcgatttaatcgggcagcgatcaaaatctcgttttcagtcacgctgcgaagtcgctacaataaacaaacacgatgtgacgaattaaggaaggcaattatgagtactgtagaaaaaattcagcgccagatcgcagaaaacccgatcctgctgtacatgaaaggttccccgaaactgccaagctgcggtttctctgcacaggcggtgcaggcgctgtcagcctgcggtgagcgttttgcttacgtggatattctgcagaaacccggacattcgtgccgagatgccgaaattcgctaactggccaactttcccgcagctgtgggttgatggcgagctggtcggtggatgcgacatcatcgttgaaatgttacaacgtggtgaactgcagacgctgatcaaagagactgcagaaaaatttaaagaagcagaataaaaaaaggccgacatcacgtcggcctttttcattgcggcatcccttatgcggatgtcgtggcttctgcatcgccttccgcgaagggcagtggccagccgcctaaccgtttccagcggttcaccagctcgcagaacagcgttgccgtctgctgagtgtcatagagcgcagaatgcgcctgcgtgctgtcaaactccattcccgccgcaatacaggccttcgccagcaccgtctgacccaataccagtccactcagggccgcggtgtcaaaggtggcaaacgggtgaaacggattgcgcttcaggctggctcgttccgccgccgctgacataaagttcaggtcgaaggtggcattgtgcgccaccataatggcgcgattgcagccgctgtctttaatgcccttgcgcaccattttgaaaatggcgtgcagtgcctcatattcactgaccgcgccgcgcagcggattgctgggatcgatgccagtaaaggccagggcttcgggatgcagcagcgacccgacaaaaggttcgacgttgaaatgcagcgtctggtcaatctgaatccatccctcttcatccattttcagcgtgatagcggcaatctccagtaacgcatcggtttgcgcattgaaacccgcggtttcaacgtcgatcaccaccggatagaagccacggaaacgttgattgagtgcattaggggaattcgattcagacatcaggatctcgttgcagaaaaagggcagcgcgtattatggcaaaaaacggggccgggtgcagcagatgaagcgcagagaaggggattcagcccacccgatcgggcgggctgacaggcaggtttagttgccgaggccgttaccggcatctttgttttcgatcagctcgattttgtaaccatcgggatcttcaacaaaggcaataatggtggagccgcctttaaccgggccagcttcacgcgtcacgttgccgccatctttgcggatacgttcgcaggccgctgctgcgtcatcaacgcccagcgcaatatgaccataggcatcaccgagatcatacttatcgacgccccagttgtaggtcagttcgatcaccgcaccttcgctctcgtcggtgtagcccacaaatgccagggtatatttgtattcggtgttttcgctctgacgcaacacgcgcatgcccagcacacgggtgtagaaatcgattgaacgttgcagatcgccaacgcgcagcatggtatgaagtaaacgcataacatcctcttttaaataaaacgccatcgcccgatgactcaggcgctaagtatagcgatgaaaatcgctattgaataatggctgccgtcatcatcccggacggcagcccgaaccggttacagcgtcgggtagtcgatataaccttccgcgccgccgccgtagaagctttccggacgctgtggattgagtggggcatcctgctgcagacgctcaaccagatccgggttagcaatgtaatcgcgaccaaacgcaaccgcatcgatcagaccgcgaccaatcaggtcatccgctttctcaacggtataagcaccggcaccaatgatggcacccgggaagagatcacgcactttctgacggaaggcgtcggtgtaaggctgaccgccggcccagtctggctcggaaaggtgcagataggcgatgttgcgttttgccagctcgccgatataccacagcgccgcttcctcttcatccgggccgttgtccagattctggaagctgccgataggtgagacgcgaataccaatgcgatcggctgaccagttagcgatcaccgcatcaaccacttccagcgcaaagcggccgcgtttttcgatgctgccgccatattcatcattacgctggtttgagccaggagccaggaaactggtgcatcaggtaaccgtgcgccgagtgcagctcaagcaggtcaaagtccgcttcacgcgcgttggccgcagcctggccaaaatctgccacgatctgcttaatctctggcactgtcagctcacgcggcgttgaggtatcttcgcgatagacgctgccatcttcagcacgcagtgaggtacgggtgccagcggcaatcgccgatggcgcaaccggtgctttgccttccggctgcacgctgttatgtgagatacgaccggtgtgccataactgtactgcggtgtgaccgccagcctgatgcacgccttcgttaatcgctttccacgctgcaatctgtggctgagtatgtaagcctggcgcaccggcatagcctttcgcctggaaagagatctgggtcgcttcggtgatgatcaaaccggcgctggcgcgctggcgataatattcagccatcatcggggtagggatgtcgcctggctcaatgctgcgcagacgggtcagcggtgccataaatacgcggtttgggacggtaattgcaccgacttttagcggacgaaacagctgggtactcgccataatagctcctgattagtagaccagtcgtctacaaacatgttttttaaaaatcagcggcgttcaagccactgttcgatggtactcaatgccagacgcagtggctgcgcctcgcgggaaattttgctctgcaggctggcacccagccacagcagcgacagcaattccgccatctgcgcggggggctgcggcaggctcagcgactcctgctgctctgcggcaatcagggtccgggcgtagagtgccgtgatctttccggcaccctgctgcaatgcatcacgcatcggctctgagagatcgcacacctccgcggagactttgacgcccagacagcctacgatgtggccctgctgaacaaacagatcaacggcagcacgaaagtggttaagcagacgctcacgcggcgtgccttcggtctggttaagctgcaacgccacatcctgcaggaaacgcgcaaaatagcgttccagtaacgccacgccaaacgcctctttagaacggaagtagtagtagaaggagcctttcggcaccgccgcctgcgtcagcagtttcgctgaggcccattccggtaaagccgcgttgcagacagagttgctcacctgtctggagcaggtgttcgcgggtttcgttgcgttgtagcgtcttattcatggcagtgagattagtagaccagtcggtctaatgcaacgcaaccctctctatttggcacagagtgttcactcctgagtcaaagaacaggataattctggccgggtggggcttacttcctgcgcaaccaggctacgctttttactggactgtttattctgtgaatccggaggcgtggtggccgagcagcttgagtttttcccggttcccagcccctgtcgcggcatctgccagacggatgcgcgcggctactgcctgggatgtttacgcagccgcgatgagcggttcaactggctgcgctttagcgatgcgcaaaagcgtgaggtcattcgtctctgtcagcagcggcgtcagcgtctgcaacggcaacagaaaggcgaggagccgcacgcgccacaacagccggagttattctgacgactttgcgctttccgttatactctctgacacgctaatttcagccaacgcgcaacagggagaacgtcatgttagaaccgcaagccatcgcttcacaggggcccgatttttcaccgctggtcatggggtactggcgtctgatggagtgggggatgtcgccacaggaacgggtcgcctttattgagcaccatgtgaggctcggcatcaccaccgttgaccatgcggatatctacggtgactaccagtgtgaggcggcgtttggcgaggcactgaaactggcacccggcttgcgcgaccagctacagattgtcaccaagtgcggcatcgccacccgcgcccagcctgagcatcagataggccactacattaccgacaaacgtcatatcctgcagagtgctgaaaactcactgcgccatatccacaccgatcgtctcgacctgctgctgatccatcgtcccgatccgctgatggaggctgacgaggtggccgaagcctttatggcgctgcatcacagcggcaaggttctgcattttggcgtctctaacttcacaccatcacagttttccctgctgcaatcccgtctgccgtttctcgctggtgacaaatcagctggagatctcacccgtgcagcaaagtgtgctgctggatggctcgctggatcagtgtcagcagctgcgtattcgtccgatggcctggtcctgtctgggtggcggtcgcctgtttaacgatccccatttccagccgctgcgtgacgaactggaagccgtgcggcaggaaaccggtgccaccagccttgagcaggtggtctatgcctggatactgatgctgccatcgcgcccgctgccaatcatcggctcaggtaaaacggcgcgggtcagcgaagccgccggagcactgaacttatccctgtcgcgtcagcagtggttccgtattcgcaaggcggcgctgggatttgatgtgccctgaagcgtaaaactgcgtcaatctccggcaaaatagtgcaacagcgaccagacttatctcaaaccctggtatgcaaatggagtcaccatgaaaatgaaagcagttgccttattcgcactgatcgcctgcggctcagcactggctgccagcgagcaggttacgatccatcaggttaccgctgaagggattgggaaatcgctgggcaccgttaagattgacgagacacagtatggtctgcagttcacgccggatctgcagggccttcagccgggcattcatggtttccatgttcatgctaaaggcagctgtgaaccgggcgagtctgaaggcaaagtggtcgccgccggtgcggcgggtggtcaccttgatccggccaacagcggcaaacatctggggccttatgcagaggggcacctgggcgacctgcccgcggtctatgtcgatgacaaaggcagcgccacttatccggtgctggcgccgcgtctgaaatcgttaaaagagatcaaaggcaaagcgctgatggtgcacgtcggcggtgacaatcatgctgaccatcctaaaccgctgggcggtggcggggcacgctacgcctgcggtgtaatctgagtttccgggcggcaggcgatggccgcccgcttttctcctgcctgtttatgaattgttgtaccatccctgacatttcccccctatgatattgattcaggtaagaaagcgtgatggggaaaggagcaggaaaatgaaattcaagggcgcattactgctgtgtctgctgctggtgggatgcgataaacccaatgatacgcaactggtcaccgaaaccggacgcgaactgcagcgcaccatcgataccaacccaatgcgtatcacctgtgaaaagatcgcgaagggtcgtgaatggctgagccgcaacatggtgcgtaagctggaagcgcagggttgcgatcaggtctttcgcagcgccaccgaaaccaatttcacggatagcactatttatcgccgtaccatgacgatggtgtgcggtggcattcatggtcagagttttaccggtaccgaactgacacgccggtttatcttctcacccgatgagaaagtgctggtgattgaaccgatgaccgaaatggataaaacccgcttcgaaggccataaaacgctgcaacagctgcaggatgattttaaccggcaacagcagcaatattgccagtgatcactccggcaccgcctgcttcagctgtgccagtgaacagcgtaaccgccagataatccccgccagctcgctggcctcgttgctttccagtgccagtaacgcggtgatggtctcctccagttgcgtcagcattcgatccagcgagctgtggcgcacgccgcggctgctgataatctgctgtaagtcttgcaggcagtgatcgcgaaaccccatcagtgcggctgaaccggcgcgccattcacgcagctgccagacgatatgcgagcagttgagcagcaccacgccccagcgcagtagccagacgcgtgcctgctcgtcccggctgtgactgagctggctgatgcggtggtaaatctgcgattcgaagcggctctcgctgagccggggccgctgccgcagctgatcgagaaacgccagccgcagcgcccggatatgccgtcggctgcgccgcgcatcggagctgggtcgcagaatctggaacgccagccaggcgagcagcaccccgcagactttggcgatgttatcgttaaagaagtcctgataatcccatgtgggcggattagtcaccgcgataaacgagcccataaagacgatgaactgtccccacatcccggcgcgctgtttctgctgcagcttaaagagttgcagcgtcaccagcagcgggaacagaaacagcaaaaactgccacagctgactgatctgcaccatcagcccaaacttcatcacaaaactaaacgcaaacagccacagcagggtcttcagcagcagcgtgacgctgccgccaggtgaaggtgatgaagcgtagagcacacaggctatggcggttaaggtgagcgcggcggcacctgaagaccattgcgtattgatccagaaggcgcagcccagcacgataacgcagaaggtacgcagggcgctccagcccgcctcggcgctgtcactgtcgcgcgccagcgccggaaccggcggtggctgaaagcgggtgtcggcatcggcgcgatccagcaggcggatccagcgcagcacgttgaggtacatccagcagaagtagcgcagccgctgacaaaaagcgcgctgccggtagtcgccatccgctgccggggtcacgctgcgcaggatttgcgccagacgatatttatcacacgccggtttcgccagctccgccagcagttgttgcagcgcgtcaaacagcgcctctggcgcgtcgggccagttcagcagcatgcgtcgcaggctggagagcacgctggtgagtcgcagctgctggtgcagcacatagttcagcacgttgttctgtcggcgaaagcggtagtggctccagaaacgcctgaatccgcagcagattcatggtcaggatctggctgatgacattttcatgcgcggtccggatggtctcgctggctgagggctgcagcagtaataccgcatgttccagcagcctggcatgcatctgtttcagtgaggtaatcagcgtctcaccatcggaggtactcggcagtaccatcatcattaatccggcgcagagaatgccggagatcacctcgcaaacccgtgcctgagcgatggtccatagcgaggtgatatcggtgatgttaacgctgctaaaggcgatgatggcggcggtgtagcccgccagcgaaaaggcgtaggcaacattattctggtagtggttcgctatgccggtacagagcgccagccagccggcaatggcaaaggtaaacagccacggctcattaagcgtatgtccggcgatcagcagcgcagcgctggcccccatcagactgccaacgatgcgccccagacttttactgatcgcgccgccgacggtgggaaagctaatcacggcagcagaggtcattgcccagtacggctcatccagatccagtgcgtaggcgatgctcagcgccaggcacatcgcaatagcgttgcgcaacgcatagcgccactggccggcgttcgccttaatccagggcagttgatcccaggccagccactgaaaattcatggctggatggtgatggtgcagctggttcccgccaccagctctgcatcggcaggaagcgggtcgagacgaatacgcaccggcacccgctgcgccagccgcacccagggcacgttgggtttgatatcgggcaccaggccgctgtcggtctcaatgctctggtcatagatggcgcggccaatgctatccacctgaccctgcagccgcataccattgctgtagagcaccacctgggccgctgcgcctgggtgaatatggcgcagtttggtctcttcgaagtagcccattacgtagtaagagtggctgtcgaccagagcaaacagaggcgaacccgcggtggcatagttgccgggacgcagcgtcagattggtgatccagccatccgccggtgcggtcagcgtcgtctgctgcagattccagcgcgctcgttcccactccgcctgtgccgctttggtgctggcggccgccgcgccggcgcttaatcgcgcggcatcaaggtcctctgcggagatgatgttgcgcggcaggctgctgcgacgattaaattcatgctgcgctttcgcgagatccgcctgcgctttgctgagctgggcggcggcattgtcgagcgcgatctgccatggcaccgggtccagcgttaacagctgctggccctgatgcacaaactgattgtctttgaccttcagttgcgtaattcgtcccgacacctgaggcgtgatatccaccagctctgcccgtactttcccgtcacgggtccagggcgactgcatgtagtagttccagagccagccagcggccagcagcgccagggcaaacacgatcagcgtggagaagtattttaccgcgttaaatttcatatcgattatccgtgaccgatgagccagagtgcggcggtaacgcacagcacaaacagggagagatcaaacagggtgggatgccagacatcgccggagtagatccagccacgtaccagagggtggatcagcagccagaaaaagaagccgaggatcaccgctttgaatatcggcgggaaaaacagtgaggcacccaccaccagatcggtcagcggattcgcacctgaaaaagcaggagtgagcacgtgataacatccttcgttaacccaaacagcagagtgaaagcgctgccacgttatcgtggcctggtccgggatttgtaatttgtcctgtaaactcgcagaatagtgtaaaatctggcttgatagctagcaagctaattataaggagatgaaatggatacgcccctcggaacggatttatctcgcctggtgcgcatctggcgcgcgttgattgatcagcggctgaagccgcttgagctgactcagactcactgggtgacgttgcacaatattcatcaactgccgcccgaacagtcccagattcagttagccaaggcgattggtattgaacagccttcgctggtgcgcacgctggatcagctggaagagaaaggattaataacccgttcgacctgcgccaacgatcgtcgtgccaagcgcattaagctgacgcagcaggccgagccgataatcgaacaggttgagagtgtgattgatgagacgcgggatgacattttgtccggcatcagtcgggaagagatcagtcagatggtgacgctgatcgcccggcttgaaaaaaacattctcgaacttcagcataaagagaaataaaaaaaccgacgcccaggcgtcggttttttgtttagcttcattagcgaggtgaaaccgtcacctggctgccgttggatgccatcacaacacgctggccaacagagtaacgcgtggcggcctgtttctgaaccaccatgatggtgttgccatcatccttacggatttccagctcaacgccatcggttttattgactgcgccctgtacgccctggcctgctacgccacccagaaaccgcaccaccggctgtcgccaggctacgtccgctgccgccgccaatggtgttacccaggaagccacccagcaccgcaccaccgatagcaccgatgacattgctctcatcgccgccctggattttcaccggacgtactgagactaaggtaccgtacgaaacgctctgcacctgcttagcttcactggcactgtaggtatcacccgacagcgtactggtattgctacaacctgccagcatcacaccggccagagcgaccacaattacacgcttaatcatttgaaactcctttagtcgagaaggtgccacgtttaacgctgtatcctgctcacagtataagacacaaacctggcaaattaatccctgtccgaataaaacacggctggacgaagcatagactatgcaggatcaacaataattcaatcgtggactaaaaatagtcccattacgttatcagtcagcacgattggataaaaagaatttaatcatagaattagcgatcattatttgtcaggctaaccgcagatgaatcgcacctcccgccggaagtaaggaatggctatgaaatcaggacgctatattggggtaatgtcaggcaccagcctggatggagtggatgtggtactggctgccattgatgaaaatatggtggcgcagcaggccagctactgccatccgatgccaccagaactgcgtcaggcgattctggcgatatgtcagggacagtccctgacgctgtcgcagctcggccagctcgatacccgcctcggccagctgtttgctgaagcggtagtgacattaatgaaacgcgaatcgcttgacgccagcgatatcacggcgattggctgtcatggtcagaccgtctggcatgagccgcagagtgacgcacccaatacgctgcagattggcgatcataatcagatcgtggcggccaccggcgtcaccgtggtaggagatttccgccgccgtgatatggcgctgggcgggcagggcgcgccgctggtgcctgcctttcatcaggcgctgctgatggatgcttctgaacgccgcatggtgctgaatattggcggcatcgccaatctctcgctgctgatcccaggtcagccggtgcgcggcttcgataccggtcccggcaatatgctgctggacgcctggatctggcgtaatcaggctcagccgtatgacaaagatgcgcagtgggcgcgcagcgggtcggtgattccggcactgctggaggcgctgctacgtgagccctggtttgcgttgccgccgccgaaaagcaccgggcgcgaacacttcaacctcagctggctggagcagcatctgcgctatttcccgggtctggctgcgcaggacgtgcaggctacgctggtcgagctgaccgccatcaccatcacgcagcaggtgttactcaatgatggctgcgaccgtctgctggtgtgtggcggcggcagccgcaatccgctgctgatggcacgactggcagcgcatcttccgggaacggaagtaacgactaccgatgcggcgggtgtcagtggtgacgatatggaggcgctggcgtttgcctggctggctttccgcacgctctccggcctgccgggcaatctgcctgcggtaacgggcgcacgggaaaaaagcgtgattggcgcaatctttccggcgaattcactctaccgacgctaagcggggagtcgggggcaatctgcccccgcaggatgacaggtggccgtcaggcggcgccggagagatgcgtcaggttgcgaacgccagtaatcaccgaggcaaccatggtttcacgtcgggtaatcacctcaacctgataaaaccggctgcggtaggcgatggaatagataacgggatggtacttattaccttctccgtagcgggagtagtgcgcttcaagcgcacgggtcgctgcgagaatatgggagggttctttatcaccgcggatgatttgcttcattcagttcctcaaatgctgtccctggagacacgtcgcacgcatggcgcgtagcgctggcctaaacactgaacatctgactgctaaacatttaatcactgactgggtaatgactgactctgccgcgggaagatgacagaaagatgatcccccggggctgttaactatttagcagccaccgggggatccagcaaggcaggaaatcgcaaattcatccaaatcgcagaggcggtcagatcagctccggccaggctacggccgcaacgccattgagtacaggttttgagaacagaaagccctgaaactgggtcacgcctgccgcttcaagccacatccactcttccggctgttcaatgccctcggcgataacaccgatctccagcgaggagcagcatttcagaatggcatgaatgatcgcctgcttcggcccacttttatgcacatcagcgatgatggttcggtcgattttaatcttgtcaggctgaatgcgcgtcagcagcgacaggccggcaaaaccggcaccgaaatcatccagcgccaggctgatgccggccgccttcagctgcctgatggcggcttcaaaggcctcaggctgcgagataatttcattctcggtgaattcaaccatgatctgctctggcaccagtccctgcgcagctatctcatccagcaaaaacgggacggcgtcgggcacttccaccagcgtcatcggcagcaggttgatcgacagggtcatgccctcaatccccagctgcttcgcctgggcgaaggcgatctttttcgacctcagatcgagctgatagagctgctcacgtgacagtcgggcaaaatagtcgagcggcggttcaccctgcgggccgcgcagcagcgcttccagcgagacgatttcgcaggcgaaggggtcaacgatcggctgaaaagcaaagctgacctcatccgcagccaccagcgatgcgttgccttcacgctgttctgactcgtcacagataaacgtccagccgctggcggccgggatctcaaaatagttctctttttcccgcgcttcgacaaaggtgcgcaggaactgcagtgcgcgatcggcataggtcagctgatactttgtggtgcactttgccagcaccgcctccagtaccgtctctttatcatgcagccgcagatcgaacagctccataccgacgtggccaaaacggcgtgccggggcgtaatcgcgcagcagttcgaccagattatggtggcgtggatcctggcaaatccggctgtaaactgcattgaccgccgcctccggaccttccagcagctggaaaaaatgcgtgccattgaataataaaattccggtgacgcttgaggatttattgattttattcgctttcagcgccaaaccattcaggatctcaagcggcacatgttcggtaatgtggctgcgatagatgattgtcgacaacataaaggtttccggaattttttattttttgttatggcaccctaccagaagcttcttccggggaaaacgagggccagtacgtctttctcactctgactctgttttaatcaaccggcagcgtggtattgcccgttcccagagagcgctgcataaaaacggtatccagccagcgaccctgtttaaaacccaccgagcgcaggatgcctgtcatctcaaagcctgcggcgcgatgtacggcaatcgagccctgattctcgctgtcgccgacgttggcgatcaactggcggaaccctgcctgctcagcccagcggattgcatggtttaacaggcgcgaaccggctccgcgcttctgaaatccaggatcgatgtaaattgagtcttccagcgtatgccggtaggcatggcgcggacgataaggcgtcagataacagaacccacgcacttctccctcgctgacggcgataaaccacggcaggcccgcctgctgaatcttccgcatccgctcgtcaatctctgccgcgtcgggcggcactgtctcaaatgagccggtgccgttaaggacatgccaggcgtagatctgctgaatcgccatgatgtggcgttcatctgcctcaaaaatttccattatgcggttttgccccgaaagtctgcacctggtggaaaaacaacggtatagcgggcgatgtgagggcgcaatataaatattacgcgctcatgaaattttatgagtgcgtcgttctccaggattattcctggcaggaagcagataaaaaatcacgtcggtttagtgccactactgaatggtaattaagcctattctgaaaacagcgtcagccggatgatccgggccggcgttaaggctattatcttcgcgattctgatggggttgatttattaactggaggcgcagcgtgatgcgatttgttgattttctgaatagtaagcaggggctgcgtgcagcaagaaatcactgctttgaattaaatggtgtggtactgggccattttactgcgttattcctgcatgataaccagattatttttaccaaagatggtaagcagtgtgctgtgccttattatctgggtcccgaagaagatttgcttcaacagaaaataaatccgcgcattaaaaatattcgcgcgatctgaacggacgccgcgatgagtttatcgcttcagccataacacctgcgtaatagttcctcattccccgggcgataatattggcactgtctggtaaatagcatcgacgctatttctaactcccctgttttctgccaacccattcgtttacgcctgcttatttacccgactcgctgctgttctgcgcgggtgcaataaacagcagcagcagggcgctgaccgcaaacagcgttaatgccgtactggctcccaaagaggcgtagagctgaccaaacagcagcgatcccgctacctggcccaccgccagcataaagaacaggatgccgacgccggtcgccggatcttcagcagtggcgcgtgcgccccacaccagcagcacgcccgatagcgtgacgtaacctgcgccacagcaggcaaccgcgatcgctaagccggtggattcgccccgactccaggccagcaccagcagtggcactgccatcccgcacagtgagagccggtatacacccttcagcccgatacgggcagcgaccgggccggttgccgcacccacgatgcctgctcctccggcaatcagccagagtaagcgggcggtctcctcatcaacaccgacatgctgtcgcagcagcgctgacccaaagctccaccaggcagcactgaccagacccgaaatcaacgcaatactcatcagacgatgcatggagcggcgatacagccgctggtgccagtgacgcactctggtggggcgactggcggcgtgacctgataacacgcgcatcaccggcagcacacaggccagcgacagcaaagcgaacagcagacaggcggcacgccagccgccgggcagaaacgctcaggatgaccaccgtcaggataatgcccgcgctggtgccggcattgatcagggtattgatgcgcggctgacccgcagcagggattcgatcgctgaccgccgccgccagggcaggtgaagccagaccggcactcaatccggcaataaagagtccggccgccagcagcagcgttgatgaggcacaggcgagcagcagcagacccgccgtcgcactgagtgaggccagcagcgccgtcagccgggtgccatagcgatctgccagcgcggctgcggtaagaatagtgaggcaatatgccacaaagctgcaggctgacagcatacccgcctgctgcgggctgaaggggatctccgctgagatagcgggcagcatcaatccccatgagaagcgcgccatgccataggtcacggcgatcaggctgaagccggtcagcgccagcgcgatgggcgatctcatcctgtcgccctgttctgaagtaactgactgacgacctgcgccgcctgttgagcagcggcgggaccggtaatcagcgccgtggtaatggcaccctcaaagagtatccagatagcatcactcagcgacttattttcagcaccgcgcagatgcgtcacacaaagggtgatataagcccgcatcgtggcccggaaggctagcgcctgagcggccagttcactgtcccgctcggcatactctccccaggctttaagaaagaagcagccacgggcaccgttcgcctctgtccactcgcccagcaccctgaacagatgcgctatcgcatcaggctgttgcggtggcagcagatcggccataaagcgctgctcgcgcgcgacgagtaccgctgcggtcagcgcttcgcgtgaggcgaagtgatgatagagcgtgcgggtagagacgcccgcttcgcgacagatattgtcggtgctggtggcgtggaaaccgtgggtgtagaagagccgctcggcggcctggatgatatcgtttctctttttcatgctttaaaagtaaaccgatcgttttactttttcaagccggtcgctgttaattacgcccgctggtattgataagtccctgatgccaggggagctggcgttccgcttaaaggcacgctgtgcaccactttcactcttattcaggttcagtttatcaatactcataaatacccctgcggggatgatatttttcagcttctgctctaatcatatctgagtagcgcgtcacccctggcgcgcgggttgattttataatctgttgttttttaggttttattttgttttttgcttttttaatgatgcattagcagtataaatgtaagcggggcgacagagagggtgagggcgttacagcgcgtggaatgcctgaagcgacataagcaatgaaaaagggcatattctcaaagtcagccagactcacgcaataaagtggttttagggataattctcagttagtttaataaagcttcagattacaaaaaaaacctcttacgaattttggttcgttttttaagatacatacagcaactatcaggatgactaccatgctcaaagccagctactattatctgtgcccgcgtcccatgggtggatggattttacacaaagaaggttgcgttaatctgtcaaagaacgataaacgcgtttttattggttcgctttatacccgccagcaggcgctggccgtggcgaaagtccatcacgctaatgccatactctgtaatgcctgcctgagcacttttatttgcccgaccagcagcacggcaattaaaccggcacgcgcggcaacgccaacccgccatacgccaaaacattaatttgtatgcaggcagttattgttctgctgtggcagaaggataataaagggaattaatgctgcgggccggttagaataaaaaaaggcagcgtaaagacgctgccctgttctttatttaagcctgtttaggctggccatttgaagcggtaattccgccatcaaccggcagattaacgccggtaatataactggcttcatcgctggcaataaagagaatggcacgggcgatatcatccgcttcaccggcccggcgcagtggaatacggtcgtaaaagcgctccagcagcgcctgatcctgtttggcatcttcggtcagatcggtaaaggtaaagccgggacagattgcattgactcgtacgccatctgcgccgtagtccatcgccagcgcacgggtgaagttggtaatcgcccctttagccgcgttgtagatgctcatgccccagtcgccgcctaaaccggaaacggaagagatgttaaccacgttgcctttgctctttaacagggcaggcatgaaatagtgtacgccgtggaaaaccccatcaaggtcagttttcatcagggttttccatgcgtcgagatcgacctcatggatgcggccctgcacgatgacgccggcattatttaccagcacgtcaacacggccatacttcttcagcacggtttctgacagctgtttaacctgtgcggcttctgagacgtcgcaggcagccaccaggtgatcgcctggcgtcatgtcggccagcgtctcttccagtttctgcgcggtacggcccaccagcaccactgatgcaccctcttcagcgaagcgttttgcgctggcttcgccaatgccggatccggcacctgtcacaaccacaactttctgcgtaaatctggacattatgcctccttttcagcatcaattctcactgttaacaaccggttaagcctggcagcgatcgccagaaacacaagcgcagcgcgaaatgcgctgcgccagatgactgctttttaaccgggtcagcggctatggacgtctgaacagggcgaagctgcgtccttccagttcgaaatccttctccttggtgatcaccagaccgcgcttcgcggtgtcgctggtggtcagttccagcacccagccgccttcaccaaactgcgggatctggaacggtacattgccttcaaacggattgaacagcatcaggacgtcgtgccagatgccttcctcggtctggaggtccggtcggccgatataaacccccagcgttgagccttcatcccactgctcagcctgctggaagccgccaccggcgttaaaccatttgatatccatgccatcacgccagttttcacggcgcagtaacggctgctgagcacgtaacgtcaggatctggcgggtgaactcgcgcagcgcctcggcagattccggcaggttatcccagtgtacccaggagatttcgctgtcctggcagtagccattgttgttgcccatctggctgcggccaaactcgtcgcccgccagcagcattggcgtaccgtgtgagaagatcagcgtggcgaggaagttgcgcttctgacgctcacgcaccgcgttgatgctttcatcatcggtcgggccttcaaccccgtagttgtaagagcggttgtcgttgtggccgtcgttgttgtcttcgccattctccgcgttatgtttgtcgttgtacgacaccagatcgttgagggtgaagccatcgtgcgcggtgataaagttgacgctggcccatggacgacgaccgtgctgatcgtagagatcgccggaacccagcaggcgggcggcaaagtctgtggagacgttgttgcctttccagtagtcacgcaccgtatcgcgatactgatcgttccattctgcccagcctggcgggaagctgcccacctgatagccgcccggaccgatatcccagggttcaccaatcagctttttctgcgacaggaccgggtcctgcatgatggcatcgaagaagccgccgcgcgggtcaaaaccatcaggctcgcgaccgagaatggtacccagatcgaaacggaagccgtcgatatgcattgattctgaccagtaacgcagcgaatcgagcaccatctgcagcacacgcggatgcgaggtgttgacggtgttaccggtaccggtgtcgttgatgtaatagcgatgctggtctggcaacgtacggtaataggagaagttatcgatgcctttaaacgacagcgttggccccagctcattcccctcggcggtgtggttgtaaaccacgtcgaggatcacctcaataccggcatcatggaaggctcgcaccatgtcacggaagccctgaatgccgcgcggcccaaagtagcgggtggcgggggcaaagaagttcagcgtgttatatccccagaagtttttcagccctttatccagcaggtgctggtcatccgggaaccagtgtaccggcagcagtttcgaccgaggtaatgcccaggcttttgatgtagtcgacggtcgatttgtggctcatgccgtcaaaggtgccgcgcatttcaggtggcagggcggtgttgagctgcgtgaagcccttaacgtgggtttcatagatgacggttttcggccacggcacattcgggcggtttttatcctgccagtcgaattcgttgggatcgatcacccggcactttggcgtaaacggcgcgctgtcgcggctgtcgaaggtcagatctttatcgtcatgatagagatcgtaagcgaagtgcgcttcgttccacgcgatgtctcccgccagttcacgggcgtagggatcgagcagcagcttgttcgggttaaagcgatgaccattttccgggtcataagggccataaacgcgatagccatagagcgcgccgggctgcaggcccggaatatagccgtgccatacttcatgggtatattccggcagctccagacgggcaatttccgttttaccgctgggatcgtacagacagagttcaacccgctcggcgtgggcgctgaacagggcgaagttcacgccctgaccatcaaagttggcccccagtaaatggctgtatcccgccgtaatttcaaaacgctgactgtttgacatttatgcctcgttattcaatgaacagattgacgcgtaataaaaaaagttctttccggaattcactgtgccaccagcacggcacaccactgcgatgccagcccggtaagcggcaactggtcgcccgcagccaccgttttaccggtcagcacatcctggtagcggcgctggcccagtgcggtgggcagcgcaatgaccgtgtcagcccagcgcgcagcgggcggctggtcgagattcgccggcaactggttaaagacccggcgtgacacaaccactatcaccgcctgatcctgtccggtgcgggcaaaggccagcacattattctgctgctcgccctctgccgacagtgccagatagtcaccgtggcggaacagggcaggctgctgctgacgcagcgtcagcagcttcacaatcgcctgctgattgacctgaccgcgcagccagtgcgcctcactgccgtcgtgctgtgacgcgttaagcatcgccgccagcgcgtcgaaatcgggttcgcggcggttatccggatcgaccaggctgaagtccagggcctcgctgccctgataaatatcgggtacgccaggcgccgtaagcttcaccacagtctgggtcagactgttgaccagaccggcacgcataaagggttgcagcgactggcagaagtcactgaggaaggtgctgctggcgggcgcaagcaggtgacgggcatagcccagcactgcctcctcataggcgtcgttattgtcggcccagtcggtacgcagcttggcttcacgcagcgctttttccacatagaccacaaagcgggcttccagcgccgccagaccttccgcatcctgcggctgcagggtggttggccagacgcccgccagcgcttcatacagcatccactccacggccggttcgggtgccggaccatctttcaggcgtacgacctgatcgtggttcatctcccgccagcggttgacgcaatccgcccagcgttgcggcgcttcggtaagggtatagagtcgcgcacgcgcatcttcaccgcgcttggtgtcgtgcgtagaggtgcccgacagcgcatcgggctgatgttcgcgccgcgcctgcatttcagcgtgaaactgatccagcgagaagtggcgcgccagcggttcagcgccgacttcattcagcgccagcgccatgtgctgacggaagaagagggtatcttccaccgatttcgccatcagcggtccggtcagctgctggaagcgggtgcggaattgcgtggcatcgtcgcgagcggagtcggcaacctctgcgcgcagaatatgggtcaggaaatcaagcgcctgactgtcgggcgcatgggcactggctttgacctcgctgaccacctgttgcaacagcgcggtgtcggctggggtcaggccctgcggcgtaccgtaggtgcgatagaccgggaacgccaccagcagttcacgcagcgcattcttcagttccgcttccggctgtggcgtgccttctgcgtcggcaatcttcagtgccagctgcagtaatcggttaaattcaccggcaaaattgcggtttgccatcagcagtttggcggcgcgcagctccgctttcatatcaacggttttaccgatgacggcctgatacgctttgcgcagtccgctcagctgatcgctgtcgaccagcagattggcgagtgcggccataaattcatatccggtggtgccggaaaccggccatgcatcaggcagctgttcattgtcacccaggattttctccacagtgagatagcagtcgggaccggccgcctggcgtaactgttccagatagccgtgcggatcggccaggccatccacgtggtcgacgcgtaagccctgcaccgcaccgctgtgaaccagttccaggatcagctgatgcgcggcatcgaagaccgttttgtcttccacgcgcacgcctaccagaccggtgacttcaaagaagcgacggtaggagagatcgttgggcgcatcgcgccacgacatcagccgccacggctgctggtcatgcagttcagcaatctccgccgcgtcgcgcagggcgagtaccgcttcttcccgatcctgccaggtatcaggtgccagcggatagaaattgtcgaagtaggccagcgccggtttgccggtctgcggatcgcgcttcacgctgatctcgccgttggccagcaccgcctcaaaggtgtcaccgaggaaacggcagcgtcaggcggcgtgaccagtcgatatcgaagtaatgcgcatagcggctctgttcgccatgctcaatgacgtcgcgccaccacgggttctccagcgaggcggccatgtggttgggcacgatgtcgaggatcagccccagcccggccgctttcagcgcggcagccatgcgatcgaatccttcacggccgccaatcgacggctcgatctggttaacgtcggtcacgtcatagccgtgggtcgattcagcagtagcgctgaagatcggtgacgcgtaaagatggctgatacccagctgtttcaggtagggcaccagcgccgccgcacggtcaaacgtcatgccgttgcggaactggatgcggtacgttgcggttggaatattcattctgcttctctcttagccagacgtaccacgatagcgttgggaatcagttcgctggcggcctgcggccaggcaaacagcgtttcgcctggcagatcggggatcggctgtgtgctgttgccgacgttcagcgccagtgacagcgtgccctgcgggaagtcccagcgcaccgcgaggaaaccttccgccgttttcaccacctgaccggcatcgccaccggcggtctgcaacagcggcacgatatgttgctgacgcagggccagcagctgacgcgtcagcgccagccactgctgaccttccggcgtttctgttcgctgccagttaagcttcgactgttcaaaggtggtgacatcgttgggatccggcacagtttcgccgtgaccggcatggccttcaaactctctggcgcgaccttcacgcaccgctttggccagatcgccgtggaaatcggtgaagaacaggaacggccgggtttcgccatactcttcacccataaacagcagcggaatatgaggcgagaccagtaacatcgccagcagcacctgggtgcgctctgcgccggccaggctgatgagcctttcgccctgcgcacggttgcccgtctggtcatggttctggatgaagtcgacaaaggcgaccggcggctggctgctgcttttcacgccgcgtggctcgcccgactgcggcgagacttcgccctgatagacaaagccttctgccagcgcccgcgctacccgctgttccggctggtcggcgaaatcctggtaataggcgtggctttcaccggttgccagcacatgcacggcgttgtggaagtcatcgttccattcgccggtaaacagcggagcgtccccgttttcgtcacgcggatgcaggaaggtgacgttacggcaatcttcggtggtcagatgaatagggcgatcggtaatcgaggcgcggatgcgctcagcaatgtcaatcagcacatgcttttcgctgggatcgtcaatctgatcgatggcgtcaaagcgcaggccatccagattaaactcctgcagccagtagagcggcgcttccacgatatagcggcgcaccgcatcaacgtcataggcgataccggcgccccacggcgtctggcgcgctttgtggaagaagtctggtgagagcagcggcagatagttgccctccgggccgaagtggttcagcacgatatccagcactaccgacagaccgtggccgtgtgctgcgtcaataaaggctttaaaatcatcgggtgtgccgtaggcggcatgcggtgcatagagcagcacgccatcgtagccccagccgcgattaccaccgaaactgcgacaccggcagcacttcaatcatggtgatgccggtttcagccagcgttggcagcttctcaatcgccgcccggaaggtgccctcaggcgtaaaagtgccgatgtgcagttcatacaccaccgactcctgccatggacgacccttccagctcgtgttctgccactgataagcgtcaggatcgatcaccagcgacgggccattgacctctgctttctgagcgcgggcggcgggatcgggcaccgctgtaccatcggccagcacataatcatattcggcattggctgccacaccagcgacctgagtttcaaaccagccgtcagcctgcggcatcatctcaatgtctttaccggagagccgcagcgtcacgcgttgctgaccggttgcccagaggcggaaacgcacctcgtcgctggcaacccgttcagcgccccaacttttaaaaaaagatttggattccattcagttgcctcatttagcctggaaatgcgcgatggtggccaccgcacgaaaaggatgtcgatgacgcaagcgtcaaaaaatcttaaagctatcagcgagaccaggaggccaggtgggctggcgcgtctcttcagtcagaaagccggactggtattcagcgtggtgtggcggaaaacgggccgtgagaccgcttccacgcggcatacagagagtaatcatagactaagatgttgcaatcgcagggcggcgggaggtggagaggcattaatttgcgttaattgctgtgaatctgcatccggcggggcgaaagcaggaaccaggcgcagaaaagcctgccggatggcgccgattcgctataagctaatgcgcgatggcgcaggtcgctccggatgacctgcggcgctgaacacttcagaaggatgttacgtgaggaaaagagttctgttagccgcgttgttgttgctggtctccgcctgttctaaccgggtcggacacaggctggacagcagtaatctgcagcaaattcatgccggtcagaccaccaaggcccagctgatcgcactgtttggtcagcctgacagtgaaacgccttacccggacgggcagcggttgctgaagtggacctacagcgaggcgcgcaccctgaataccaccgaagggcagacgctgactgtgcagatgaaaaatgacaaagtgctgaactatgcgctgagtaaaagttaatgcgctgagcaaacgtgaatcacggcggcggcagatcgccaccgcgcattctggttactgcccgccgctctgctgtgcgtcccggctgtcggggcgcggctgagccagacgggcaaaatcggatcctgccggatgctgataaatctgcagctcaaagtggcgggccatcgcgtagatatactcaaaaatcgctgcctgagtattttcataatcggcccagaaaatagaggaggtgaagcagtagatctctaccggcaatccatccggcgacggtttcagcggtcgcaccacgatatacatctctttctgaatgtcgtcacgctgcgccagccaggcggtcaggtatttacggaacaccatcagattggtgatgccgtttctccataaaccagcggtcgcccacggcattgatatcacgcccatccagcagctcagtgatcgattcgccagcgagacggatctggctcatcgcctgcagcatctcctgattcacaaaggtgatcgacttctgatcaagataaaagctgcgcatgatgcggcgtgcgcccgaggagaacatcgcctgccagttggtgtaggtctcggtcaggaagttcttggtcgggatgcgcgaaatggtgttgtcccagttgcggatggtgatggtatgcagagcaatatcgatcacttcaccactgatatttctgtccggcatctcaatccagtcgcccagttgcagcacatcgttagaggagagctgaatattcgccaccagcgacagcagcgtatgctggaaaatcagcatcagcaccgcggcgaccgcacccagcgaggagatgataatcgccggtgacttgttggacataatcgccagaatcatgatcgcggcgataatatgcaccaggattttgccgatctggatatagcctttgatcgagtgattcttgcgttttgatttgcgcgaataggagttgttaacaatctccagcacttcgttgaagaagatcgacagatagacaaaaaacaggatgccgcagatggtctgaatcgccactttcagattttcaggcaggcccggcataaactgcaggaaattgtagaccacaatcaccggcacaaaatttgacagcttctgagagaggcggacatctttatccagcggcacgccctttttgtggctgctgaaaaagaccttcctgatcactttgacgatgaaaaatttgcagatcaggtgagtgaccatcccggccataatcagcagcaacaggctgaagctgatcgacagtaccctgtttccctcaataaaactcatcagactctgaatgtaatgcatgataaccacgtgcaaaaaagataaggggcgaattcaaccacagcacggggacggttgttaagcgccgaatgcgttcaggctgagccgcaccgctttttttgcgtaacggcgcgctggcagcaccctccatcctgcggattgttaccttctctggtgcaacactcagataaacgccgcgctggccgataacagctttatctcctctgatatgagcctgcggacatgcttaaaaatcttaaaatcactcacggtatcgctgctgtttctggtggtctttgtggcgttactgacgctgaccggatttctgttctataacggcgtctcaaaagccgacaaaaacttcgtggcggcagagcagcttacgctgcagcagcagcacctgagtgacgcggtaaaaaccctgatcaaaacccgcgtcactatcaaccgtgtggcaatccgtttcctgaaaaatcagcaggatccaaaatcactggcagctatggctgcgctgctggagcaggctggaaagtctgctgctgctgccgatgcggacttcaaagcctggcaggcgctgccgcgcaaagagggccagggtgaagcccaggcgacgcaggtgcagaccgcctaccagcagatgcgtgacaccatgctggcctcgattacctttctgaagcagggcaactacgcgggctacggcaaccttgaagcacaggcggcgcaggaccagctcgacagtgcctatgaggtctggcgtgcagtgaacatccagctgatgaaagcgtcctcggagcataaccagcgtagcctgacggatgcgctctgggcgcttctgactattggcctgatcaccggcgtgattggggtcgcggtctggattgggctgcagaaattgctgattggcccactgggcaggctgaccggccatatgcgcgccatttcaggcggtgatctgacctccgatattcagcatgaaggccgcaatgagatgggtctgctgattcaggaactgcagcagatgcgcgatgcgctggtggtgaccattacctcggtcgatgacgccacccgctctatctttaccggtgcagcggaaatctctgcgggcagcaccgatctctcttcccgtaccgaacagcaggctgccgcgctggaacagaccgcagccagtatggagcagctcacctcaacggtgaaactcaacgcagataatgcgcagcaggcgaccacggtagcgaaagaggcttcagccacggccctgcagggcggtgagactgtcgcccgggtcatcgccaacatggatcagatcagcgaaagctcgaatcagatcgccggtatcatcgccattatcgacagtattgccttccagaccaatattctggcgctgaacgccgccgttgaagccgcgcgtgccggtgagcagggtcgtggatttgcggtggttgccggagaagtgcgctcgctggccggacgcagcgccagcgccgcgcaggagatccggggactgattgaccgctcagctgagcggattaaaaccggtgccggtcatgcttctcaggcgggtgtcgcgatggagagcatcgtgacgtcggtgagccgtgtcacgcagctaatcgaagagatcgcggcctcctcgactgaacagacccgtggcattgagcaggtctgcaaagcggtctcggaaatggatggtgtgacgcagcagaacgccgcgctggtggaggagtccgcgactgccgccgcctcactggaagagcaggcgagctacctgcgtaaaacggtatcggtattcaaaaccggcactctgcaggtggcgtttctctgctgcgccggtggcgaaagcccttgccgtgccaaaacttcagcctgcccgcctggcggacaacgataactggcagaccttctgataaaaaaaaccgccccaagggcggttttttattttgtgacgcggcatgcggcatcgtgccgctgacatcaggccgggacggactgtgccttctggctgcgcgaccagacgcggtgcgctttcatcgcctgagtgaactcagacatcagcgcgctctccgccgagtcgccctgcacaataccttcttcctgatccgcatcttccagaccgaactgcgctttaaagcggcgcgcttcccccaccagaccaatcaccttgaggtgcttgtaggcttccagcaggaagtaacgggcatcgccgctcagcagcagggcatcgatattgccatccggcaccatcaccgcatcaaaggtcagagagggcagacctgcgaacgtcgcatcgaccggcagcaccgaaccatcatcggcgcgcacctggcccatatgcggagccagcagtttggcgtgaacacccaccgctttcagcccctgcaaaatcgccagcacatcagccgccttcacaccatcgctgagcagcagtgcgacctggcgacctttgatctcgccatccggaatggcgtagaggctcaggctgtcatctttggtcaggccattcaccggcgcaggcggctgaatgttgagctgctcatccgtcagagcgagtcccaggttatccgccacgccctgcgccagtttagtatcgatgcgtgccagatgatccaccacacgctcacggatataagcacgcgccactttactcagttcaaacgagtaggcaccaatgatgtgctgctgctcgacttcagtctggctcagccagaacaggcgcggctgcgcatagtactcaccaaatgaggggctgcgctcgcgcactttatggccctcaatccgctcctgatagctctcgaagccaccgccttctgcagcaggtggggtttcacgcggccagttatcgttgatcgagttcggctcgtagttcgccggattggtgtcgatatcctgacgatgcatgccctgacgctggaagttatggtacgggcaggtcggacggttgatcgggatctcatggaagtttggtccgcccagacgactgatttgcgtatcggtataggagaacaggcgaccctgcagcagcggatcgttggagaaatcgaggcccggcacgatatggcctgggtggaacgccacctgctcggtttcagcaaagaagttatccggattacggttaagtaccatcttgccgacaatctcaaccggcaccagcgcttccgggatcagcttggtggcatccagaatatcgaagtcaaatttgaactcatcctcttccgggatcagctgcaggcccagttcatattccgggaaatcacccgcttcaatggcttcccacagatcgcggcgatggaaatcgggatcgcgaccggtcagtttctgtgactcgtcccacagcagcgacgctttaccggccaccggcttccagtggaaacggacaaaggtcgctttaccttctgcgttaatcaggcggaaggtgtgaataccaaagccttccatggtgcgatagctgcgcggaataccccggtcagacatcgcccagatgacgttgtgcatggtttccggctgcagagagacgtaatcccagaaggtgtcatgggcgctctggccctgcgggatttcgttatgcggttccggtttaacggcgtgcacaaagtcagggaatttatgcgcatcctgaataaagaacaccggcgtgttgttgcccaccaggtcaaagacaccctcttcggtgtagaacttagcggcgaaaccgcgaatgtcacgcacggtatcagccgatcctgcaccgccctgaactgtagagaaacgcacgaaaaccggcgtggtctgctcgggatcgctgaggaactgtgctttggtcaaatctttcagggagcggtaaggctgaaaatagccgtgtgcggcagagccacgggcgtgaacgatacgttccgggatacgctcatggtcaaagtgcgtgattttctcacgcataataaagtcttccagcagcgtcggaccgcgcgaaaccggcacgcagtgagttttgatcgttggcgatgcgtgtgccctggttggtggtgagggcgcggtcggtgccgtttttgcggctggcttcaagctggtcaagtttggcgttgtgcgtctgaggcgctttcaggctgcctggggcggtgggctgcttgcctggcggagtcggttcggctgggggctgatgcgaaccatcttttggtgccagtgaacccagacccggctctgaggattccggaccggtggtgggggcgcgctcgctcaggggtttcttctctgtttctttcgacattaattcatgctccagctgttattttactttcgacgacactaaatatagaacaacctgaacaatactgaggttaaatcgggcatttaactgtgacgactgtgccttttttgtccgccagaaaagcgcacttatctctcaatccggattatcgcttcgcttattcatgccttgtgccgtctggcttaacggcgttccagcccgcgcctgctatacggaaagtgagctttcagaggatgcagaatctgccgccgcaggaggcgctcattgcctgatgcagggcattaaccgattaataaaattaatgctggcgtttgctgcttttggttgaagttagaaatgttatatcataacatttcattttgtaacgttgaccggggtatcagactttgatgaatcatgcaggtaaatggattgggctactgggcgcactgttagtcagccagccgtcgctggcacacggcacgcatgcacatggaaaaccgctgtcagccctggagcagaaagcggcagaaggggtttttgctgacagcgatgtgaaagatcgtccgctcgctgactgggatggcctgtggcagtcggtttatccgctgctgcaaagcggggagctggacccggtctggcagaagaaagcgcagcaggatcacagcaaaacggcagaggagtataaagcgtattaccgcaaaggctacgccaccgacgtcgataccatcggtattgaaaatggcgtgatggagttccacatcggcgaccaggtcagcgcctgccactaccggtatgcgggccacaaaatcctgacctatgcctcaggtaaaaaaggggtgcgctacctgtttgaatgccaggacgcgggcagcaaagcgccgaaatatgtgcagttcagcgaccacaccatcgggccgcgtaaatctgcccatttccatatctttatgggcaacgattctcagcaagccctgctggcagagatggataactggccgacctattatccttaccagatgatgaactcacaggtcgtggatgagatgctgcaccactgagagccgggccggtgtcagatgccccgcggatcagagctgtttcgcaaggatagcgactggattcatttcccccgtttgaggaaatatagatccttgagttaagttaactcatgagttaacttaactccaacggaggatctatgtttgagataacgatacacaaggacgcgctcactgaaattaaggcaatgccagagatgctccgggctaagctggcccggcaaatagataaactggctgcccgtggaactgatttgagagagccggataccaaaccgttagggtcgggtttttttgagctcagggcgaaggccaatgagattgggcgagcggtgtatgtttaccagaaaggcagacgtatttttatcctgaaagcttttgtgaaagagacaaagaaaacgccagcagcagtcatgacggcagcggcgcaccgtttagaggagatgttaaacgatgagtaagaaatcagttgtgtggacgacggcccgcaaagaaattttatctgatccggctgttcgcgaacattacgaggcagaagttcgggcagagcacctgcgcgagcagttagccaaatggcgggaaagcgccggaatgaccagcgctcaggtcgcggaggcgctcggtgtcagcccgtcggcagtgtcacgcaccgagcgtcgcgcagataaagccacagttgaaacactcgcccgctatgcccgtgcctgtggcgttgaaaatccccagatctctctttgattgagagatgacggcaggtgccagaacaatgctggccctgctatttatcttgcctgctatcaagcaaactttctttccggtgcacacgtatcccctccacgggttttatcccacccaggccgggcggcgcgaggcgggtatacccttaaccacacgctgataggaatcctctaccagctgctgaatcaagccaggcgagaggtcgtcaccgggatagaccgtgatccagtgacgtttattcatatgataaccggcggtgatcgagggatagatcacccggtgcagctccgcctgctgcggctcgcatttcagggtgataatcggcacaccccgcagtttcggtcagcagtaaaaacacttttccacacactttatagacctgatgttccggcccgaatggatagctgcattcagcggcgggcagccgctcagccgcttcaatggcgatgcgctggatctcatggccctgcatagtgagtctccctgtaattattcagcctgagtctgcggcccgcgactggctggtcgccaggggcctgttacacttctgataagcataaatcaggagcagacatgaaattaggctttgcatgtaagtatctcaacagcgatggcaaacagtttttcccgcttcgcgccaccacccgtaaacggtttctgagtttatcgcacgatgaacgcaatcagctgatctatgagattaccgtcaccaacctcaacaatctctacctgacgcttgagcatctggccaccttacctgagccactcaggatgatgcgtattggcagcgatctgttaccgctctatacggttcccgaggccacgccactgttcaccgaatttctgcctgaactctatccgctctttgcccgctgtggcgagctggcgcgggcgcatcacatccgtctctcattccatccaggacaatataccgtgctcgcctccgataatcccgatgtggtggtgcgcgcgctggaggatgtggagtatcacacgctctgcgcctgtctgatgggatatggcaagacctttcaggattttaaaatcaacattcatatgaatggcaaggcgggattcgacggcttcaaacggtcgtttaatcagctcagcccggaagcgcggcggatgctgacggtggagaatgatgagatctcctgctcgctggatgacgtgctgcaggcagcaccgctctgtccggtggtgctggatattcaccatcactgggtaaaagagagtgagtttattcagccggatgacgcgcgtgttgccagagtgatcgattcgtggcgcggcgtgcggccggtgctgcactattcgatttcgcaggaggggatgattccgcaggagggctggcccgatcagcagcagctgggcgtgagcaaaagcaagctgcgggcgcactctgactacttctttaacccgacgctgaatgcatgggcactgtcgtttcaggatttcgatatcatgtgcgaagtgaaaatgaagaatctggcgcgggaacaactctaccagtgggggataacacagaagctaatagctaatcccctggccgaagcgaccagggaatcggcgaacgttaaataatggccacaccgcccgtcacggcgatggtcgctcctgaaatgtagctggcttcatcactggccagcatcacataggttggtgccagttcagcaggctgaccggcacgctgcagcggcacttcgctgccaaagttcttcacctgttcaaccggcatggtcgacgggatcagtggcgtccagatagggccgggcgcgaccgcattggcacggatacctttttcagccagtaaggctgccaggccgccagagaaattaataatggcggctttggtggcggagtaggcgagcagcttcggtttcggctggtcagcattgatcgaggccgtattaatgatcgatccaccagcaggcatatgccgtgttgccgctttagtgatgtaaaacatcgcgtaaaggttggtcttcatggtccggtcaaactcttcgtcgctgatctcatccagcgattcgcgcgtcatctgatacgccgcgttgttcaccagaatattaatctcaccaaaggcttcgacggctttatcgaccagggcgttgcagtgtgacgcctcagtaatatcgccaggcaccagaaccgctttctgtcccgcttcttcaaccagccgggcggtatcctgcgcatcctcatgttcatcaagataagagatcaggacatcggccccttcccgggcaaaggcaatggcaacagcccggccaatgccggaatcgccaccggtaataatggcttttttccccgccaggcggccggagccctgataactctgctcgccgtgatcgggctgaggctgcatcgcagcggtagtgccaggccaggtctgctgctgttcggcaaaagggggttgtggacgctgagtggatgacatgactattcctccgtcaaaaggtgggacaagcctgtcagggcatcaaaccctgacaggcgagtaattacagtttcggtggtgtaacgccgtcaatctgctctgactgcgcaccagaaaccgggacgcgcattgccgagcagcggctcatcacccagaatctctggctgctgtttcgcgctgaactgaccatggccatcgtaagccgggccactgctccagcgaccttccggcagcggtttatccagcgaggtattcagacagtagtaagagtgctcctgcgcctcatgctcctgcgggaagctgttcgggatcggcagcgacgcgttcagtccgcccatctcttcgatcaccgccagccactgctgctggtgcatattgtcacgggcgatcaggaaggagaggaagtccttcatgcccttgtcttccgtcatgttgtagaggcgggtcgccagtacgcggcccgtggcttctgcggtgacgttagccagcatatcggccgccacgttgccggacgcatagatatgactcatatcaaaaggcatgccgttggcgttaaccggcatcgctgccagaccggaagagaggatatggcgcgggttcattccacccagaattgcattaactaccggatctttcgctgacgcttcctggtaagagagcggggcgccttcaaggttaagtgccacggcgtagcccagcatttcgatatggctcagctcttcggtggcggtagagatcagcagatcacgaatccgcacatcaccgcgcgcgcccatcgcctggaaaaagtattgcatcgctacacgaatttcaccttcgacgccgccgatggcctgctggagcagcatggcaaattctggatcgggtttctctacacgaaccgggaattgaagttttgatgaatgatgaaacatgattattttcctcgtctgtgtttgcagtggatgcagaaaaagcctggacgcagatatcggataaataaagcgaaacgacagcaattaaccggaatttcaggttgaataaatggcgaaaacggtgttttccggagctatatctggtccggcggggcaggcaatcttagcggtgtgaaggggacaagtgattcagtgcaggagaaataaaaaaagccccataacaggggctgattccggacgggaaaagcatccatgctaattcgcgtttccctcataacagacacagatttttagctctcgctggtcgccgaagcgcgctgcagaacatgttcaagcgcctgacggtaaatatcctgcttaaccacgtcacgctcactctccaggcggtgaatcaggcccagcacaatgtctttatcggagacatgggttttcgcatgggcaagttcggcatggactgcggcgataacctgtttttcagtggtcagcgctgtgccagagttcatgaagtaatcagaaatctgagactctgtattcatcgttgtttgcatgtcaggcctcataagaaatggggggaagaacgcgtcgattcagatccggtcaccggctgacgcaaaaaaaaatgcatctgaaggtggaaatccacaacaccttcagatgcggtgcaaagcacctttcgttacaagtgatttaacatcacgagacaaagttatacaagaatcgcaaagttgtacaatgaaatttgacaaaatttaactggtcggtggtgtatataaaaagcatgtttaaagtgaaaaaagaggttttcgatggttaattgaataaatacagtgagttggtgaggttttcagaggggtggcgattttcagaccagcaggctggggattgtgctgacgacacatcaacgcgttaaaaccgcttttttccgcagatttcagccaaagttgtacaggtttcaacgctggaaaagtggcgggtgcgattgtgctgctgcaatcctggccgtctgacaggccatgccgcataattcacttcccacgactgatgcagaaggctaaggttgaccccttatttatcacaaggaaatgatcatggttcacgactatttcgcaattccgcctgcgggcatgactcaggaacaacataaacgttcggtcgccgtggctgctgctctgtcagtggcaaaggagtccgtcagcgcctccacctcagcaaccggctcaaaaaccgcctgggatctgcaggccgtggcgaatgaagttgctaatctggccgacgcgattcaggatgcgctggagagtgacagcgaggtgtaaacactaaccggtatcgtctgaggctgctgcggaggcggtgcaggacagggcggtggcagcgttcaggagccggtaaagtccggcaatcggacgctgccggaaaatccgcttattccattgcgggtggctcatatttaatatactgacgcagggcatcatggatagcctggttattgccctcttccagaccgcgttcggcatactctttcgccagcgccgccagtacatcgtcaaacttccctttgtaattgagattattcagcgcaatttgctgaccgagtatcgcttttaataccgtagtctcaacccttaactgcgcaactgtctcttcaagatgtttgattcgatcgtcgtctgccataatccctccatgcttaaaaaagcagaataaccagcccgcccgtaatattcaaacctctccgaatgccagagaagcgttgtcagattttccttaagtaaaaataatcagccggtgaatttataagattctttactgtaagaagaaatcgacgatattccggcggtgcggcgaaagtaacccgtttccgcttactctgacggcaatgcgaaaaaacgtttaaaaaaaagtgcattaccatcaaccctttcgcttaaagatgttccatgtcacttgattaaaagggggattagctattactgtgtttatatacagtaatctgaaaaaggagcgaaattatggaattcattaaacctgcggacattcgtgccgttatgcctttaccgctatatatcgaacgtgtgccgtgcgggtttccatccccggcgcaggattatgtcgaacaacgtattgatctcaatgcgctgatggtccagcaccccagcgccacctattttgtccgggtcagcggcgagtcaatgattgaggcgggcatcaatgatggtgacatgctggtggtcgacagttcactcaccgcctcacacggcgatattgtggtcgccgcggtcgaaggtgaattcaccgttaaacgtctccagcttcatccctgtctgcaactgatgccgatgaataccaaatttaaaccgatcgctatccagaccgaagatgcgctggaggtgtttggcgttgtgacctttgttattaaagcgacccactgaccatgttcgcgctggtcgacgtaaacagcttttacgcgtcgtgtgagaccgttttccggcccgatcttaaaggtaaaccggtagtagtgctgtcgaacaacgacggctgcgtgattgcgcgcagcgccgaggcaaagaaagccggcatcaaaatgggcgcgccctattttaaaatgcgtgaagaactaacgcgtcacgcggtgcaggtcttcagctcaaattatgcgctctacgccgacatgagccatcgggtgatgaccatactggaagagatggcgccatcggtggagatctactcgatcgacgaagcgtttatggatctcaccggcgtgcagaactgtatggcgctggagacctttggtcgtcaggtcagagaaacgaataggcaaagagacccatctgaccgtgggcgtcggcattgcacagactaaaacgctggccaagctggcgaattttgcggccaaaaagtggagcaaaaccggcggcattgtcgacctgtcggaccctgaacgacaaaaaaagctgctggcgcttattgatgtggcggaagtctggggcgtgggtcatcggatcggcaaacggctcaacgccatgggcgtcatgacggcgaaagatctggccgatcaaagcaccgaggccatccgcaaacagttcagcgtcgtgctggagcgcactgtcagagagcttcgtggcgaatcctgtctggagctggagtcagtgacgccggtaaaacagcaaatcatgtgttcgcgttcgtttggcagccgtatctccgactacgatcagatgcgcgaggctgtctgcgcgtatgccgagcgcgcggcggagaagctgcgccgtgagaatcaatattgccgtcaggtaggggtatttgtgcgcaccagtccgcatgcgactgacgaacccttttatggcaatcagtcgatggagcaactgctgattccgacacaggacacacgcgacatcatcagagttgcaatggcgtgcctggataacatctggattgagggacatcgctatatgaaggccggcatcgtgctgggggattttttcagccagggcgtggctcagtttgatctgtttgacgaacatcagccacgccgcaatagcgaagagctgatgaagctgatcgacacagtcaacaagctcggcagcgggaagttgtggtttgccgggcaggggatcaacaaagcctggtcgatgaaacgcgagatgctgtcgcctgcctataccacccggataaccgatctgcctgtggttgcgcttaagtgaaggctgacccgatgttcctctgctgctgaagccgcggcctctgctaaaagctttttttatcacgcgattaaagtggcgggaagttatgctttgcctgacccgatgagtagtttttcatcgggtattttaagcaaattaccaggtaaatataatggatttcaggcagtttgaagccagagtgatgctctggcccgcaatacatttcacagcaatcataaaatcccgccatcatgacgaatatgagatttatgcgatcgacgataacagcaatataaaaaaccgactctttgtatgttttgctgacaatgaaaaccacgccagcctgcttattaagcaatttacgttatggctgataaaaataaacgcgctgaagcgcagccagcagcgggaaaaaggccgcacagagacaacatccttatctgaatgaaccgcgtccggcttgcaccgcagaccagacggcggctggtcagacagcggcgaatcatactaacgcgtccgggaaataacgggccgtctgcgcgtgacgggtggcggacggcctggcttgttacccgcgcctgggatagaatcgccactgattttgacagcaacacacctccccaggccggtaacaatgaccacgacagccacaacgtataaaaaaaaagagcggggacgccccagagagttcgggatcgaacaggctctggatcacgccatgatcgttttccggcaaaaagggtatcacgcggcctcaatgaacgatctgggtgaggcgatgcatctctccgcaggcagcatctataaggcgtttaaagataagcgctcgctcttcctgctggtattcgaacgctatctgttgctgagaaatagtgagttgcaccgtcgtctggcaccctgtgccagcgggcgggggaaaataaccgagctactgcagtttctacctggattcggcacgtgccacagaagggcgttgcggctgtctggtcgtcgccagcgcgattgcgctgcagacgatggatcagccactcgcgcagcgcattgatgaggtcgttcagcgtaatcaacgcttcctggtctcgctgctggagctgggacaacaggatggatctatcgataacacgctggacagcgaggcggcagccggtttaattctctgtattgcttttggattgcgggtggcaggtaaggtcagcgatgtgactaacgaagaaaagacgctggcgctggcattgaaagtactggggtaaccaggcaaggccgctcaatcagtaaacagacttcccggacctgggcttccagacagagaaattctgcactttcctttcccctcatctgattatgtgccaggctttcacgctttatcctgtagcgaagaaaattaaggcgcgtttcgtgaaaacctcaatcttactgacacttgtggcagccattggctgttctgtttttgctgcccgtggtgggtttgaaacccctacagcgaaacatccaaaaacgatgcaggtgactgaaaacggggagccgctgacgcgctgagcgtgacggcaggtggggagaggccgacgaggaccggttaacggccagacagcaggctgatgagtgcagggtaatggcactcatcaatgggtgtggaagccgtttcaggctgtgaggccaggcgcgtgcccggcaccctaaaaataaacagcaatgacccgcacatgactaacgataatctttaagattaaccggtgcctgtccggtctcgaccagccagtttaattcggcacggtcgcgcgttgaggattcgataaaacctttgagccagttgcgcgcatcggcaatctgcgtgacccgctcatcgttgcgctcctgttcggccatttcgctcagctggcgaatcagtgctaccagcgtaatctcctgtttcgtcaaaagccagattaattgcagcttcaccaagaatcatatgacccgttgttttgtcgtgataaaccatctgcaccctcctgattaagtagcgatataaagagtctagttaaaggcgctctggactaaaaggtgggaaacagcagggcgctatgattaaaatttaccgaaaataaagtgaacctttaatcgaggcggtaaaccactcatatcaaagcataaaaacaggctgaggttttttgtgagaaataagatgagctattatgctggttaaaaaagctgggagttgccggaaattcagataagggcggaacggcgcatttcgttatcagattattatctgcaccactatccgcacggttgcctgccatattatggccacgccgtagcggatatttctgatttataaaccaccggggaataaaaccaggactgtgcaccacttcgtgccaggcgcaggcaaaaataaagccgcccatgggcggctttattcatcgggcaacagcgatcggattatttcttcggtacttcagagaccgctttaacgtccgctttattaatctgctgcttcacgccatttgcatcggtataagccagcaggccggcatccgattcagaaggcttgccatcactaataatggtgcgtccatcgttagtctgaatcgcataactggtacgggtgcagccggttaatacggtcataccaatcaatgcggcgagaggtaaaatcagcgcttttttcatcttattcaccttatattagttgtcgagttcactcatattactgatctcattacgattgatctgctcagtttttcctgtctgagcatcgcggtaagaaaccagaccagtatctgaatcaatctgcggtttgccatcggtgacaatcgtgcggccatcggtggtcttaatcgactggtttgaggcacaacctgccagcgtacctaaagagagagccagcaacgcaatggctgacagggatttcattttcattttttctgctccatgaagtatatccgaacgtttacagcatagtcggctttatcaggtttgctggccctgtcgcgtctcgctgcctgttttttaaacaaaaccggagtgtgtggtgctgattagggggtatgacggcgtgaaatagcatttattgcaaatgtacccagccgttctgtgccatttcagcagaggatgcgctgtaccgaaataagatcgatgctgatgcgggaaataagcacggcagccagagcggatatttccgtaaaagccagaatagcggtgcggaaatagtcagcatgtgggtgaatgtctggcgggattcacaggtccgataccctgaaggctatcggacccgtggagaaggggatcagaggatggagtcttcgcccgctttggcggccgctttttctgctttcatggcgctgaccgggtctgatgcgctcagccagcggtcaaatttctggtaggtgtcgataaaggttttaaagtagctgctggcgatggtggcattctctttgtggttcataaacgccactgccagcttaaatgcatcttcgttatcaaatttcatgtttgtcttcctcgcttaagatctatagagcgtagcctgagaaacgcggcctgtgcattcagacaaccgtctgaaaaggcgtaataattcagcctgactgacagcatctgccagattggcgtggattcccacttacttcgcgcgcaatccttcttataatgccagcttcactcgtgaaggagacccgcttatgttgaaaggattaaccgttgccgcggtgctactgctgtcaggctgtagcctgatgcataaacagccgccgtcgccgcagaccctgcactatcgctgcggaaccatgcccctgaccgtgacgctggacgaggcgcagcagcaggtcagtttcatcatggatgggcagcctctgacgctgaagcagacggtatccgcgtccggcgcacgctacagcgataacacctatgtgttctggtccaaaggaaacggcgcatttatcgaacgtaacgataaaattgtcgtgaatgattgtgagctgcaacctgccagctgacttgttatctgaataggcgagcattatgagcgacagcgaaacgctacacaccattgcccatctgcggcgtgaatatacccgcggtggattgcgtcgtaaggatctgccggacgatccgatcgcgctgtttgaacagtggctaagccaggcctgtgaggcaaaactgcccgatcctaccgccatgaccgtggcaaccgtagatgagcagggccagccatggcagcgtatcgtgctgctgaagcactacgatgcgcagggcatggtgttttacaccaacctcggcagccgtaaggcgctgcagctggtgcacaatccgcgcatctctctgcacttcccgtggcactatctggagcgtcaggtgatggtgctgggtgaagtggaaaaactgtcgcctctcgaggtgctgaaatatttccacagtcgtccgcgcgacagtcagattggtgcctgggtgtcgaagcaatcgagccgtatttcggcacgcggtattctggaaggaaagttcctggagcttaaacagaagttccagcagggcgaagtgccgctgcccagcttctggggtggctaccgggtgaaatttcacacgatggagttctggcagggtggcgaacatcgtctgcacgatcgtttcatctatcagcgcgatcacgacggctggaaaatcgaccgtctggcaccctgaatctgcacgattcgcccctatcagcgctggcacagaaagcgtcagcgctttatgctatagccctgatttttttcgattccgcaactcagcggaaagctgtgtaccagcataggtgcagtctgatcaatttggagtcagtaatgaccagcagtaacctgatacaacaattgcaggagaggggcctaatcgcccaggtgacggatgaagacgcgttaacagagaaactggcccaggggccaatttcgctctattgcggctttgaccccactgctgacagcttgcatttgggccatctggtaccgctgctctgcctgaagcgttttcaggatgccggccacaagccggtggcgctggtcggtggtgcaaccggcctgattggtgacccgagcttcaaagccgcagagcgtaaacttaataccagtgaaaccgtcaacgaatgggttgaaaagatccgccagcaggtggcgccattcctcgacttcgattgcggcagcaatagcgccatcgctgccaacaactacgactggtttggcggcatgaacgtgctgaccttcctgcgtgatatcggcaagcacttctccgttaaccagatgatcaacaaagaagcggtgaagcagcgtctgaaccgtgacgatcagggcatctcctttaccgagttctcctataatctgctgcagggctatgacttcgcctgtctgaacgagctgcacggtgtgtccctgcagattggtggttctgatcagtggggcaacatcacctccggtatcgatctgacccgtcgtctgcatcagaaccaggtctttggcctgaccgttccgctgatcaccaagtctgacggcaccaaattcggtaaaaccgaaggcggcgcagtctggctggatgcgaagaaaaccagcccgtacaagttctatcagttctggatcaacaccgcggatgctgacgtctatcgcttcctgaagttcttcaccttcctgagcatggaagagatcaacgcgctggaagaagaggacaaaaacagcggtaccgcgccacgtgcgcagtacgtgctggctgagcaggtgacgcgtctggtgcatggcgaagcgggtctgtctgcggcgaaacgcattactgccagcctcttctccggatccgtcagcgaaatgaccgaagccgattttgaacagctggcgcaggatggtatgccaactatcgtgctgggcgctgacgatgatctgcagcaggcgctggtgaaagcagagctggtgccgtcccgtggccaggcgcgcaccatgatcggctccaatgccgtttcactgaacggtgaaaagcagtccgatgcggagtaccgcttcagcgacagtgacaaactgtttaaccgctatacgctgctgcgtcgcggcaagaaacattactgcctgattaactggcagtaagatttcagggccggtttccggcccttttttatggcaaggcaggacagggcaaacaagtgaaaaatattttagcgattcagtcgcacgttgtttttggtcacgccggtaacgcggcggctgagtttccgatgcgccgtatgggcgcaaacgtctggccgctgaataccgtgcagttttccaaccatacgcaatatggccactggaccggcacggtgatgcctgcaacgcatttaaccgacattgttaaaggcattgctgacatcgaccgcctgaagacctgtgacgcggtcctgagcggatatctgggctcggcagagcagggcgagcagattctgcagattgtccgtcaggtcaaagcggccaacccgaatgcctggtacttctgcgatccggtcatgggccatccggagaaaggctgcatcgtggcgccgggtgtggcggagtttcactgtaaaatggcgatgcctgccagcgacattatcgccccgaacctgcttgaactggagatgctgagcgagcgcaccgtcacggacgtcgacgcggcggtagacgctgcgcgggcactgattgcccagggaccacgcgtggtgctggtgaagcatctggcgcgtgcgggtcgtcgcagcgatcgctttgaaatgttgctggtaacggctgaagatgcctggcacatcagccgtccgctggtcgatttcggtgtccgtcagccggtcggcgtgggcgatctcaccagcggtctgctgctggtgaatctgctgcacggcaaatcattgcaggatgcgctggagcatgtcaccgcagcggtatacgaggtgatgctgaaaacccatcagatgggcgaatatgaactgcagctggtggcggcacaggatgccatcgccacgccgacgcagcacttcgcggcagaaaaactgtaacgcatcagggccggataaccggccctgttgactcaggctaagccttccgccttaagcgccgcctgcaccgcaggacgttccgcgacacgatcaaaccacgcgcccagcgccgtaaagccggataaatccagtcccagcgcttttgcccagcgcgtcaccacaaacagataggcatccgccacgctgaaatgcagccccatcagccactgtttgtcgcgcagtgactcatcgacatagcggaattttgcttccagctggctgcgggtctgcgctttcacctcatcggagtaaccggggcgaaacagtggcccaaagcttttatgcagctcactgccgatgtagctgagccactccacggtgtgataacgcgtcaggctgccaaccggtgccagcagatggcgatcgggcttaagatccgccaggtactgaacaatggcaacgccttctgtcagcacagaaaccgtcgctgagctgcagcgcgggcacctggcctttaggattgatttggcggaagtcatcgccccgttcagtgatttttgtggccagatcaacactcacctgagtgaagtcgagtccgcattcacgcataacaatatggggtgagagagagcaggcacccgctttgcaaaacagtttcatgaccaggtactccttgttgcaatgggatccttgcatagtaaagagtcaaagcgggattaccagtgacaaagatcagggatctgcgaagggtgttgcggcaagccataaaaaaagccgggcagagcccggcttagctgaagtgcagcgtgaattacgcctgcccgttattttttttcgcgtcaggatcctgcgccatgcggttcagcatcggcgccgtaatcagcatcagcagggcgatcaccgccgtcacgataccaatctgctggaatacgcggctgtaagtcgccagcgaaatcagtggatcggtgacgttttccggcacggccatcaggtttgccactttaccggcaatcaccgccgcgccagcggtagtcaggaaccaggaacccatgataaagcccatcagacgctgaggcaccagctgtgccaccattgccaggccgaggccagagatcatcagctcaccgatactctgcagcgcatagctcaggatcagccagttaacggaaacgataccggcatcgctggcgaacttcgcacccaccggcagcaccaggaacgcagcggagcagagcaccataccaaaggcaaacttgtgcggcatcggcagtttatcgcccagcttgttgtagagcgccgccagcagcggactggccagcataatccagaacgggttcagcgcctggaactgctcgggggcaaaagtaatgccgagaatggtgtgctcaacgttgcggatagcaaagaagttgagtgacgttggcatctgcatataaagcacgaagaacagaatcgcttcgaccatcagcaggaaggcaacaatcatcttacgacgtgccgctccctgcagtgcaaaggcctctttggcaaacaccagcacgatacccagggcaatcacggccagcaccagtcgtgcgatagactggtgatgcagcatccagttggccagtgcgatcagtacgacgatgccgaccagcgtcatcagcagttttccgatctgcaacggagcgaaatcgggtttagaaccgtaatccttaaccatgcgtttgcagaacaggaagttaaacagggtgatgatcagaccgataacgcacagtgagaaggctacgctataaccatatttcgccgctaaccacggtgtcagcatcattgagaagagtgaaccgatgttgatcgacatatagaacatggtgaaagcaccgtcgagacgcggatcatctttgtcatagcaggtagagagcagcgaagaggggtttgccttaaacaggccgctacccaccgcgatggtcgccataccgatgtagacaatgctgacgttatgaccggagaaacgccaccagtgcatagcccagcgccagcaccaggacacccagtacgatgacgcgtttggtacccagcaccttatcaccgagccagccgccaatcgcgaccaggccatacaccagcgcactgaatgaagagaacagagtaatggagtctgattcagacaaccccagttgcttcaccaggtaaaccgccataatggcctgcaggccatagaagccaaaacgttcccataactcaatcgagaagattaagtagaacgccttcggctgtttaaacgcattgagactgacagcctcatcagtgtgtttgtttgcagttgacacatgtacctcagttttttcataccctgtttcgggacaggaattaagtccgcgtcatgtgagttttccatgcgcaagattgttattagaagggaaaagcggcgactaatttggctgattacgggcggcagggcaagaattttctgacaacccgcccgaccctggaatgttgggttaaaaaacttatagcaaactgttaattggtttttaattttgagtgtagggaaaatagcagcgcataagcgctggataagcccctagcactggagagtattaacattaactgctaatgcgtgattaaccagataaatagtttgctgaatgataatcaggcagcactaacggcaggttgctgattaattcacagtcaatctgccgaattatcggacattacacgcctggcattgccgcaaaaaccatcaaatgatgatcctgtgcacaaacagatgatttatttcagaaaggaaaaaaagaaaccggttgcgtcgtctcgtctgacgcgggagctgagggggctcgcaggcgcaggcaagataaaaatcagctcagcctgccggtgaaaagccgcccgtgcgtgttaaaaaacgtatcgcgataatccgctttcagcttgccctcgacagaaaattaacattactgtaacctctcaatttccccgagaaggatctgtttatgtcgtcccccctgcgtttatctctggttggtgactaccgcgccgaggcggttgcccatcaggctatcccccttgctattgaacgtgctgcccgctggctgaatatcaccgctgaagcggagtggatcgccactgaccgactggatgagtcagaaactgcaactcagcgatgccgtctgggtggtgcccggtagcccctatcgaaatgatgccggcgtgtttgacacactccgctgggtgcgtgaaaccggaaagccttttcttggctcctgcggtggattccagtatgcgctgatcgaatatgcgcgcaacgtactgggctggcaggatgccagtcatgccgagacggacaccgaggggaggatggtgattgccccgctgagctgttcgctggtggaacagcgcggcacggtgaggttcgaacccgggtcacgtattgccagagcctacggcgtgctggagagcgatgaaggttatcactgtaactttggtgttaacccggaattcagtgcagcgctgggcgataatacgctgcgcattactgcctgggacaaggcgggcgatgtgcgtggcgtcgagctaccggatcacccattctatgtcgccacgctgtttcagtcggaacgcgccgcactgcaggacaaagattctccgctggtgattgcctggatgcaggcggcgctggcgcaacgctaaacgcgatcaccctgtgacactgtcacagggcgatgctcgtcagcgcagcatggccgggcgttttgcgttaaaggaccagttatcgatcagaaactgcatgcccagcgcatcgtttcggtttttatccggtagcgagttgtagagtgcatgtgctgcttcaacccgttccatattcagggtaatccccagccctggcccctctggcagttccagatagccatcccgaatctgcggcgcatgctgcgtcagctgctgcccatcctgccagatccagtgggtatcaaaggcggtcaggcgatcaccgggtgcggctgcccccagatgcgccaccatcgccagcgacacgtcaaagtggttgtttgagtggcagccggtggtcaggccccactcatggcagagctgcgccacggtgtgtgcgttacgcatcgtccagaagtgtgggtcggccaggggaatgtcgatggcattgagctgcagcgcatgctgcaactgtcgccagtcattggcgatcatattcgtggcaaccggaatgccggtggcccgcctgaattctgccagcgtttcccgaccggaatagccatgctccgcgccgcagggatcttccagatagggaatgcggcccgccagctgtttgccataataaatggcctcatccagcgaccagctggcgttaggatcaaccgttacccgcgcctgcgggaagcgcgccagcagggcattgaccgtctccacttccacttcgccgtgatggactccgcccttgagtttgaaatcgcggaaaccatagcgatccgctgccgcctccgccagccgcaccacgccttccgcgtccatcgctttctcatgacgcagttgcagccaggcatcaccacccgcgtggcccgcctgatagttcatgctggtcaggttacggtcggcgatatagaacagatagccgaggaccggcacccgatcgcgctgcttgccgctggcaagtaactcggccaccggcagattcaggtgctgacccagcagatcaagcagcgccgcttcaatcgccgcggtggcgttgtaaaacttctccgggttcatctgcggaatatgaatgtcgtcggtatgcgcggtctgctggtgtcgcgcgtcgctggcaaacagcgtggcgatggtggcattcagccgcaggagtttcgctgccctcaatctgcggacgaaagcgctcaagcaacgccagcgttgaagcgtgacagggactttcgccgacgccggtacggccagccgagtcagtcaggatcaccaggatacgggtaaagtagcagttgtgtgcgccgccaatgttcagcagcatgctgtcatatccggcgaccggcactacccgcattgttttaatgactggactgtctgacatgttgattctccataggatcaagggaaggcggggatggcttgcggcgcagcagcagccacagcccggtcagcagcgagacgctggtcagggcatagagaccgccggtagtggagccggtcttcatctccagatagccaaacaccgtcggcgcgaagaagccgccaaggttgccaacggaattcaccagcgcaatgcccggcgcgacaatcgaggcgggcagctctccctgtggcatcggccagaaaaaggtcgcactgactttcgagccgatacaggccacgatcatcgccaggaagccaaaccacggggaacccagcgtggccataaaggtgccgcaggccgcgaccagcatggcgacacccagcgctttatcgagcttgtcgcggtggcggtctgaaaagcggctcagcagattaatagcaataatggcgcacagccagggcacggcggtgagaatgccgatgccaaaactgctgaagccctgaatgcgctgaataatctgcggcagccagaacaccagcgtatagccggtcatggtcatagtgaaaaagatcgcgcagaagaacagcaggctgcgattacgtagcagcgacatcttgcctggctcgcggttaagctcgtcacgctgcgtctcttcattctgcagctgctgcaccagcgcctgtttctccgcagcactcagccagcgtgcctcgccaggtcgtgacaccagcacccaggcggcgagaatgccgaccagcaccgacgcaccgccttcgagaaacatcacccacttccagcctgcaatccccatgaaattgtgcatcatcaggatcgcgccggtgatggggccggagaagagaaaggcgccagcggtggcactcagcaccatcgcggtggcgcggccgcgccaggtattgggcacccactgacgaaaatagaacagcacgccaggaaagaagcctgcttccgctacgccaagtaaaaaacgcagcaggtaaaactggatcggtgaggtgacgaaaccggtcaggaccaccaccagtccccaggtaatcataatgcgcgtcagccagacgcgggcgccgaagcgcttcatcatcaggttgctcggcacctcaaacagcgcatagccgataaaaaagaggcccgcgcccagcccaaaggccgccgcgctgatcccggcatcggttcgcaactccgctttgataaagccaatattggcgcggtcgatctggttaataatcagcatcaccaccagcatcgggatgatatgggtgaagaactttttgatggcggaggcgatcagctcatcgtgctgcggggacaaggcgctatccatcggtcttcctcgtgagaaacgtaaagaagagcaaagtgtagggcgctgaaaaggccagctctatgggcatccgcccaggagccgatgggcgtacggcctggacggttgtgttatcagtatgttacggagtggcgtgggcgaagcggcagagtaaaactgtggcagcgatcaacttctcaggaccagggttgaggggagacctgaatgccagaagtcgcgccgacagtgaaagatgtaacagtgcgggcagacaggtttcagccactgaaactgacggcgctgggcaatctcttcagcacgcagcagcagcgcctgcaaatcatcctcgtcaatatccagcagttcaccgtcctgtaaagcctgatgcagatccgcacgcgtcagcgggaccggcatggctaccggatcgggtttaacttcttccggggccagcggatgcggatagcgacgaccggccagattattaaacagcagagccagcagggccagggtcagtgagttgagcaggatcggcgtcaggacaaaatgatatccaagctgctgcaccgaagggccgcccagaatagcggtcagcgcaacggcaccgccgggcggatgcagacagcgcagctggaacattaacaggatcgccacacaggctgcgacgccgcaggcaagggcaggatccgggatcagctggctgacggtaacgcccgccagcgctgacaggctgttgccgccgacgattgcccacggctgagccagcggactggcgggcagaccaaagagtaaaaccgccgaggcaccgaccggcgcgacaaaccacaggttcagttcgcccagcacccagtggctcagcaggctggtcaggatcaagccgataccggcacccagtccggcgatcaccacatgctttttactcactgccagcggatgtggccagaggcgcgccagaaacaggcgcagaggatggcttccggcagaagcgcttttgttcattactttactcactgtgtcataacattttcttatcgtcaggggcggcgattttccatcatcaacatcaatgtaacaacccgacaaactgtactgttattcgtacgaacagggagagcagcgaaaagggggatcgggcaggagacgcgttagcagaagtgatcgccggataataaaaaacccgccgcagcgggtctttcatcagtgcaatcactcgactttgtcgggatactcgcagagatcttcaatcaggcaggagccacagcggggtttacgcgctacgcaggtgtagcgaccgtgcagaatcagccagtgatggcaatcaaccttatacgccgccggaaccaccttcagcagcttctgctccacctcttccacattcttacccggcgcaaatttcgtccggttgctgacgcgaaagatatgggtatcgacggcaatcgtcggccagccaaaggcggtgttgagcaccacattggcggttttacggccgacaccgggcagggcttccagtgccgcacgatcttccggcacttcgccgttgtgctgctcaagcagaatgcggcaggttttaatcacattttccgctttgctgttaaacaggccgatggttttaatgtactccttcacgccatccacacccagcgccagcatcgcggcaggcgtattggccaccggatagagctttgcggtggctttgttcacgctgacatcggtcgcctgcgccgagagcagcaccgcgatcagcaactcaaacggcgtgctgaagttgagtttcggtggtcggatgcggattattctgctgcagccgacggagaatttcggtgcgtttggtctgattcacaccggtttcccgacagcgtcctgaggcggcgcggtttcggccgcctgagcacgcagtgctgcccgctgtttcatcttctgatcgatcagatatttacccgccagcatcatgcccagaccgataaaggcgcctggcggcagcatcgccagcagcattggcgagtcgaaatggaccacttcgatacgcagcgacttcgcccagggacctagcagctggtcggcaccgttaaacagcgtgccgctgccgataatttcgcgcagcgatcccagcaccaccatggcgcaggtcgcgcccatgccgatggcgaagccatccagcgcggcaagcgggatgctgcttttagaggcgacggcttcagcacggccaaccacgatgcagttggtcacgatcagcgggataaaaatccccagcgactgataaagaccataggcataggcgttgatcagcatctgtacgcagctcaccaccgaggcgatgatcatcacataaatcgggatacgaatttccgatggcacccagcggcgcgaggcggaaataaaactgttggtcagggtcagcaccagcgtggtcgccagacctaaacccagcgcgttggtggcggttgccgtgaccgccagcagcgggcagaggcccagcagctgcaccagcgctgagttgttcttccataatccaccgaacagcaggcttttagcttcactcatttgcgtctccacataccggtaacgaagagagtctctccggaagcgttttcattaacagcgcggtgcgtttggttgcattgaccaccgcgcgtggggtaatggtggcaccggtgaactgatcgaattcaccgccatctttcttaaccgcaaaagctttatccgccggaccatgaaccactttgccattaaagctgttgatccagtcagagatacgcagttcgatcttatcccccagaccgggcgtttcgtggtgttcaatcacccgcacgcccaatactttaccctggaaatcggcaccgaccagcatctgtatcgcaccagaatagccgtcaggtgcagtcgtctccagcgcagccgcgaccggctggccgcctttacgcgccaggaagagatgatgcggcgcactgttgcccagcgctgcatccgtgacaacgtaacagtcctgctggatgttgttgtcataaagctcaacaggcaccacctggtccagcaggtttttctgctgcaacagtgtctgatgttccaccgtcggcctggttaccgtatttaccactgccgtggcggcggtagtgatcgcagcaaaaatcgccagcgtaaccccgtttttgcgaatcgtctccagcatcgcttaatccttctgatggccgtaaacgcgcggctgggtgtagtaatcgatgagcggcacacagatgttcgccagcagcacagcaaacgctacgccatcgggataaccgccaaaactgcggatcagccagaccagcagtccaatcagtgcgccatacaccaggcggccacggttggtggttgaagcggtcaccggatcggtggcaatgaagaacgcacccagcatggtggcaccggagaaaagatgaatcagcgggctgttcagcgattctggtgagaagaaccagcccagcgtcgcgcagaaggccagtgacagcagcatggcggcagggacatgccagcggatagcatttttccaaagcaggaacaggccgccggccagataacccacgttaacccactgccagccgaggcccgccagcacgccgttgtaaatcggctgcgccagcagatgttcagcactgtgacccgcgcgtaaaccagttttaaacgtatcaagcggcgtcgcctggctgatgccatcaacacccatctgtagctgctgcatggtttcacccgccagcgtgtggccccggaacaccatgctcaggctgtccatcagcccgggtttgatcgcctgaagcgtatcgggcggcaaccagctggtcatctgcaccgggaaggagatgagcaggaccacatagccgaccatcgccgggttaaacgggttctggcccagtccgccatagagttgtttcgcaatgacgacagcaaacagggtaccgatcaccaccagccaccacggcgccagcggcggcaggctgataccgatcaggacggcggtcagcagcgccgagttatccgcgagggtgctggcaacgggcgctttgcgcagtcgcagaatcgctgcctctgtcagccaggcggtcagcgtcgccagtaagacctgtaaaaaggtgccgtagccaaagaaataacactgtgcagcaaaacctggcaccgcggccagcaccaccagcagcatgatattgccggtgctgcggcgattatgggtgtaaggagaacttgcgatacgaaaagccatttaatcctcaagcgtcgtagacgactgcgctttacgcgctttggcacgggcgatggcggcagcaatagcggccttgcgcgcatcatcgggttgattcagttcaggtgcctgttcaggttctgcattggcgttgtttgcctgctcctgggcctgctccgctttatccaccgcaaaatgcgcggcggtggccagtgcggcggcatcacgagaagcggcatccgcctcactttccgcctgtgcggctttcttctctttagcacgggcgatagcggcctgaaccgcggctttacgcggatcggtatcagcggcagcgtccggcgcagcctctgcagcgctgtcgcctgcggcctgtgcctcggcgttttcagcctgtgcggctttcttcgctttggcgcgggcgatagcggcctgaaccgcggctttacgcggatcggtttcagcggcggctggcgcagcctctgcagcgttgtcgcctgcggcctgcggttcctcggcggattcagcctgagcggctttcttcgctttggcgcgggcgatggcggcctgaaccgcggctttacgcggatcgctttcagcggcagcctctgcagcgctgtcgcctgcggcctgtggtgcctcggcgttttcagcctgtgcggctttcttcgctttggcgcgggcaatggcggcttctactgcggctttacgcggatcgacactggcctcagcctggttatccgccgcctcaaccggcactgttttcttcgctttcgcccgggcaatagccgcttcaaccgccgctttacgcggatcgacggtctgacgcgtcaccggctgggtttcagcctgcgcctcggcctgacgcagacgcgcctgcgcatggcgggcttcacgctgggcttcaagcgttgcctcatccggttcggccgtctggcgggctttcacccgcgctttggccgcagccagttcgctggtatcggtgcgggcaacgcgttgcttcgcctcttcatgacgcgcttcacgagcctgcttttcacgctccagtcgcgcctggcgtgcttcgaagcgtgctttggcttccagcgtgcgtttcgcttccagatcgatggcgcgcagttccgctttttcctgacggtaatattgcaccagcggaatattgctcgggcagacataggcgcaggcaccacattcgatgcagtcatcaatatggtgagcgcgcgctttatcgtgatcgccgccctggctgtaccagtaaagctgctgcggcagcagtttggccggacaggcatcggcacaggctgaacagcgaatgcaggactgctcttcgtcgttgttgcccatttcactggcagatggagccagaatacagttggtgatcttcaccactggcacatccagcgatggcagagtaaagcccatcagcggaccgcccatgatcaccatctgacgcggcgcaggcgtgaacccgacctggtgtaacagatggctgatcggggtgccgagacgactccagacgttacgcggctgggcaatcgcctcgccggtcagcgtcacaacgcgttcggtgatcggttcaccattaataatggcccgcttaaccgcccaagcggtgccgacgttctgcatcagcacgccgatatcggaggaacgcccgccgtgcggcacttccttcccggtcaggatgcgggtcaactgcttggcaccgccggagggatatttggtcgggatgacccggatgtgcagatcacgctcgctacccagcgcctgcttcagtgcggcaatggcttcaggcttgttatcttcaatgccaatcagcacctgttcagcctgtaacacccaggcgagaatacggctgccttccaggacttcggcagcgtagtcctgcatcagacgatcgtcagcggtgatataaggttcacactccgccgcgttaataatcagggttttaaccccgcgcaggccgcccttcagtttggtggcggtggggaaacccgcgccgccgagaccggcaatgccggcgtcgtgaatgcgctgaacaatgtcggcgcgcggatgctgacggtagtcaggcaagggatccagcggcatccagcggtcgtcgccatctggcgtcaggaaaatgcaaagctcagagagaccagaagggtgcgcggtcatatgctgaccgatatcttcaatcacgccggaggtgggcgcatggactggcagcatgcggccagtgccaaatgtcagaggctgaccgcgcagcactttgtcgccaggcgcaacgcagatctcaccttcatgtccgatatgctgtttcagtgggataataaaacggtgcggcaacggcagttcgctgagcggcgtgccgttggactgggttttcatttccggcggatgaataccgccctgaaaatcccagaccttctcttttttcaggaagttaaacagattaagcatgagtttctaccgggatcacccgtacaggaatggtatttaaatcccacttccagttagctggcgtggtggcaaccggacgcatttcaatacagtcagtcgggcagggcgcgacacagagatcgcagccggtgcagacatcgctcagcacggtgtgcatggcgcgggttgccccgacaatcgcatccaccggacaggcctgaatacatttggtgcagccaatgcagttggcttcatcaataaacgccacggtgcgcaccggctctttcgccgtttcatcgccatcaatcggctgcggttcaacgttaagcagggctgccagcttgagcatggtctgctcaccacctggcgcgcatttattgatcgcttcaccattgttaccgaccgcatccgcatagggacgacagcccggatagccacactgaccgcactggctctgcggcaggatggcatcaatctgctcaacgataggatcttcttcgacctcaaagcggcgcgaggcgtaacccagcagcgcgccgaacaccaggctcagcgcacttaatacggcaacagcaatccagatcgcggtcatcagaatttcaccagaccgctgaagcccataaacgccagcgccatcaggcccgcggtaatcagggcgatggagttgcctttaaacggggcaggaacattagccagcaccagccgctcgcgcataccggcgaacagcaccatcaccagcgagaagccgatagaggcactgaaaccatacagcgcggcctgcataaaggtgtggttaaggttgacgctcagcagaggtacgcccagcaccgcacagttggtggtgatcagcggcagaaagatacccagcagacgatagagcgacgggctggttttacgcaccaccatttcggtgaactgcaccacgacggcgatcaccaggatataggccatggtacgcagatagaccagatccagcggcagcaggatcagatggttgaccagccatgcgcagatcgaggccagggtaatgacgaatgtcgtggcgaggcccatgccaatcgccgtttccagttttttggaaacgcccataaaaggacacaggccgagaaacttcactaatacgaagttattcaccagcacggtgccaacaaagagaagcagataatcggtcattttttcgcctgggagccagaaagcggcttattatcattgatagcgcggcgtatctcaacacctgcgccatctgctgagcggcagaccgcactcagaattaaattcctgacataactcacagcgttatggcgcgataaaggtcgtttttacccgttttgagcgtttgaagtagggcgcaaacaccgcagcggccagcagcgacagcagtaatgtctggagggcacggctatcggtaaccggcgtaaaggcaaaggttttcagcgccagcagcacagtaatcagcagccagagcaggtagtgacgcggcaggcggcgggagcgcttaaagaacagccagctgatccagagactataagcccagaccgccacggcggtgagcagggaaatagcccagtaagagaagagtgtgctgccgtgagaaaatagcgccacacgccattccggattaaacagtggtgtcagatacatcgccagcaccagaaacggtggttaacagggtcattatcagccaggccagcggcagcaaaagccagccaccaatacgcggcgcagcaacctgttcattcatcgtggttattcctgtctcggggagtcgaagcgcagcagaataacatgtccagaggggcacgcccatccggacaagatcagcgggataaacagcgataaatcagccggaaatcagaccacgtagcgccacaccgttttagggacacagccgagatcatataaccgtccgccagagaccaattcagcacgtcggtgatcggcagcccggtacatattgatgatttccagatcattcgtcagggagtaattaagatgatcgaaaagcttttccagactgtctgaattatttactttgcggaatttaagcaggtaatcgtgcgcagtcatcattgccataacagatagaagtaacaaaggagtgctcagtatagggggcaagcttatgctgtccagatcatgcggcttaaaaaaggcgaaaatcagataaaagcaccttattagtcactaaaactccatatctggcttttttactattgtctgagccagcaactcagcgtctctatcttaaacacctcactaacttattacggacagagccggcataaagcgtttaaaagcagaggttaaatattatttttttcttattcagcgctgacaatgcattagtggcttctttctcacccttttagcccaaaaaaattaaccattctgcacttagtgccagagaaacgtttcgcgcctgactcaggccagcgatctactgtgcggactatcacaaatcccattttttgttcatcgcaggccggataacccgttttgtacgcctggctgtaatcgtttccagttgcagtaagcataagcgattctgtttattacaattatttaacgagcagattttttctgctcagccgttttatccataactcccccgtcagccaaaccgtgtgactacacgtaacccctttaaattgctctgttttgtgaagtgtgtcgccattatgcacccttttttagtccagtctaagcaggctctctaccctaaacagcaaacgcctttcagaggattaaaaactatgtggaaacgtttacttctgaccacgctggtcagcgccgcgttaaccggcccggtactcgctgcagatatgacggtcggcttctcgcaggtaggttcggaatctggctggcgttcggcggaaaccaacgtagcgaaaagcgaagccaaaaaacgcggaatcaccctgaaaatcgccgacggacagcagaaacaagagaatcagatcaaggcggtacgttcgttcatcgctcagggcgttgatgccatcttcatcgcaccggtggtgcagaccggctgggagccggtactggaagaagccaaagatgccaaaatcccggtttacctgctggaccgcgccattgtggtaaaagacaaatcgctctatcaggcggtggtgacggctgacaacgtgctggaaggcaagctgattggcgactggctggtgaaaaccgtgggcgacaagcagtgtaacgtggtggaaactgcagggcacggtgggtgccagcgtggcaattgatcgtaagaaaggctttgctgaagcgatcagcaaccatccaaacattaaagtgatccgctcgcagtcgggtgactttacccgcagtaagggtaaagaggtgatggagagctttatcaaggcggagaacaacggcaaaaacatctgcatggtttacgcgcataacgatgatatggcgatcggtgccattcaggcgattaaagaagctggcctgaaaccgggcaaagatattctgaccggctcgattgatggtgtaccggatatctataaagcgatgctggcgggtgaggctaacgccaacgtggagctgacgccaaacatggctggcccggcgtttgatgcgctggaaaaattcaagaaagatggcacgctgccgccaaaagtgatcaagaccgaatctaagctgttcctgcctgccgacgcgcagaaggagctggataccaaaaaaggcatgggttactgattcaccgatcagccgcagaccagccgcagaccgccctacggggcggtttttcatgacgtgaggcggagtgagcagaatgaccacgcaaaatgaaacaccgctgttatccatcagcggcgtcagcaaaggttttcccggcgtcaaagcgctgaataatgtttcctttgatatccgtaaaggggagatcatggcgctgctgggggagaacggtgccggcaaatccaccctgattaaagtgctgaccggtgtttacagccgtgatgcagggactatcaccctgaatggtgagccgattacgccgcataatacggcgcaggcgcaggagatgggcatcggcaccgtttatcaggaagtaaatatgctgccgaacatgtcggtggcagataacctctatattggccgcgaaccgcgccgctttggcatgatcgaccgtcgccggatggtgcgggaggccgatgcgctgatgcggaattatggtttttccctcgatgtgacacgtccgctgggccactactcggtggcgatgcagcagattatcgccatctgccgcgcggtcgatctttccgcccaggttttgatcctggatgagccgacagccagtctggatgccagcgaggttgagatgctgtttaccctgatggcgcagttaaaagccaaagggatgagcctgatttttgtgacgcactttctcgaccaggtgtaccgcattactgaccggattaccgtgctgcgtaacgggcagtttatcgccacccgcgataccgccacgctgccgcagattgagctgattaagctgatgctgggtcgcgaactgctggagacggcgctgcagcggcagggcagcacgctgcgcagcaatcagccggtggtgtcgtttgaggattacggcaggaaaggcaccatcgagccctttaacctggaagtttcgtccaggcgaagtagtgggactggcggggctgctgggttcgggccgcaccgaaaccgccgaggtgttgtttggtattcgtcgtgccgaccgaggaacagcgaagatcaaaggcaaggtgcagcgcattactaatccggcgaaagcctcgcagctgggcatgggtttttgcccggaagatcgtaagactgacgggattatcggcgcggcctcggttcgtgaaaatattattctggcgttgcaggcgcagcgcggctggctacggccaattaagaagcgtgagcagcaggcgattgccgatcgttttatcaagagtctgggtattcgtacgccgcatgcagagcagcctgtggagctgttatcgggcggcaaccagcagaaggtgctgctgtcgcgctggctggtgaccaaaccgcagtttttaatcctcgacgaaccgacgcgcggcattgatgtgggcgcgcacgccgagattatccgtttaattgaatccctgtgcgccgatggtctggcgctgctggtgatctcctctgaactcgaagagctggtcggttatgccgatcgggtgttgattatgcgcgatctgaagcaggtggcagaaattccgctggagcagctttcggtagcgtcgatcgtcaatgctatcgcggacggaggggtaaaacatgcttgagtcccctatgacatctgaaaaaacgccacgtcgtaagctgaaactcccgccagggatgccgcaaatcgccgcgctgctgttggtgctgttgattgacagtctggtggccaataacttttttgccgtgcatctgcaggatgggcgtctgttcggcagtccgatcgatattcttaaccgtgcggcaccggttgccctgctggcgatcgggatgacgctggtgatcgccaccggcggcatcgatctttccgtgggtgcggtgatggcgatagcaggcgcgacggctgcgacattgaccgtagccggacacggtgtgccgtttattattctctgcacgctgggaaccggtttagcctgtggcgtatggaatggcgtgctggtggcgctgctgcgtattcagccatttgttgccacgctgattctgatggtcgccgggcgcggaatcgctcagctgattacgcaggggcagattgtgacgttcgacagtgacagtcttggctggtttggtaacggctcgctgtggatgttgccggtcccggtctggatcacactggtggtagcgctggcggtctggttgctgacgcgcaaaaccgcgctgggtctgtttatcgaagctgttgggattaatctgcgcgcggcccgtaacgcgggtgtgacaggctggctggtggtgatgtcaacctacgccataagtggcgtttgtgccgctgttgcggggctgatcgtcgcggcggatattcgcggtgcggatgccaataacgccggattatggctggagctggatgcgattctcgccgtggtgattggcggtgcgtcgctgatgggtggccgttttaatctggtgttgtcgctgatcggcgcgctgattattcagtcgatgaataccgggattttgctctccggcttcccgcctgagctgaatcaggtggtgaaagcggtggtggtgatgtgcgtgctgttgctgcagtcaccacggtttattgcgatgttgaaacggagacgcccgacatgattaaacgtcatcttccgctgatgatcaccttgctggtgtttgtggcgggttacctgttttgtctgagtcagtttccgggctttgcctccacccgggtaatctgcaatattctgaccgataatgctttccttgggattatcgccgtcggcatgaccttcgtgattttatcgggcggtatcgatctgtctgtgggtgcagtgatcgcctttaccggcgtgtttcttgcccgggcgatcggtgattttcatatcgatcccttgctggcctttgcgctgattctgtcactgggcgcgctgttcggcgccatgatgggctggctgatcgatgcactgaagattccggcatttatcattacgctggcggggatgtttttcctgcgcggatgcagttatctggtgtcggagaactcaattcctatcgatcatccgttctacagcatgctttccagtctggcgtggaaagtgccgggcggtgggcgtctcagcctgctggcggtgattatgctggtggtggtgtttggcgggattattctggcgcaccgcacgcgctttggtaaccgggtttacgccatcggtggcaatatgacatccgcccagctgatgggcgtttcgacccgtgcgaccaccattaagatttatatgctttccaccacgctggcgacgctggccgggatcgtgttctcgatttatacctcggcaggttatgcgctggcagggctgggtgtggagctggatgcgatcgcgtcagtggtgattggcggcacgctgctgtcgggtggtgtcggtacagttttgggcacgctgttcggtgtgttgattcaggggctgattcagacctggattaacttcgacggtacgctgagttcctggtggaccaagatcgccatcggaattctgctgtttgcgtttatcgccctgcagcggttactgacggtcatctgggatcgtcagcagaaacgcgcccgttaagcgattaccttcctgagttcttcagtactccgatcaatggcggctcgcaggagccgccttttactgcgcaagacgcagcaccatgaccgtgacctcttcacccgcgatttgccgctgttccaccgcctgccatcctgaacgctgatagtacgcctgttgatcgggtgtatagagccacagttcacccatctgctgttgtctggctcgcgcaatcgcctgctgtattaacgcttttgccacgccctgaccccggaatgccttgtccgtcaccacctcaccaatccagaattctcgtgccggaatgtcatccagttcatagcgaatgacgctacaggtcgcgaccaccgtttcgccatccggtgtggcaataagagtaaattctgccgaaggtttctgattgcgctgttttaaacgctcaaggatggcaggcgggtgagaccatgcaggaagatgtgaccattcagtgtgcaacagttgtgcggtttgtccggcgaagccgggatgttggtttagctcggcaatgtgcatggcgctggcgacctttgttttgtcaggctacaagcaatacaggctggtgggggaaagtgcaagttcatgaaagggttaagttatagcaaagacttaggttctcttttgtatgacagtaaaaacaatcgctattggatttaggtgcaaggtcaggaaaggtatgcctgatcgcaaaggattcccgcatccatgcggatcggccgcgtcatccctggcgcggacgctttgctcttcaggcatatctttccttcccggttgggctgatgcatcgctttaagaagcaggacagtggatatttctattgatggtggattaattcaaattgctgttggctgatgagaaaggtcaggaaagatatgcctgatcgcaaaggattcccgcatccatgcggatcggccgcgtcatccctggcgcggacgctttgctcttcaggcatatctttccttcccggttgggctgatgcatcgctttaagaagcaggacagtggatatttctattgatggtggattaattcaaattgctgttggctgatgagaaaggtcaggaaagatatgcctgatcgcaaaggattcccgcatccatgcggatcggccgcgccatccctggcacggacgctttgcttttcaggcatacctttccttcccggttgggcttgatcatggctttaaaaacatgcgctgaactatcaaaattatggaacgcccgtcattcccgactgaatagcatagtatttatcaaaaaccgatgccgcataatcctgcgtcagccgtttcattaacttacttaagagcgctgttaattaaaaaattgaacagcgccctttagttattaacgtttcaaacggtaatacgcttcgttccagcgcagtgcgtctttaaacgcaggtaaacgcgtgtgctcatcaatcaccagcacttcgatatcgttcatctcaccgtacagatacatatcatccagcgtcagcgcctggctgaacaccgtatggtgcgcgccgccgcccagaatccacgcttcggatgccgttgccagtgacggctgggctttccacagtgcgcgcgcaaccggcaacttcggcagcggtttcggctgtttcgatagcatccaccacgttaaccagcagacggaaacgatcacccatatcaattacgctggcgttaatcgcgcgacccgctggcgttgagaaaatcatgcgcgccggatcggctttatcaccaatgcccaggaactgcacatcgatcaatggcttctcttcaatggcaatcgacgggcagacctccagcatatgcgagccgagaaccagatcgttaccgggtgagaagtgataggtgtaatcctccataaaggaggtgccacctttgcgatcgcctgccagcactttgaaaatgcgcagcagcgcagcggtcttccagtcaccttcacctgcgaagccatagccctgacccatcagacgctgaaccgccagacctggcaactgcgtcatgccatgcagcgtctggaagttggtggtgaaagcgtggcagccttctgcttccaggaaacgcttcagacccagctcgatgcgcgcggcatccagcacgttctgacgcttttcgccgccggaagcggcaacatcggtaaagcgataaaggctttcatattcatcgaccagcgcattcacgtcgccatcgctgacgccattgatcacctcaaccagatcgccgacgccccagccattcaccgaataaccgaactgaatctgcgcggcgactttatcgccttcggtcacggccacttcacgcatgttgtcgccaaaacgcgcaactttcagctgctgactggcctgttttgtcagtgctgcacgcatccagttgccgaggcgctgctggctggcgctatcctgccagtgaccggtcaccacgctgtgctgcaggcccatacgggcgccgatgaaaccgaactcgcggccgccgtgtgcggtctggttcaggttcataaagtccatgtccatgctgtcccacggaatctccgcattgaactgggtatggaattgcagcagcggcttattcagcacgctcagaccaccgatccacattttggccggggagaaggtgtgcagccaggtaatgataccgacgcactccttgtcataattggcgtcgcgacacagagccagcgcttcatccggtgacttaaccagcggtttcagctccagacgcagcggtaaaccggcctgatttaaaccctctaccacctgacgtgcattctgttcaacctggcgtaacgtctccgccccgtagaggtgctgcgtgccgatgacaaaccacacgctgtagctgtttgactgttccataaaatcactcctttactttgagcctacctcaataggctattttatttgttagtctgaacctgggcagtgctcacacaggctgctttagcaacctgaacgcccgtcagggcggccctgaaagggcgagcgtagcgagtcatcctcacgtactccgtgtactacggattgttccgcgctgtccgtgtccagactgcctgcaacattacgcctgctgagataggctcttagcggaagcggggcgtgcggcgtattgcggttcagccgccacgcaccattgttgatagcgttgataaagttgttgatagcgtgcgacgcgcgccggatcgggctgcagcgtcacggcaatcgggctggccatcacctgctgggcgtcgggaaacgctggcatgcacaccggcggcgacggcggcgaaaatagccgcacccagcgcacagcactcgtcagaagcgacgatatccagtgggcggttcatcacatcgcagcaggcctgcataatcgccggggatttccgcgcgatgccgcccagggtcagaatgctctcgaccgggatctgctgttgctcgaagcactccataattgcgcgtgcaccaaatgcggtggcggcgaccagaccaccaaacagggcgggggcatcggtgcccagattgaggtcggtaatcacccctttcagccgctgattagcatttggcgtgcggcgaccgttaaaccagtccagcaccaccggcagatggtcgagctgcgggtttgcggcccaggcctcggtcagatctttaatcagactcttttgcatctcagccagctgaggcttcagctccggatgctgctgcgccgccagctgcagcggccagcccagtaaacggctgaaccaggcgtagatatcaccaaaggcagactgacccgcctccagcccgatagcgcctggcattacgctgccatcgacctgaccacagatgcctttgatgtcgcgatcgccgaccttttcactatccgcaatcaggatgtcgcaggtcgaggtgccgatcactttcaccagggtatagggtttggcaccgccaccgaccgcgcccatatggcagtcaaatgcgccacccgaaagcgtcacggtttgcgtcaggccaagacgctgcgcccattcagggctaagcgtgccgacaggcagatcagcggtccaggtatcggtaaacaggggagagtcgagctgttgcgttaacagcgggtccagcgcattgagaaaatccacatcgggcaggccgttccagtcgccgtgccacagcgccttgtgcccggccgcacagcgcccccgacgcaatttgtcaggtgcggtggtgccgcttaacagggctggcacccagtcgcacagctcgacccaggagacagcggcgtcacgcacggccgcatcttcacgcgacacgtgcagaatcttcgcccagaaccactcagaggagtaaattccgccaatatagcggctgtaatcctggaagcggccgctgtggcacagctgattaatctcttctgcttcttctatagcggtgtgatctttccacaacacaaacatcgcgttggggttgtcggcgaactccggacgcagcgccagcacgttgccgtcgcggtcaataggggcaggggtcgaaccggtgctgtcaacaccaatgccgaccacggcgttgcgctgatcttcactcagtgcattcagcacgccgagcagcgcctgctccatggcgtcgatgtaatcctgtggatggtgacgaaaacggttagtgtgcggatcgctgtataagccctgttgccagcgcggatagctgaacaccgcactctgcagctctttgccgctatgacaatccacggccagcgcacgcaccgaatcactaccaaagtccagcccaagggtgatggctccagcacgcatcggaatctcctgtagttagttaactcctgtatcctgggttcggcgcgccaaatcagttagtcatcgctggctgacaatatgcacttttctgtcatcggcagtgattttgtgatccattgcaaaagttaaggtccggttaaatttgctgaatatatggatcattttgtcgtgattttaagatgtgataccgctctacatttttcttcgctaataccgctaaaactagcccagcgtctggacagtctgtcagcacatgccagcctaacgcactgatttatggctgtacccacaaaacaaaacaaactggtagcgtttacaccgattcgttattagcagcgaaaaataacctggtaccggagagcatcatgcataaattcactaaagcgttcgcggccatcggcctggcagcggttatgtcacaatccgctatcgccgagaccatgaagctgggattcttagtcaagcaaccagaagaaccctggttccagactgaatggaaattcgccgacaaagcgggcaaagatcttggctttgatgtcattaaaattgccgtgccggatggtgaaaaaaccctgaatgccatcgacagcctggcggctaacggcgcgaaaggttttgttatctgtacgcccgatccgaaactcggctctgccatcatggcaaaagcgcgtggctacggtctgaaagtcatcgcggtcgatgaccagtttcgtcaccgccaaaggcaaaccaatggataccgtgccgctggtgatgatggctgcgaccaaaattggtgagcgtcagggtcaggaactctataaagagatgcagaaacgcggctgggatgtgaaaaccaccggcgtgatggcgattaccgctaacgaactcgacaccgctcgtcgtcgtaccggcggctccatggacgccatcaaagccgctggcttcccggcagcgcagatctaccaggtccccaccaaatctaacgacatccctggcgcgtttgacgccggtaactctctgctggttcagcatcctgaagtcaaacactggctgattgtcggcatgaacgacaacaccgtgctgggcggcgtgcgtgcgaccgaaggtcagggctttaaagccgctgacgtcatcggtatcggcatcaacggcgtggatgccatcagtgaactgtcgaaagagaaggcaaccggcttctacggatcgctgctgccaagcccggatatccacggctacaaaagcagccagatgctctacaactgggtcagcaaaggtgaagagccaccgaaattcaccgaagttaccgatgtggtgctgatcacccgtgacaacttcaaaactgaactggcgaaaaaaggactgatgtaaccctgagcctgccaggcagtttgtcgcctggcatccttaatagccaatttcgcgccgcccgccataaccggccggtggcgcgaaagagtgaggaaaaacatgaacactgattcagcatttctgtcgtttcatggcatcagtaaaaccttccctggcgtcaaagcgttgcaggatatctccttcgactgccgtggcggtgaagtccatgctctgatgggcgagaacggcgcaggcaaatcgacgctgttaaaaatactcagcggcagttatcagccgagcggcggtgagattcgtattaaaggccagccgatgagctttcagcgcaccaccgatgcgctggacgcgggcgtcgccattatttaccaggaactgcatctggtgccggaaatgagcgtggcagagaacatctatctcggtcagatcccgcacaaacatgggctggtcaaccgtaagctgatgcgttttgaggcgggcctgcaactgaaaaatctcggcatggatatcgatcccgatatgccgctgaaatatctgtcgctggggcagtggcagatggtggagattgccaaagcgctggcgcgtaacgcgcgtattatcgcctttgatgagccaaccagctccctgtcggcgcgtgaaatcgacaacctgttccgcgtcatccgtcagctccgtgaggagggccgggtggtgctctacgtttcacaccgcatggaggagatcttcgccctcagcgatgccatcaccgtctttaaagatggccgctacgtgcggacgtttaccgatatggctaacacccatcacgacgatctggtgcaggcgatggtgggacgaaaccttggtgatatctatggctattcaccgcgtgccaaaggcgcggtgcggctggagctggacaaggtcgaagcgaagggcgtgcggacgccgatttcgctgaaagtccatgccggtgaaatcgtcggcctgtttggcctggtcggtgccggtcgcagtgaactgctgaaagggctgtttggcggcacgcgtctgcgcggcggtcaggtgattctggacggcaaaccgctgccgctgcgggagccgatcgatgccatccgtgcgggcatcatgctctgcccggaagatcgcaaagccgagggcattattccggtgcattcggtgcgcgacaacatcaacatcagcgcccgtcgtcataaccttactgcgggctgcctgattaaaaacggctgggaaaataaaaatgccgacagccatatccgctcgctaaacatcaaaacgcccagcgccgatcagctgatcatgaacctttccggcggcaaccagcagaaggcgattctgggacgctggctgtcagaggatatgaaagtgatcctgctggatgagccaacgcgcggtatcgatgtcggtgccaagcatgaaatctataacctgatttatcagctggcgaaccggggcattgcagtgctgttcgcctccagcgatttaccggaagtgatgggcctggccgatcgcatcgtggtgatgcgcgaaggtgccattgccggtgaactgctacacgacgacgccacggaacagcagacgctgagcctggcgatgcccaaaaccactcaagcggccgccgtggcctgacaggagatcatcatggcttcatccacgacctcaaatacgccgcagcccgcttcacgcggcggcctgcagttaggtcgcatctgggacaacttcggcatgctggtggtatttgcactgctgtttattgtctgtgcgatctttgtgccgaacttcggctcgtttatcaatatgaaaggcttagggctggcaatgtcgatgtccggcatggtcgcctgcggcatgctgttctgtctggcttccggtgattttgacctgtcggtcgcttccgtcatcgcctgtgcgggtgtggttaccgccgtggtgattaacatgaccgaaagcctgtggattggcgtgggtgccggcctggttctcggtatgatcaccggctttatcaacggctttgtcattgcccgactcaagatcaatgcgctgatcaccacgctggcgaccatgcagattgtccgcggcctggcctatatcttctctgacggtaaagcggtcggtatcgaagatgagcgtttcttcgaactgggctttgccaactggcttggcgtgcccgctcccatctggctgactctggccaccatgctgatcttcggcttcctgctcaacaaaaccacctttggccgtaacaccctggcaattggcggcaatgaagaagccgcacgtctggccggtgtgccggtggtgcgcacccgcatcatcatctttatcctctccggtctggtttcagcggcggcgggcatcattctggcgtcacgtatgaccagcggccagccaatgacctccatcggctatgagctggtggtgatttctgcctgcgtgctgggtggcgtttcgctgaagggcggcatcggtaaaatctcctatgtggtggcaggggtgctgatcctcggcacggtagagaatgcgatgaatttattgaatatctcgccattctcacagtatgtggtacgcggtctgatactgttagctgcggtgatttttgaccgttacaaacagaaaaaagcctgattgagcgagccgttggtccgcagaggcagaagcctctgcgggctatccgaacaataacagactgagtgaggacgctatgtatcaccgcgaattaccggccgagcagcaaaaccccttgttgccgggctattcattcaatgcctggctggtggcggggctgacgccgatcaccgccgatggtccgctcgatttctttatcgatcgcccgcacggcatgaaaggttacattctgaatctcactatcaaaggtaaagggcgggtatttgacggcgagcgggcatttgactgcgaacctggcgaaatgctgctgtttcagccgaaaacggctcactattatggtcgcgcgccggacagcccgcagtggtttcaccgctgggtctatttccgtccgcgcgcctactggcacgactggctgcgctggcaggatgagcaggagggcgtgggacgtctgctgctgcctgaatcgctgcgcggcgaatttgatcgcctgtttgccagtatcgaacagacccacaattcgggccgtcgctttgcagaagagctggcgatgaacctgctggaacggctgctgctgcgcgccgttgaagaagatccacgcagccatcagttaattcgcgatccacgcgtgattgaagcctgccagtacgtcaccaaccatctcgccagcgaggttaagattgaagaggtggcgcgccacgtctgtctgtcgccgtctcggctcgcgcacctgttccgcgagcagatgggtgtgaacctgctgcgctggcgtgaagatcagcgtgtaatccgcgcgaaactgctgctgcagaccacccaggagccgatcgcctcggtaggacgtgaagtgggctatgacgatcagctctacttctcgcgggtgttccgcaagcgggtcggcgtcagtcccagcgacttccgccgccgtaatcaggatgcgcacgacagcctggccgctcagaccgcctggccgctggcgcgaagtgctatctcttagttttttcggggaattccggcttgtcgtcatttggttaatagtcttaaatcaatcaggttatcaactaagagtctggtcaatcaggctctgagaggaatccaaatgagcgataaattacgtgttggtctgatcggctacggttttgccagtaaaacgtttcacgccccgctgattgcggggacgccggacgtcgagctggcagccatttccagtagcgacgccagcaaagtccacgccgactggcccgccgttaaggtagtggccgaccctcaggcgctgctggacgacccgacgctgcaactgatcgttattcctacccccaacgacacgcacttcccgctggcaaaagcagcgctgaacgccggtaaacatgtggtagtcgataagccgttcaccgtgacgttgtcacaggcacgtgaactggatgcgctggcgaaagccaaagggctgctgctgtcggtgttccacaaccgccgctgggacagtgacttcctgacgctgaaatcgctgattgaggccggtacgctgggtgaagtgcgctacttcgaatcgcactttgaccgcttccgtctggaagtgcgtaatcgctggcgtgaaatgaaaggcgcaggcagcggaatctggtatgacctggggccgcatctgctggaccaggcgctgcagctgtttggcccgccggtcgctatcacggttgatctggccgagatgcgtccgggcgcgcagactaccgactacttccacgcgacgctgacttatccgcagcgccgtgtcgtgctgcacgccagcatgctggtagcggcagaatctgcccgttataccgtccacggcacgcgcggcagttacgtcaaatatggtcttgatccgcaggaagatcgcctgaagtcaggtgatttcccgccgcaggaagactggggctatgacatgcgtgatggcactctgacgctggttgacggagattccctgaccgaaacgacccagctgacccagccaggcaactatcccgcttactatgcgggcatccgcgatgcgattgccggacgtggtaacaatccggtgacagcggaagaggcgattcatgtgatggagctgatcgagttaggtctgcaatccgccgagaaacgccagacgatgtcgctgaagcgcgtttaatcggtcggtgcttaaaacgcaataagtaaaaaagccaaacgggccggatatccggcccgttttttgtccctacgcttcaggattactgcacccgtgcgcgaagagccgctttctctgcttcgttaaggaacgcaatcgtcagaccattttcctgcgcctgacggatctgcgccgcgctcagaccggcagccggagcggcgtgatgatactcatgcgccagttcaatgccctgaaccgccggatcatccgtgttgatcgtcgccagaatgccatgctccaggaaggtcttcagcggatgctgcgccagtgatggcacggtgctggtctggatattggaggtcaggcaggattcaataccaatacggtgctccgccaggaaatccatcagcgcgcgatcttcaatcgctttcacgccgtgaccgatacgttctgcacccagctcccgaatcgcctgccagatgctctcgggtccggctgcttcgcccgcatggacggtcacgcggaaaccggcatcgcgcgcctgggtaaagtggctcaggaaactcgctgcccgggaagcccagctcatcacccgccagatcgaccgcggtgatgtgatcgcgatgggcaagcaaaccttccagttcgctgaggcaggcatcttcgccaaaggtacggctcataataccgatcagacgcacgtcgatatcgtgctgctgacggcctgcgcgcacgccctcaattaccgcttcaaccacaccggcaatcggcaggttgtgggtcatcgccatataaccaggggaaaaacgcagttcagcatagtgaatgcccgcgcgggcggcatcttcgacattctcctgcgcgatccggcggcaggcatccagatcacccagcacttttacaccccagtcgagcttctgcaggaagctcaccaggtcaggctcattctggccgacctgcacatgcggacgcagcgtctccagcgtggaagcgggcagggctaggttaaactggcgacctaaatcgagaatggtttgtgcacggatgttgccatcaaggtggcggtgaatatcagtcagaggaattttagaatcgatcatggcgcactcgctcagttgtcggtgaagtgcagagcattataaaaatatcttgcgcaacagcgccagctatttgcgcaacagctgcgccggatgctgcttaattacgcataaccggcgagcaatggttgcctcgtcggttaatgtcagccctgcaactgatggatcgccgcaatcaggcgtgaaacgccctcatcaactttgctgcgcggacagccaacgttaagacgcaaaaaccctttgcctgcatcaccgtaggtcgatccgggcataattgcgacccgttgctggatcagcgcctgttgcagggcctcttctggaatgcccagcggattgatatcgagccaggcgagataggtcgcctcgggaatgtgccagttcagtgcgggaaactcagcgttaagccgattggcaaccagtatgaaattaccataaagatagctgcgcagggcatccagccagggtgcgccttgtcggtaggcggcaacgtgtgccgtgacggccagcacggccggagacgaaaggccgtcagcatttttcagcgcctgaaaccaggcggctctgtctgccgcatccgggataattccccacgcaccggtcaggcccggcacgttgaagcttttcgacgccgaggtaaacagcgcccagtcactgcgcgccacgctggcccacggagtatggggctgattacccataatcatatccatatggatttcatcgctgatcacccgcacgccgtgacgatcgcagagcgccgccatctgttgcagctcagctgctgtccacactttgccggtgggattgtgcgggctgcagagcaacaggattttgcagcgcgggcgcgccagccgcgtctccagcgcggccatatcacatcgccagctaccgttatcccgctgcagcggcatctccagcacctgtcgctgattgccgcgtaccgttttataaaaagcatcgtaggcgggagtgtggagcaccacttcatcatccgggttgctccagcggcgcagcatctgcgccaccatatagatcaccgaggggccataaaccaggctgtcagcatcgggctggtagccgaaacggctggacatccagtggcagcaggcggaaagaaaatcatcatgctgccagcgactgtaacccaacacgccgtgtgctacgcgctgcgccagcgcctgctgaaccgctggcgcagttctgaagtccatatccgaaatggtaaacggaagcagatcggggacgccaaagcggtcagccacgaaatcccactgggtcgaccagctgccgcggcgatcgatgacttcgtcaaagttaaacattatcggctccggcacatcaggcaggtacattcatcaggtgtgacagttcatctttcaccgactgcacctgtggaccgataaccacctgcaggctggtctgattaagatggaccacacctatcgcgccgttggctttcagcgacgcatcatccactttactcatatccgccagggtcagacgcagacgcgtcagacaattatccagcgaggtaatattctccacgccgccaagtgccgccagaatagctggtgagttatagccagatttgcctttaccggcattgctgacctgctgcgcaaccgcactggcactttccacttcgcgtcccggtgttttgatattgaagtgcagaatggcgaatcggaaaatcaggtagtaaccaacaaaccatatcgctgcgacaacgggtacccagtaccatttggtcgacagcccgtgcagcacaccaaacactacaaagtcgatgatattgccgtctgtattgccgatagtgacgcccagtatcgccatgatgctgaagccaacgccggtcagcagggcgtggatcagatagaggaacggggcgacaaacagaaacaggaattcgataggttcggtggtgccgccaaccacgcaggccaccacgccggagatcaacaggcctttaatcttatggcgattctccgggcgggcgcagtgatagatggccagggcagcacctggcaggccacccaggaacgcaggcattttaccctgtgacaggaagcgggtcgcgctttcagcaaaaccgtgggtttccggacaggcgagctgcgcctggaaaatggttaaggcaccgctcacgctcttgccacacacatccagtgtgccgcctgcatcggtaaagcgcatgatggcgaccagaatatgctgcaggccaaacggcagcagcagacgttcgccggttccaaagatcatcgggccgaaatcacccgcgctgtttatcatccagcctaatccggtgataccccgcgcgaaaaaaggccagatcagcgggacgaccagtcccagtaaaccaatcaccagcgtggtgataatcggcacaaaccgggtgccgccaaagaaagccagcgcatcgggcagtcggatgttatgaaagcgctcatgcagacagaacaccacaatacccacaatgaccgcgcccagaatgccggtatcgatcgacggtatccccaggatcggctgaacgttgttagctttcagcagggcggcatcggtggttggcagaatgccgtggatattgagccagaagttgatgctgaggtttagcacggcataccccacaaagccggcaaacgctgccacgcccttgttctcgcgcgccatacccagcggaattgcaatggcgaacatcaccggcagatagctaaaggcgaaagatccgagtttggccatccagagaaacagatattgcagccaggggtgatccagcacaggtaacagggtcaggacatcacgactgctcagcgaactgccaatcccgagcatgatgccgcagaaggaaagcagggcaaccggcagcataaaggttttccccagactctggaaaaattcccagacggacattttttggtgagagggtgacatgaacgctcctggataaacggaccactgagtgaagtggcgggatgataaaacgttttacctggatcttatgcgcgctgaatcacactcttcaggtcatggacgatataattctgacgtcataaggtgtaacgttttaccttgttttctaatgctgtagttcagttgagtaatctgatgagtaaaatcaccatcaatgatgttgcggcggcggcgggcgtgtcggtgaccacggtatcgctggtgttatccggcaaaggacggatctctgcggccaccatggcgcgcgtgaacgaggccattgagcaactcggtttcgtacgtaaccgttcggcaaccatgctgcgcgggggtgagagtggcgtgattggcttgatcgtccgcgatctcagccagccattttatgccgaaatgacggcaggtctgagtgaagcgctggagaagcagggcaaattgctgttcctgacgcagagcggcgcccagggacagcatctgcatcgctgctttgagtcactggtcgctcagggagtggatggcgtggtgctgggaggcggtgccgataaggccagccagattgtgacacgggccagagaggtaaatatggccttagtctgtgccgcgcgcgccagtagcctggaggaggtggacgctattcgccccgataatgctcaggctgcgcgtctggccaccgaatacctgattcgtcaggggcatcagcgcattgcctggctgggcggccatagcgcatcattgacccgggcagagcgtcttggcggctactgcgccaccctgctgcaatatgggctgccgttccggcctgagtggattattgaatgcggtaacacgcaaaaagaggcggctgaagcagcggtacagctgtttcagcatcatccgcggctgactgccgtgctagcctataacgccactaccgcgctgggatgctattttgggctgttgcgcaccgggcgaacgttcgcccggggtgcagtcgacagctattacgatcagcaactggctctgatgggctttggcgatgaaccgcaggcggaactgaccgatccgccgctgacgtttgtcaccagttcagcccgggagattggccgtgtggcagctgagcgtatcctgcaacggatagcgcaacccgatgccgcccggcagaacgtgattatgccgccgcagctggttattcgcggctcggcataaaaaaggcgacccggaggtcgcctttaaaagaaaagtagagaattactgcggcatcccttcgctggtcggcatacccagcatatagcgggagaggaactgctccagcgtcattttgtcgccgttcatgttcacctgaccgttggtatactgcaggctggtgacgatattgttatcctgctgctgggtcaggcggaacatctgacccatcgccgccagtcctttcacctgctgatctgccagcttctgtgcgtcatcggcctgatatccttcagccagtcccactttatgcatggtttcggtcgccattggcatattgatgaccagcttgctgtccaggctcttgagtacccgatcaaccatggcgctgagtgtctgggcttcgccggtcaccgcagagggatcgttgaaatttgcgttcaggttaaaggtactttcacctttatcatttttccagctcagcggggcgatactgatcgcaggtgagcccttcagcagcatcggcagattgctcatcagaatctgatgcacacccgcctggtagcggataggatcttccgcgacgccaggctggctcagcagttcctgcatctgcgcgttgtaacgatcggagaaggcttttaccgcctgcgcatcaaactgtgacagtttcatcttcagcgctgcctgaccaaaatcctgcttctgcagctgaatgccttcaactttgtagtcgatattgccgccaatcttaccggcgctgttatcgaaagaggaggtgcctttcattttgtgcagcgtcagggcgtcctgaccattgatgctggcattgaccttctcaatatccactgactggtcgccaatgcgcacaccttccgggctgagatgggtgttaccgctcagcttcagaccattaatggtgaacagcactggctggcccatctcatttttactggtcagcgcgaggctatcaacgtcactgtccagcgacactttgtcgcctttgttatccgcgctgacgttgaaggtgcccccattggtggcaagacgctcgccgctttgcgcattctgataatcaaccggcagaacgcgcagcgccgtatcggtggcaccgctgtagccgatacgggtatcggcattaatcagtgacttgttgccggtcagctcaaacagctttttcaccgcatcggtgttagccagttcggtatgaaccgacgccatgctcgggatcagattgaaatgcttcagctgagcaaaggggaaagggccatgatcgatggtttcgttcaggatgatgctctggcctggtttaagcaggggattatcttccgtctgcgagttggcctgaatcaccagattcactttgctgctgaacacgccgcgctgatagtcctgatagctgatcttcagtcggctgttaggggcataagcattcagctgggcattggcgttctgcaccagctcatccctgtggctttcaatctgcttgccggtgaaccatgccgcgccagtccagactacgcccagtgcgatgatgacacctacggcaacattggtctttttcattgctgattcgtccttatccttgagtccgcttatgccgcaggtttaccccagcgactgaagaaaaacgcccgcaggcgtttaaaagctaataggttgaaataatagcagttaacaggcactccgtcagccgcttcaccctaagtcgttaaatacccgcgccagtcggcccgtgcctgcgaccgttacgggggattcgctggcggcaatgaagcaggattcacctggtttcagcgtcacctgctgctcgcctttggcgatcaccgtctggccttcgatgcagaaaagcagtgcggcgctctgctgcgccagcggctgtggctctgcgttcagggtatgaatggcaaaggcaaaatcctccaccggaatcgggaagcgcagcgcgttgccctgttgctctggctcggtcagcagggtgctggctggcttctcttcaaacttcaggttcgccatcaactcggcaatatcgatatatttcggggttaaaccggcccgcaacacgttatcagagtttgccatcacctccagcgccacgcctttcagataagcgtgcggggtctccgcgtagaggaacatcgcctcgcccggttgcagcgtgattacgttcagcagcaacggcgaaaacaggccgctgtcgtcaggatactctgccgcaatcatgcgaatggtctgccacggctcaccctgttgtgcatcaaccgtggatttcaggatgcccagcgccagcgatttcgcctcaccctccagtgacagcagggtagagaagagcgcggccagcgtatcctgatcgggatgctgcagaaaatgggctatctgtggatgtgcgcccgcaaccggctccagcagtgagaccatctccgtcagggtgcgaaagccattcatcgcctggaagggcgtcagcgcgtagaccagctccggcttgtggttggcatctttataattacgctcagcagccgtcagcggaatacccgccgcattctcacgggcaaagcccacttcggccgcgcgtttgctgggatggacctgaatcgacagcggctgatcggcagacaacactttgaacaggaagggcagttcaccaaaacgctgtgccaccgctttgcccagcatggcggcaggcgcggcatcaatcacgtcacgcagcgaacgctcgctgccctggtcaatcacggtggaggggcttttcggatgtgcgcccatccagagtttccgccatcggcagcccctgtggattggcgattccgtaaagctcagtcaacgcagttttgctgccccatgcgtagttttgcagcgtattgctcattttttgcattgtataaccctttatcacgggaaattattgccagtattaaagcagaaactgccggtaaaaatacatctccagcgcaaaaggacgctaagctctgataatgttaaattattgtgtattactatcctgaccgcccggcagtcgatcgtaatgacgtaccgggcggtcattcttttaaaaaccagatgaaggagacgtattcatggcagccaatcgcattgagaaagattcaatgggccccatcgacgtaccggcagacaaactgtggggcgcgcagacacagcgctcactggagcacttccgcatctcaaccgaaaaaatgccgaccgcgctggtgcatgcactggcattgaccaagcgcgccgcggccagcgttaaccgcgatctgggactgctgcccgctgaccgcgccgaggcgattgtcagcgcggccgatgaggtgctggctgacaagcatgcggatgaattcccgctggcgatctggcagaccggttccggcacccagaccaatatgaacatgaatgaagtgctggcgaaccgcgccagtgaaatcctcggcggcgagcgtggtatggcgcggctggttcatcccaatgatgatgtgaacaagagccagagctccaacgatgttttcccgacagcgatgcacgttgccgccgttatcgccttgcgcgaacagctgatccctcagattcaggtactgaaaaagacgttgagccagaagtccgacgccttcaaagatatcgtcaagattggccgtactcacctgcaggatgccacgccgctgaccctgggccaggagatttccggctgggtggcgatgctggagcataacctgaagcatattgagcagagcattccgcacgtggcggaactggcgctgggcggcaccgcagtaggcaccggcctgaacacccatccggaatatgcggtgcgcgtggcgaaggcgctggccgatctcacgcagcagccgtttgtcactgcgccaaacaagtttgaggcgctggcaacctgtgatgcgctggtgcatgcgcatggcgcgctgaaagggctggccgcctcgctgatgaaaatcgcgaacgacgtgcgctggctctcttccggcccgcgctgcggcatcggcgaaatcgccatcccggaaaatgaaccaggcagctccatcatgccgggtaaagttaacccgacccagtgcgaagcgatgaccatgctctgctgtcaggtgatgggtaacgatgtggcgatcaacatgggcggcgcatccggtaactttgagcttaacgtgttccgtccgatggtaatccataacttcctgcaatcgattcgcctgctggcggatggcatggacagctttaatcatcactgcgcggtcggcattgagccggtgcgtgagcgcatcgatcaactgcttaacgaatcgctgatgctggtgacggcgctgaatacccatattggttatgacaaagcggcagaaattgccaagaaggcgcacaaagaggggctgacgctgaaaggctcggcgctgaagctgggttatcttaccgaagaggagtttgatgcctgggtacggccggaagagatggtcggcagcatgaaatcgtaaggtttgagtgagtcagaggccagcgaatgctggccttttttatttatatcggacaatcgacccacagatgcagtctggggattaaaagattcagcggttcagcggcaggtttataacgatggttaatattatcggcatcgtagttaagcaattcacccagaaaccggaacctggctgcgatcgcgacagataaccagaatcggtgaaggacaggcgagctgagtctgtttttgttcatccgcgcgccagacgcgtgcaaccggctggactttcaccgggcgcttgattttcagccgtgccgaggcgggcagggcgcgcacgcttgccagctcctcctgcactttttccgcccactgttcacgtgaccacggcgcttttgcacgtcccgacttcaggcttttttccagctgggcgatcacctcttcacgcttgagattcttgataatgtgcttgttggcccagccgaaacgcaggctatccggtgcgctcagcagggtgatagtgcgataggcattcagggtgatcagcccgcgcaaatgctggtggacaaactcaaaacgcgcctcactcggcaggccagagtccaccgtaatcagctgctccagccgtgctttcagctgattgatgacgtcgaccagtgcgccgatctccgcctcctgctgcgcgtcgcattcgatacagagcgcgccaggtaagcgcacggcagccttggtgctcagctgttctgactgatgctgcataaacaggcggcagtagtggtcaagcgccatctttaacgcgctctccccgagatgctgctcgacggcaatccgggtgatcgcttcatgttcgcgacctttaaccaccggcggcaggctgaagacgcgggcgatcagcagaggctgcgcttcaatctgctgacgcaattcacccagcgccagttccaggtcatttacacattgatgcatatcagccactaagtcgtagcgcgtcatgttgtgcctccatagttacaacgtccacaatgtggcagaagcctggcgaggatgcaagtgtcatatagttacaacatactataagtggtttactcaaaaccgtgcggcctgcatggctatccagtcaaaagggcatcacgcattttggcttatcgcagaacatgttataaaaacggttcgcctgctaaccaggagattgcctgtgaatcagaacaacaaacccggcatcgccgccattattaccctgggctgggtgcagatcctgtcatggggcgggtcgttctatctgatggcggtgatggcgaatccgattgcggctgagacaggctggtcacagcagtggatttatggcgcgctctcgaccgggattctggtatcgggcctgctgtcaccgctggcaggcaggattatcgcccgcaccggtggccgcctgttgctggcactgagtggcatggtgatggcggtggggctggtgatcatggcttatagccactctctgccgctgtttctgtttgcctgggtaattattggcatcggtatggcgatgggcctttatgacgcactgtttgccacactcggcacctgctatggcggtcaggcgcgtgcagcgatcaccggtatcaccctgatatctggcttctgcaccacgctggtctggccgggaacggcgttgttaatccacggattcggctggcgaaacgcgtcgctgataattgcggcactgatggtcgtctgcgtgctgcccgcctatctgtttgccttacccgacagtcatgctaagcggccggtgaaacgactgagtccgcagcctggcacggcggagattgcgcctgcgctgttctggctactgtgtgccatctttaccctggcgtccgtgatcatgacggctatttccgtgcagcttatcgctttgttacaggcgagtggccatacgctgacctcggcgctggcgatcagcgccgtacttggtccgtgccaggtgggatcccgcctcgtcgatatcgcctttaaacgcagtcatcccatccgtaccacctttttttccgtcgggctggtggcactgggcttgctgttgctggcactgtttccgcagatggcattgctgagcatggtgttgtatggcgcaggaaatggcttacgtgccatcgtgcggggaactttaccgctggcgatggtcaaaccagagtcctatgcgattgtggtgggtaaaatggcccgcccggcgttgatggggcaggcactgacgccgctgataggtggatatgtgtttgaaaagatgggtgcatcggcgacgctgtggttgctttgcgccctggcaatctttaacgtggtactggttatggcgctgaagcagcgattgccggcgacatcggccaccacggcataacggaacggttctccttgctccgcaggaagagggccgttagcaggctaagcaccttgtgctatcgggcctcagcctttggtgaatacgtgccttgtcaccgccggtttgcttcaaaaaagcaacagtgtttgttatatttattgctcattgattgttcacttatgcggcaataaaacaataagatgcaccgcaactcaggataaagaaatgcttgattaccgcttcccgacagctttgcaaatggttctgagcgtagcgatggcggagcaaatgggaaaacgctctaccagcgcgattctggcctacgggctggaagcgaatcccagtttcatacgaaaattaatggtcccgctgacccgtgacggcattatcgtctccacgctgggccgtaccggttcgattcatctgggccgtcctgctgcagaaattactctgcgggatatctatgtctcagtgatcgaagacaaaaaaatctgggccgcgcgtcctgacgtcgcgccgcgctgtctggtcagtgccaacctctgctggtacttcaagtcgatagccgatgaagccgagcaggcgtcgctggatgtgctggcaaaacgcaccgtggcagacgcactgaacgaactgaagaaacgcgacaccagcaactgcaccgccgtgccggaacctgaacccgaagagattgatgatctctgcaaaaagagccgctgattagcggctttttttatgcctgctgaacatccatttctgagccacttctttcccaaacctgcaacgcaggccttctctccgtaaattccatcttgacctcttaccgtatcgtaataaaatgacttcactggatgaagtcgcggaggtcaggatgaacaccgttgtcagggagttacggaaaaaacatcgtgaaacgttggagcaggtttttcaaatgccgccgccgtccggactgaaatggcaggcagttgagtcattaatcagggctctgggtggtgagattaaagaaggcagtggttcacgggtgcgatttcttctcagaggaagaatagcgcgttttcaccggccgcatccttcgccagacaccgacagaggggctgttattaatctgcgtgaatggctggaaagtattggagtcgatccctatgaataatcgttcaaattcatcaatcaccgtcgctggtcaacccgctgtgatcacctatgttcctgaactcaacatgttccgtgggcgttttactggcctgtcaggctactgtgattttgtctctgacagcgtacaggggctgtacaaagagggcgagatttcgttgcgcgaatacctggaagattgtgcagcctccggcattaatccctatgctgagcaggaaaaaattaagacctttacgctgcgctatcctgaatcgctgggagagcgcctgtctcaggctgccgcgcaaaatgaaacctcgctgaatgcgtttatcattgaaacgctgaatgaaagattgaagcggcgctagcctgcaaggcggggtctgctgaaatcagtgaatcacaggcaaaaaaaggggcgatagcatggtcgccccttttaacttttacggtttacgccgtcacggacgatgcactacctgaccggcgcgtcaccagcttgcgcagggccacatagaacaccggcgtcaggaacaggccgaacagcgtcacgccgagcatgccggagaagaccgtaataccggtaacgccgcgcacctctgcacccgcgccttcacccagaatcaacggtattgtaccggcgataaaggcgatggaggtcattacaatcggacgaagacgcaggcgacacgcttccagcgccgcttccacaatccctttgccctgaatctccagctcccgcgcaaactcgacgatcagaatcgcgttcttacaggccagccccatcagcacgaccagtccgacctgcacgaagacgttgttgtcaccgccagtcagccagacgccaaacagcgcagagagcatggtcatcggcacaatcaggatcaccgccagcggcagcgtccagctctcatacagcgcggccagcaccaggaacgccagcaacacggccatcgggaagacaatcagcgcggtattgccctgcgttgactgctgataactcagatcggtccactcgatgttcatgccgtttggcaatagctgaccggacatcgcttcgagctgactcatcgcctgcgccgaggagagcacgcgtgggtcggcatcaccaatcaaatccgccgccggatagccgttatagcggatcaccgggtcgggaccgtaggtggtggtaatgttgaccatgctgccaatcggcaccatctcaccgcgatcgtttcgggttcgcaggttagcgatatcttcgatgctgtcgcggaaatccccgtcagcctgcgccatcacccgccaggtgcggccaaagcggttaaagtcattcacatacgacgagccaagataggtctggagcgtgctgaacagcgcggtcagcgatactccctgcgctttggctttatcccggtctaccttcacatcaagctgcggaacgttggcctgataagaggagatggggaagtgcatccctggcgtctgcatgatgctgcccgaaagcgtattaatcgccgtctgcagtgcgccataacccagacccgcgcggtcctgcacatagagcgaatagcccgagccctggcccagccccagaatcggcggtggcataatcgagaagccaaagccctgctggatttgagcgatcttcgcattgatctcagcgttgatctccgccgccgtatgtttgcgctcattaaacggcttcagaccgaagaacaccgtgccgctgttcggcgtattggtgaactgcaatgcattcaggccagggaacgcgaccgcataggcgacgccttcggtctgcataccgatttcgctcatcttacgaatcacttcatccgtgcgcgccagagaggaaccttccggcatcttcacgccaccaatcaggtagagcttatcctgcgtcggaataaatccacccggcacggtgtggaacataaatccggcacccgccagcagcagaatatagacgccaaacacggcgccacggcgacgcagcgtacggcccaccagcgattcataaccatgggcactgcgctggaagaagcggttaaacggccggaacagccagccaaacagcgcatcaatgatccgcgtcagccggtctttcggcgcgtgatgatctttcagcagcatcgccgccagcgcaggcgagagcgtcagcgagttaatggcagagatcactgtagagatggcgatggtagtggcgaactgcttgtagaactgcccggtgacgccagagagaaacgccatcggcacaaacaccgcgcacagcaccagcgcaatggcgatgatcggcccggagacctcacgcatcgcctgatgcgcagcggcgcgtggcgacagccccatctcaatgttacgttcgacgttctccaccaccacaatggcgtcatccaccacgataccaatcgccagcaccagcccgaacaggctcagcgtattcagcgagaagccaagcagatagagcacgctaaaggtaccgactatcgaaaccggcaccgccagcaggggaatgattgaggcgcgccaggtctgcaggaacagaatcaccaccagcacgaccagaatgaccgcttccagcagggtctgcaccacggctttaatcgagtcgcggacaaataccgtcggatcgtaaggcgcggcccatttcacgtcattggggaagcgggtcgccagctcatccattttggcgcgaaccgcattggagaggtcgatggcgttggcgccaggtgcctggaagataccgataccaaccgcatctttgttattcagctgcgagcgcagggcatagctgcccgagcccatctcaatccgcgccacatcgcgcagccgcaccagcgaaccatcttccgaggttttcaggatgatatcgccaaactgctgctcgctctccagtcgtccctgggtgttgattgacagcagaaaatcgctctgttttttcagcggctcggcacccagctgaccggcagagacctgcacgttctgctcctgcatcgccgttaccacgtcagaggcggtcagaccacgcgccgccactttattaggatcaagccagacgcgcatcgcatactcgcctgcgccgaaaatctgaatctgaccgacacccggcagccgggcgagctcatctttcaccttgagggtggcgtagttacgcaggtagagcgaatcgtaggtattgttcggtgagaacatgtggacgaccagcgtcagggtcggcgacatcttctgggtggtgatccccagccgacgaacatcttccggcagacgggcttccgcctgcgctacgcggttctgcacctgtacctgcgcctgatcaggatcggtgcctggacggaaggtgacggtggtcaccagcacgccgtcagaaccggctactgacttcatgtacatcatgttttcgacgccgttgattgcctcttccagcggcgtcgccacggaatccgcaatcactttcgggttagcgcctggatactcggcgcgcacctgtacgctgggtggcaccacgtcgggatattcactgactggcagcagcgggatggcaatcaccccggtcacaaaaatcaggatcgacagcaccgcagcaaaaatgggccggtcgataaaaaagcgggaaaagtccatagcggcctcgggttattgagcgactgccgcacgcatggcgaccggctgagcagtgaccggcatgccgggcataaatactttttgcagaccggcgatgatgaccttgtcgccggattgcagacccgatttaacgatgcgcaaaccatccaccatcgcgccaggctggatatcgcgccgctgcgctttaccttcgccatccaccacgtagacatatttgcgatcctggtcggtcaataccgctttatcatcgatcagcaccgcctcgaactgcgcgctgccgggcagacgcacgcgggcaaacaggccaggcgtaaactgccgctgttgattgtcgagcagggcgcgcatacgaatggtgccggtgctggcggtcagctggttatccagaaagtcaattttgccctggtgcgggaaaccctgttcgccgaccagcgcaatctcaaccggcagcgcatggcgctgctggccctgacgcgccatcgcctgatagttcaggaaggtgttctcatcgacatcgaaatagacatacatctgctgctgcgacaccagcgtggttaacacactggcgctgtcgccggcggtcaccaggttaccggcggtgatcatcgcccggctggcgcggccatcaatcggcgcggtgacgcgggtgaagtcgaggttcagctgcgccatatcgaccgcggcctctgcggccagcacatccgcctgcgcctgactggcggcagaaacgacgctgctcccacgcttcgcgggaaatcgcctgcgtgccgatcagcttctcgctgcggcccgattcgctgcgggccagactcgcctgactgcgcgcccgggccagttccgctttggcctgctccagcgccgcgcggtaactccggtcatcaatggtaaacagtacctgaccttttctgacctcatcgccttcacgatagttaacggcatcaatgtagccagagacgcgcggacgcaactgcacgctctgcaccgcttcaacccggccattgaaattatcccactgactgaccggtttgatcagcacgggggcggcactcacttcaggcggcgggggagcggcgttttgcgccacacccttatcgcagccgctcagttgcgtgatgagcagtaccatccctaagagggttaaaccctgacgaacccggttcgtaatcattgttgttattccgcgatagatataaacaggcggcctgcaggccaatatttgcaacttttaagattgcaattaatcgcggtgagtgtaggcttgcgtggctggcaactgcaagaataacagatacactttatgtgcggtttagggcaggccgatgaaagcctgaacaacttagctaaaaccccacaaatagtgcggcatttaatgtactaataaaacttgcattaaatggcatagtcagccacccttaagtgtaactgcaactgatactaatacttttcgccacggcgacaggagagactggaatgatgagtgatgcttttattcacgatttaatcgactggattgataacaacatcgaagcacgtctggatctggataccgtttcagagcgcgcgggctactccaaatggcacctgcagcgcatgtttaaagagcacaccggttatccactgggtgaatacatccgggttaagaagctgaagaaatcagccgaccgcctgaccagcactgatgaaccgattctcaatgtggctatctcgttaggtttcgactcccagcaatcctttaaccgcagcttcaaacgccagtatggcgtcgcgccgggtgcatggcgtcggcacagcggggattcgcacgcagcataacctcgccagggccagcttgtctggcccgcgcttttctctgcgcgcaaaactggtatcatctgcgtcctgtcgtcacggatgccatcatgtcaaaaaaactctggattggactttttctcgtcctcgcggcctgtttctacggccttaaaccctatctgaattccgtttcagcccctgcccaggccgatatcgccaccctgactgacgcccataccgtggcgcgctgggtgctgcagcatcagcaactgccggactactacctcaccaaaaacgacgcgcgcaagcgtggctggaatccggccaaaggcaacctgtgtgacgtgttgccaggcagagccattggcggcgatcgctttacgaaaccgtgaaaagcgtctgcccgcgcgtgcgggccgtcagtggtatgaagcggatgtgaattatcgctgcgggcatcgcgacgccgatcgcctggtttactcctctgacgggctggtgtttctctccaccgatcactaccgcagtttcaggcaggtgccctgatcatgcttaatctgacctttgacctgcgtcagctcaccacgcgcgcggcgttttatcagcagtttgctgagcagagcggctgtccgcagaccttcggacataatctggatgcgttatgggactggctgacgggcgggatggcgctgcctgcgacaatgtggttgcagcactatgccgcgcatcaggccgatttagcgccggtgctggcgctgctggaagaggcggcgcagtcgctggagggcgaactgcgcctgatcattgattaagcgcgtagcggcttgagcagcgcaaccagcgcttcgcgtgctgccagtggcagatcgccgccgccagtgtaaccattgttctcaatgatgacctggttcagccccaccagccagtcgtagatatagtaggccgtgtggttggccggggcggcagagagtctggtcagacgctgaccggaactgaagctgacgctgggagccggaggccgcgagaaaatcacctgaccccggttaacgcggctggcagggcgttcattttcaggacgctgtaaaaagccgagccaggccacaaaatcccccagcaccgtcattgcccgcgtcacctgacgatccgcgcgtgattcatggctgacgctctgcgtatcgggctcatgcagcgcctgctgcagcttttgcgcgatatcggtgcggaatccggccgtgatcagctcttcaaccagccactccatcgttggcttatccacgttcagcaacgccagcaggctgcggttttccggcagctgacgcagatgatccagccacagcagcagcacctgacgcggatactgctgcgcgctctgcagactctgacgcggctgaaccggcgcttcagccgggctctcactgaacaggtcaaattcaaacccgatgccaaactgattttccggggcctgaatactggccggtttgctgccttgtaaggcggactgattgagccacagctgacgcagcgcctcacgcggcggctgcaggcgttccagcagctcgccatgcaggccggtccgatgctgtaaacacttcagtagcgtatcggcgatattctgtttgcgtgccgcctgttccgggctggcacccgcttcggtccagggcaataaacgccgctccaccacagtgtgctgaatctgcgccagctgagccagcagcatgtcgcggcgcgcttccggctgcatctcatcctgcaaccagctcgccatgcggtcgacgcccgcccgatccagtgccagcatcgatccccagtgctgaccgggctgtcccatctgacgctgcaccgcttcatccacattgacctgctgatggcgggcatcgaaaggggtaatcgcccagatcagacgcggtttctctgcggattcctgtgcgggctgctgacgctgccattcgcgcagcgtttcgctggcgaggtcggcatcctgacgctggctggctgcggtacagaccagcagcagatcaattgcctgacgcgcggcgtaaaaaacgggcagcagggcacgtttctgttccagcagttgggcacgcagtggatcctgctgctgcaggcgctgacgatcttcctgggttgccgcgtcaccggactggcctggcgcgggcagttccagcatatcagcatcatcatagagcgcggttcgcggtgtggaactcagcgggaccagcacttccagcgtcagcagcgccagtaatcccagtggcacgttctgcgccttaccgatgcggttaccattcagcgggcagacttccaccagctgctgttgatcctgctcactggccggcacaatcagctgctcggccggcagcagtgatgtgtcggtcagcaggctcagtggagcaagcacccggctgctgttacgcagctggtgacgcagatgcagcagggtgcgcagcatctcattcagttcaggctgacccggccacagcagtgaaaaaagctgtacccggtcgtcaacgctgagccagggcgccagctcaaccgcctgcggccagaaatgacgatcaagccgcgcatcgtggtgcgcacggcgacggcaccaggaccagagtgttaccagcgcatcgccttccagacccgccagcggcgtggcgagacgatgacgctgcaggcgctgcagtgcgctgtcgatctgtgcggtatcgggcgttgtcgcgccggcacaggcgaccatcagccgtacgatctccgcttcactcagcagcgtcagttcaaccggccactcgtttgagagcggctcgcgctgatggctgaaacgggtggcggtagcaaaatcgaggttgccgggattgatatgctgaaaccagttcagcagtttatcacccatgcgggtcactaactggccctgtgcatcggccaccatttcgttcagcagccaggccttacccgcctgcgactggccaaacagcgccagcgtcaccggacgcgccacctgctgcgccagcgcctgagtctgcacgcgcgcctggcgcagttgcagcgtcagggtttctgcttccagcgccagacgcggcgactgctcacggctgctctcaatccaggccagactgttattcagggcgtcctgcaacaggccaagacgttttgccagcgtttgcggctgacggggtttcagggctttcatcgtttacacacgctcccgctgtcaatccagtattgcgcattggcattgccggtcgccgacagggtattcagcttaagactcaactgctccagcggcacgcgggtgccatcatccagacgggcatcgctcagcaccagactttccgggccggacgcgtcgggtccggcttttaccgccagccggatgcgcagcacgctctcaccggccactttacgcgccagggtggcgtcgttcagcgtcaggctatagagcggcgaggcgggccagcgatcgttatcaagctggcggaagccgagacagacgttgccgcgaatacggaaactgcgctttttatccagcacatagccgggatcgtcgaggtcaatttcgctgtagcagaggttctcgtccgtcagcgcctggttttcgtcgagcatgccaagatagcgaatcgtcgagtagggttcaaaatcgcctgcgcggaaccagaagctgctgaggcgcagatccagcgccagcaggcagagcatcgcaccgaccgccgcggtcgattttggattgtcgatgcggccatgtttgttaaacggataccagtcgctggtgtgatagccttccagcgacaaaatacggctgcccggcagcggttgcagatgacgcaccagcgcctgaatgcccgggaagcgcgacgggcgaccggtcagcagcagcacgtcacactgatagagcgacaccacttcacacattgaacgcagcgccgggataatcgccatccggtgctgcataaattcaccgtgcagctgtgacaggctcaccaccagcggtacctgcagcaggtcaaagcggctgttaccgcccagctcgcgctgaatctcgccgttgacgaaggccagtaccgcttcgcccggcggctgatcgaccagctcgccaaacagtgcgttgatctccgcgtggctctccagcggatcccagttttcgtagcgttccagtaccgcctgcgccagcggaataaacagttgtaaggtgatctgctgacgcagcgtggcctgaccgtccatgcggctgtcgtgaccaaacagcttgttcatcagcggttccgccagcgtcaggcccgctttctgcagatgctgctgcagcgccggtaaaatccacagctgaatcacgtccagcaggatatcgtcgcccgcgactttaaagccttcgcggaacagcagtcgcggcgtgattttgacgttgttgccctgaccatcatccagacgatactgggtgatggcgaggtcagtagtgccgccgccgatatcaatcgaggcgatgcgcaggctcttgcctggcagtttcgtcagcatcgcgcgggcgatccggacgggccatgctgctgaaaaagtcttcggcgcgaccggcaaagttgacctgggtttcattaaacagccagaccatctgaccacaggtcgcttcatcccactccatctgcacatccggcagcggtttcgggttctgacgtggcagtgatggtgaaaggtcatcttcgtcagccagccagccttccgctttccagaccagcgccagcgcttcctgcatccggcggcggaaaatttcacgctccggcttcggcatcgctgacggcagcgtcaggatcacatggcgcagctgacgcggcgcgtggctctgtggcatccgctgacgctgtgccgcgctgttcatctgcatcagcgcctgagccagcagctcacacagcataaaggtcatcagcgaactgcggctgtagtgcggagaaaagaccggcagacgatcgtccggtgccagcgtcgagagcggctggccttcgtcgttgagcagggtggtaaagggtgcggcataggccagcggttcagcttgctcgccgggcgtgttaaaacgccagcctggctgatagcgcgcctcatcccacagataacggcgcgggctggagaggccggtgctgccttccagtcccacacgctgcagtgccagacggctcgcttcacgcccgacgcgcgtcaaagaaggccacataaaggcctgctcacgaccgctctccagcgagaaattcgctttgccaaaacgggtctcggcaaactccagacgactgtcaaacagctcgttgtaaacctgatgcggctgcgacagatcgcgcagctgcagctcataggtctgtttcaggccgttgctctcttccgggtgatcttcaaccagaatgccgcaggtatgggagttaccgacatccagaatgatatcgacattgaccgccggggtctgcagcgtggcagcctgaatatggatctcgctgaggtcgagctgttcgcccagcagctccagcagattgaggtagtgcgcctgatactcaaactcgcgcagcgcctgattaatcgcctgttcgcggcgatcggagacgcggtcggtaaaggattcgcgcagccagccgtcaacccaggtcaggtcaagaaaatcacccagctcgtagttgtgccaggcgagcgcaaaggtcacaccgttctgagcatcagccgtgctgaggccgagctgttcaccgccatcctgttccgctacgcagcgggtatcaaaggccaggctgacgcgatgggtattgcccgctgcatcgggcgcgggcagcgcaaccagacgcatccgcgcccagttttcaggaccgccgataaaacgacgtccgctggcgcagcgcagcatcggcagcggcagccagcaggctgacagcagggacagtgagtccgccagcgcgatatcagactccgggcgcaccacttccgcagcgccgccatcttccggatagagcaggaacttaccgctgttgccatcgacgttcaggcgcagcagcgggccgttggcggtctggcgcacaaactggcggcgcgcaggggtatctgagagttgcaggccgaaatccagaaactgcacgccgctattttcaatcagcgaaattttttgtttgtcatcgatcaggggagccagcatcgttatttactctcacgcttaatcgtcatcgggaagacccggtcatcagcatactgcgcttcacatactgcggcgccgatactcgcatggcagaccagcagtggcatacggtagcgcgaactgttctggcacttcgccgtgtagcggctctcaatcaccagattaccggcgctggtcatggccgcgctgacatccgctttacaggtggtattgccctgggcgatctgcacgctgcctttgccgtttttaaactggaagcgcatcaccggaggcttaccggttggcgtcggcatctggtcgatagtgacacgccagcggccatcaatcacccgtacctggccatcgcgcaccgcatccggcgtcacgatcaggtcatcgggtttggccggaaccggcgccgtcaccgttgtggcaagagtagcagatgcgtctgccggtacggtatcggtggtggtgttggccggtttctgcggctgcgattcagggagtttttccggtgctgcctgctcggcaggtggcgtgacagacggtgtcgccgccaccggtgccggagtcgcagcaggagccggagtggataccgtcgccggggctgacgctggcttcgcagtggcaaccggtgtttttacgggttcagaacgatgcagcaacacggccaccgtcacggcggctgcaatcgccaccggcggtaacagataccagacgcggaaacggcggcgagccgctacaggcgtcgccggctgagcttcaacgggtgccgcaaccggcagcggttcagccacaggttcaggttcaggttcgggctcagcgatcatcactggttcagcgatgaccggcgcggcaggcagctcaggcagcggttcaaccagcgccaccggcaggttctcttccagcgtgtcacgcaggcaggccagcgcgtcatcgcggctacgcgcctgggcatcgacaaagccccagaaggtgatgaccggtttgccatcaaccagatagacatactgctggtcggggaattgcagggttttgctcagcagcgcaccaaacagccgcatcgatgggttctctgccgcgcgcgcgcgcgtactgagatcctgcatatcctgctgacaggcggtgagctgttgcagcgccgcgcgacgttcatgatcgctggcacccagccaggatttgacccggccgctaaaaggggcataccagtcgaggcgatcgccccgttcattggcctgaggaatggccaggcaatctgccagtgcgctctgacggcgcaggcgcagggtttcacgaatttgcaatgctgaggcgtagaccggctggccattttcacctaacgccagaactgcatctaaattaccgctgcgcagaaaagtttttgccacctgttgggcccttatcggtcgttgtctgaggcagaaaatcgcgtgttatcgacgattaggttgattttacgcggggcaaggacaaatcaaacggcagaaaagggggtaaatccactgtttttttcaccggctgacggaaaaaccaccgctatttcagagagtatgacgcaatcagccggatttgcgcaccagcagcaggtgggcgatgacgccgcccgccagtccccagaaggccggaccaatgcccagcagcgaaacgccggatgcggtgatcagaaaggtgatcagcgcgctgtcgcgttcggcaggcagatccagtgcgcggtggaggctgccacccagcgtggcaaggagtgccagacccgccagcgcctcaatcagcaccacaggcagggcactgaacagcacggcgatcagcgcaccggacgcgcccgccagcagatagaagatccccgccagcgccgccgcacgccagcgttgctgaggatttgggtcgacctcatcgctcatgcagatggccgccgtaatcgccgccacgcagaccgaaaacccccctaatggcgacagcagcagcgcaattaatccggtccagctcatcagtgaagagacgggtggacggtagccgtgcgcctgcagcgtggcgatgccgggggcgtttctgtgacgccatcgtcaccaggaaatagggcacgccgatccccagcagcgtggtgagggtaaagtgcggcatcacgacttccggcattgtcagcctaatcggctgcggcggaaagtggatggcgtgctgtgccagcgcgacggcaacacccaccagcagcgtgaccagaattgcatagcgggccagccagcggcgggccagcagccaggccaggcacatgctgccgcacagtacaaagttactttgcaaatcggcaaaggtctgcagcccgaagcgcagcagaatacctgccagcatcgccgctgccagcgaggcaggaatgtagttcatcagccgggcaaacaggccggtgacgccgcacaatacgatcagcaggttggcgaaaacaaagacgcctgccgcctcattcagcgaaatgccgtgaaaactggtcgtcagcagcgcagcgccgggcgttgaccaggcagccagcaccggcatgcggtagcgcagtgacaggctcagcgaagcgatcccctgcgcaatgcccagcaccgacagccagccgccaatctgcgcgggcgtggcgcccgccgcctgaaacatctgatagataatcgcgccactgctgctgtagcccaccagcacagccacgaagccggaaaccagcatcggcagggtaaaacggggaggttccgctctcgtcatggtcagactctttatgagattgtgcgttatagcgcacatggtcgcatgatgcgctataacgcacaagtgttacactattgccataacgtcactcaccaggatgacgagaaagcaggagaaaaaatggcggattttcagcaacacctgagcagcgcgctcagacagttgcggcaggccaatggctggagcctgacgctgacggcggagcgaaccggcgtcagtaaagcgatgctgggccagattgagcgcggcgaatcgagtcccaccgtggcgacgctgtggaagattgccaccggtttcaacgttcccttttccttttttatcgacagcagcgtgttgccttcaggcgccgcgcctgcattcagtcagcccaatgccgacatgtcggtacggtcgctgctgccttacgatccgcaactgcgttttgatctgctggcggtggagctggcagcgggcgcgcagagtcattcttcgccccatgaagcgggctgtgtggagcaggtggtgatcatcgagggcgaactattgctgggcgtcggggatctctggcgacgtctgctcgccggggaggcgttccagttcagggccgatgtgctgcacagctaccgtaacccgctcagcacgccgctgcgcttccacagtctgatccactatctgcagcgcccggaggttacaaattgatacctgagcaaactacacagtttaccttcgtatctttatactttcgcttatcgatggagacgggtaatgagcgatctgactgaatccgctgcaatgctgcgcatgctggtgggcaagctgggccgccggttgcgcgagtcagcaccgcctggcgaattaacctggtcgcaggtcgcggtgctgggtcatctggttcgcgatggggcgatgacggtaacgcaactggcggcggccgagggcgtacgcacccagtcaatgggcgcgaccgtcgccgggttactggcggcggaactggtgacgggcgagccggatccccatgatggccgtaaaacccgctatcttcccacgacgtccagcctggcggtgattacgtcgagtcgcgcgatgcgcgatgactggctggtccggacgctggaagcgcgactgagtccggcagaacagcagcaactgaccgacgtttctccctctgctgcaacgactcactgactattaaatctgaggattcaacatggctgtaaccacacttgatgcaaaaactgcgctgattgttatcgacctgcaacatggcattgtggcgctgccgctggttcatgaaccgcagccggtgatcgaacgctgtgccggactggctgaggcgtttcgcgcgcacgatctgccggttgtgctggttaacgtggctggtggggcgccgggccgcaatgagcaggcacgtcacagcggcgaattgcccgccgactgggccacgctggttccggcgatgaccccacagcagaatgaccttacggtcaccaagaaaacctggggtgcgtttcacgccacggcgttgcacgatgagctgcaaaagcgcggcattactcaggtagtgatttgtggtatcgcgaccagcatcggcgtggaatccaccgcacgacaggcgtatgagctgggttacaacgtcacgctggcgaccgatgcgatgaccgatctcaacctggatacgcacaacaatagcgtgaacctgatcttcccgcgcctgggtgaaaccggcagctgtgaggatattaaggcgcagctgaattcgcgcgcatgattggcgtgtgacgttaagcgtcgggccaccgcgacggtggcccgttgagggcagccacagctcttatcaaaaaactgcgccacgtttctccccagggggccggacgaaactcttcaccagcaatcgctgacataatgacattcaaatcatcatcctcattctgaagcaggatgtttatttcattccgcgcttcgataacaggcatgtcatgatcaatatagctctgaagcatttcttcgagggtattgccaaagtcgtcatggtggcagcttaaaaacactcttaacatgccggttagcgccgggtattgtttctcgggtttatcaccccatccacggataagacgtgagaacatagtaaggtttcccgttataatttaccggaaggcgtaacccagcgttaaaccgacgctgtaattgcggcccggcgcggattcgaagtagcgtccattactctcattcacaatcactgaacccacatagtgccggtcaaacaggttatcgacccggccaaacagatccagtgtccagttctcaaccagccacttatagccactgttaaccgctgcaacggtgtaggacggggtgttcacgctattctgatcttcagcggcgatctggctcagataacgtacctcactgcctgcataaaagccctgttccggcagataaccgagtccggcgtaagccatgttacgggcaataccaggaatgcggttgccgtcacagctgtcgctgccgcaggcgttagtgcgatagcgcgcatccagcagggtgtaggccatcttcagccgccagtcccaggcaaactgctgatccaggcttaactccagaccgcgacggcgggtctgaccggcatttttataggtagtgcgtccgccactgctggcatccgccacaatctcatcctgggtatcggtctggaacaacgccgcgctgatcaggccattgccgatgcgtttcttgctgccaatctccagcgtatcgctggtggccggtttcagccccagattcagaccggtcgcgccgtctgaacggtaagagagctcattaatggtcggggtttcaaagccgcgaccggcggagatccacgcgttccagcctaggtcaaaggcatacttcagtgccgcagcgggcagccatttgtgatagcgcgcatcaccgctgtcgtcgccgttaccgggctgaatatagaagtcatcagagtcaaagttaacggtgctgaaccgcacacccgcatccagcgacagcttatcggtcagttgccaggcggtctgcagatagggatcgagcgtccacatcaggttgcgctcgttgcggcgaagattgccctgttcgcccagttgcgtcaccccgttgctgaccgtgaagttttcatagcccttgcggcgctcggtcatggtttcgtagtcgagtccgccggtcagcgccaccggaatcgacagcagcgtgtcgcgatgggtccagcgggtatcgacgccctgatagtggcgggtcagggcgatcacgccaccgggatgagacgggttgcgctgcacggctgcagggatcgactggaactgggtagtttcgcgcatgcccgcatagagcatcacgctgaggtcgtcatgttcactcatctggcgctgataacgcaggccgccctgagtctgatcgacagtcttacgggtgttataaagcgggacgttgctaaccacctgacgtggattgtcacgccactgcgcctcggttaagccgccgggatcctgcgcgtcaatgtgaacgctgttaaacagcagcgtcagggtgctgacatcatcagtacgcacgcccagtcgggcgttgccaaggtttttctgcgcagcactgtgatcacgatagccgtgagtggtgaagcgtgaggcggagacggtgtagttcacatccccggcatggctgccgtcaccggtcgcgccgctggctttgacgctgtttcgccagctgccgtagctgccgtaccagctgctggcttcaagcgtggtcggctgctgcccctgctgagtggtgacattgatcacgccacccgaagcgttgccatacagcgcagaaaacgggccgcgcagcacctcgacatgatcaatcgagccgatatcgatatttgaggtctgcgcctgaccatccggcatggtggccgggatgccatccacatagatgcgcagcccgcgtacgccgtaggttgagcgggagccgaagccacgcatcgacagctgcaggtcctgtgcgtaattttgcctgttctggatctgcagacccggcacgctgctgaggttttccgacaggttaacgcgcggcgctgcctggcgcatatcgtcgccactgaccacgctcagggccgcaggcgtatcgagttcgttaaggcccgtttccggcggtgccgccgtgacgaccagggtattttcattatccgccgccagcagcggcagtggcaaaatggcaggcaacatcaacagcgtcgcctggcgcagagagattattttcattatatgtggcctgaaaaaagagaggatatgaaccagatggaacaatttccgcatatggtaagggtttgatgcgctggggtacatcgtttcgggctggattttttctctgtttaccgccaggctggaatccatcttttgcagtgatatggcgtccgattcacccggatgcagacaaaaaaactcacgggagtcagcatgaaacaacctgaagtggcggttctgggattaggcgcaatggggcacgcatttgccgccaacctgctgaaaaaaggctttcgcgttcatggctggaaccgcacccgcgcgcgcggcgaagatctgctggatgcgggtttgcagctggctgactcgccagccgaggcggtgcgtgaagcagatgtcgtgatcgccatgctgtctgatggcgacaccactgagcaggtgctgcatcaggtcaaagaggcgtttaagcagggcgcgacgctctgccagatgggcaccatcggcgtagaaaaaaccgacgcgctgatcgcctttttcgcagaaaaacgccccgatttgttactgatcgatgcgccagtctccggcaccaaagcaccagcagagaatgcgcagattctggtgctggccagcggcgatcagagccgggcgcaggcggcagaagcggtgtttgctgccatcagtaaaggcacccagtggctgggtgaggcgggaaaaagcacccggatgaagctggtgatcaacagctggctgattggcatgatgcaaagcctggcggagagtacccggctggcagagcagttcggcttttccaccgacgatctctggcaggtgctggagggcggtccgctggccgcaccgtatgcaaaaatgaagctcgggatgatcgccagcgacgacttcacgccgcagatgcatctggtctgggcgctgaaagatgcccgcctggcgctggatgccgcagagacgccgctgccggcgctggagaatatcgcccagctctggcagcaggcggtagaggccggacacggtgaagaggatctggcggtgatctaccgctacctgaaggcgcaatgagtcagcagcattttgacttcagcacgcgtccgctggtgccgctggcgcacgattatctgcacggtgccagcgaaccctggcaccagcacgcctgtgcccagctgatccacaccctgagcggcgtggtacgggtagagacggagtatggcagctggattgtgccgccgagtcgcggcgtctggctgcccgcatttacccgtcatgcgctgcagattaccggcagtgtggcggcgcgcacgctgtttatcgatccgctggcgcgcgccgatctgcccgccagttgtcaggtggtgcaaatctcaccgctgctgcgcgaactgattgtcacggcgctgagcctgccagagcgttacgccgcaggcagtcgggccgagcgggtgatggagttgattctggatgaaatccgcggcatggacgtgctgccctttgcgctgccgacgcccgacagcccccgtttacaggcgctgtgcgagctgattcagcagacgcccggtgagagctggacgctgctgcgggccagtgcccacctgaatgtctcgggccgcactctggcccgccattttatgcgcgaaaccggcctgcagttcagcgactgggtgcggcgcgcccgactggctatcgccctgacgcgactggctcagggcgactccgtgctgcgggtggcgctggagctgggctatgaaagccccagcgcgtttagtgcgatgtttcgtcgtctgctgggcgtctctccgactgactattttccgcctgcagaaactggcctgccgcgctgagcagcgcctgcagggcggcgcgggcggtgtcattgtcgatacttactccccaggctcgcgcgccacgggcatccacgcagctgatataggccaccgagcggctgtcactgcgtcgtcccagcgtatgctcgtgatagtcctcaatggtcagatgcagatcaaacgcgctgcgcagggcattgaccgccgccgacagccagccgttgccgctgccggtcagcatcagcgattgcgtctgatacaccacgctggcgctaatctgcgtctgcccgccgctgtcactctggctgtcagcccgctgtaatgccactgcgggctgcgtgacgccatactggcggcagaagagctgccacaacgcgtagtgcgtcatctctccgccgtgccggtcagtctcccgctgaacacagcggctgaaatcctgctgcagcgctcgcggcatttgtaacccgtgattctgctccagcagccaggcggccccgctttttcccgactggctgttaacgcggatcaccgcctcatagctacagccaatgtcggccgggtccagcggcaggtagggcatctgccactctgtttcctgctgttcggcgcggatggcgaacccttttttaatcgcatcctgatgagaaccagagaaggcggtgaagaccagctcgcccgcatagggatggcgcggatgaaccggcagctggttgcagcgggttaccacttcaatcacctcatgcatctggctgaaatcgagctggggcgaaacgccctgggtatagagattcagcgccagcgtcaccagatccacattgccggtgcgttcaccgttaccaaacagacagccctcgacccggtcagcgcccgccagcagcgccagtttctgcgcaggcaacgccggtgccgcgatcgttgtgcggatgcacgctgatgcagacggcatcacggcggctgaagtgacggcagaaaaactcaatctgatcggcataaacgttgggtgtgttcacctccaccgtggcgggaaggttaatgatcatcgggcgctgggcgtccggttgccagacatcggctaccgcctcgcagatctccagcacaaactccggctcggtaaagcagaaggtctctggcgaatattcaaaggtccagtgggtttccggctgcgcctcgcattcggcgcggatctgccgtgcaccagcggtggccagcgccacgatttccgctttgctctgtttaaatacccgctcgcgaaacagcggcgcggtggcgttatagagatgtacgatggcgcgtggcacaccctgcagcgccacaaacgtgcgggcaatcaggtcctcccgcgcctgagtcagcacctgtaacgtcacatcctccgggatacgctgctgctcaatcaggtcacggacgaaatcgaaatccgtctgcgacgcagagggaaaggcgacctcaatctcccggaacccgcagcgcagcagcagatcccagaaggccattttgcgttcccgatccatcggttctgccagcgcctgattgccgtcacgcaaatcggtggagagccagcgcggcgccagggtcagctggcgtgagggccactggcgatcgggcagggtgatcagcggggagggacgatatttatcagcgggtcgggtcagcataagagtctcctgtggtttttttatcagtctgccgacacgcctccgggtccgcgcgcgcagggctgacaacctgacgcgcaaaagtgacaatacccagcatgaccagcatgaccagcatgaccagcatgaccagcatgaccagcatgacctgcatgacctgcatgacctgcatgacctgcatgacctgcatgacctgcatgacctgcgtggccctgcgtgcgctctggtttggtgaatccgccgggcagggttagcatggtcgcctgtttatttgggtggactcatatgctgatttttgacggtcacaacgatctgttgcttaacctctggctgcatcatcgtgatgcgcccgcgcaggcgttttatcaggggattgaacggggccacctcgattttccgcgcattcagcagggcgggctctgcggcgggctttttgcaatctttgtgcctccgcaggagtacattgcccgtaccgttccggcacgtgccgacgaaccgtttcaaccgcttcagatcatgtggcaacagcttgagatcctgcagcagctggctgatgcgtcaggcgggcgggcgcgactctgccgcagccatgacgagatcgtcgcctgccgcgccgcaggcgtactggcgatggtggcacacatcgaaggtgctgatgcgctggatgaggagggcgagcaactgcacgccttctggcaggcgggggtgcgcagcatcgggccattctggaatctggccagccgctttggtgaaggcgtcagcggcacctttcctggctcgcccgacaccgggccaggcctgacccgcgccggagagaggctgattcagcaggcgagtgacctgaagatgatgattgacgtgtcgcatatgaatgcaaaagccttttgggacaccgcccggctctccagcgcgccgctggtcgccagccactccaacgcgcatgctctttgcccgcagccgcgtaatctgacggatgaccagctggtggcaatccgcgacagcggcggtctggtcggcattaatttcggcaacgcttttctgcgcgccgacggtaaacgcgacgctgacacgccattaacagaaattgttaagcattgtgatcacatgttgaagataatgggcagcgaccatgtagcctttggctctgatttcgacgggattaccccaccggctgcgctgggcgatgtcagcggattgccgcgattgctcgccgcttttcaggaagcgggctatgatcagacactgacagagaaactggcatggggaaactggcagcgggttttacatctgaccgggctgtgataacaatttcctgatgttccgggcttgatcccgacgcgccattggcgcaacatctgcctggaaattgtgacggcggtctcattcaatgccggtcacactgatttcaggcagctcatttactgttaaccaagaggaagtaactcatgtggaaaaaaccaactttcgttgatatgcgtctcggtctggaagtgactctctacatctccaaccgttaatcgttctgcccgccctctgagcgggcattttttttcaacttctggttttcctctatgtttatcaaaatcctcggttcagccgcgggcggcgggtttccgcagtggaattgtaactgcgccaactgccacggcgtgcgtaacggcacgatccaggcccaggcacgcacgcaatcgtcgattatcctcagcgataacggcgaagattgggtgttatgcaacgcttcacccgacatcagccagcagatcctgcatacgccagaactgacccgcaaaggggtgttacgcggcacggcgatcggcgcgattatccttaccgacagccagatcgatcacaccaccgggctgctgagcctgcgtgagggctgtccgcatcaggtgtggtgcacgccggaagtgcatggtgacctcagcaccggcttcccgatatttcctatgctcacccactggaatggaggcttacagcaccgtcccattgcgccactgacgccgtttcagcgtcgatgtctgtgatgatcttcagttcaccgcaattccgattatcagtaatgcaccgccttactcgccgtatcgcgaccggccgctgccgggccataacgtggcgctgtttattgaaaaccgcgcgaatggccagacgctgctctacgcgccaggcctgggcgagccggatgcggtgatcctgccgtggctgcaaaaagcggattgcctgctgattgatggcaccgtctggcaggatgatgagctgctgaccaccggcgtgggacacaacaccggcaaggcgatgggccatctggcgctggcggaagagcaggggctgatggcgctgctggcatcgctgccggcaaaacgcaaaattctgatccacattaacaacaccaatccgatccttaacgagcagtcaccgcagcgtcagtttctgacggagcagggaatagaggtgagctgggacggaatggcgatccaccttcagggctaaaacatgcagatcaccgacacgctgtcgccgcaggcttttgaacaggccctgcgcgacaaaggcgcttactaccatatccatcacccgtatcacatcgcgatgcataacggtcaggccacgcgcgagcagattcagggctgggtggcgaatcgtttctattaccagaccaccattccgctgaaagatgcggcgatcatggccaactgccccgatccggctacccgccgtaaatgggtgcagcgcatcctcgaccacgacggcagtaacggcgaagagggcggcattgaggcctggctgcggctgggcgaggcggtcgggctgacgcgcgaagaactactttcagagcagcatgtgctgccgggcgtgcgcttcgcggtggatgcatatattaactttgcccgccgcgccaactggcaggaggcggcctgcagctcactcaccgagctgttcgccccgcagatccaccagtcacggctcgacagctggccgcagcactatccgtggatcaaagaagagggctatttctacttccgcagtcgtctgggtcaggcgaaccgcgatgtggaacatggcctggcgctggcgctggaatatttcaccaccgctgagacgcaaaaccgcatgctggaaattttgcagtttaagctcgatattttatggagcatgctggacgccatgaccatggcatacgagctgaaacgtccgccttatcacaccgtgactgataaagcggcgtggcacaccacccgactggtataacagatgaatgaaaactcgattgccgcgtttcgtcgcggctaccgtatgcagtgggaagccgcccaggatactcatgtggtgctctatcccgaaggcatggcgaagctgaacgaaaccgccgccgccatccttgagctggtggatggcaagcagaatatcgccgcgattatcgcaacgctggatagccgttttccggaagcgggcggcgtgggtgcagatgttttagagttcctgcaatcagcctatgaacagaagtggatacagttccgtgaccccgcataaacctgacgtgaatccgccgctctggctgctggccgagctgacctatcgctgtccgctgcagtgtccctactgctccaacccgctggatttcgcccagcaggagaaggagctgaccaccgaacagtggattgaggtgtttcgtcaggcgcgggcgatgggcagcgtgcagctcggattctcgggcggcgagccgctggttcgtaaagatctgccggagctgatcaaagcggcgcgcgatctcggcttctacaccaacctgatcacctctggcatcggcctgacggagaagaagctggatgcgttcagcgaggcggggctggatcatatccagatcagcttccaggcgagtgacgaaaccctgaatgcggcgctggccggttcgaaaaaagcgtttcagcagaagctggagatggcgaaagcggtgaaagcccacggctatccgatggtgctgaactttgtactgcatcgccataacatcgaccagatcgacaggattatcgacctctgcattgagctggaagcggatgacgtagaactggcgacctgtcagttttctacggctgggcgcagcttaaccgtgaaggcctgctgcccacccgcgagcagatcgcccgcgcagaggcggtggtgaaaacctaccgcgagcggatgaacaccaccggcaatctgaccaacctgctgtttgtgacgccagactactacgaagagcgccctaagccctgcatgggtggctggggcgccatcttcctcagcgttacgccagagggcaccgcgctgccgtgtcacagtgcgcgtcagctcccggtagaatttccctcagtgctgacgcaaagtctggacgatatctggtataactcattcggcttcaaccgttatcgcggttttgactggatgccagagccatgccgctcctgtgatgagaaagagaaagattttggcggctgtcgctgtcaggcttacatgctgaccggcaatgccgacaacaccgatccggtctgcagcaaatcaccgcatcacggcaaaatccttgacgcccggcgtgaggcggattgcagcgacattaaaattggtcagctgcagttccgtaaccgcagcaactcacaattgatctataaaacacggaacctctgatgaaaacgcgttgcctggagataaacggtctgacggttgaactggtgcatcagcccgatgccagccaggccgccgccctgattcaggtgggcgcggggagtcacgacgaacccgatcgctggcccggactggcgcatctgcttgaacatctgctgttcaccggcagcaccggctggcctgatgagggccggttgatgagctggattcagacgcagggtggcagggttaacgccaccacgctggcccggcgcagcgcgttcttttttgaggtcacgccgtcgctgctggctgacgggctggcgcggctgcaggatatggtctgccatccgctgcttgataatcaggcgattggtcaggaagtggcggtgattgatgcggaatatcagctattgcagcgtcatcagccgtcacgcattgaagccgcactgctgcacgccgccgcggcacctgcggaattccaccggttccatattggcagccgggtgagttttggcgatgagctctctgcgctacagcgggccctgcgccagttccaccagcgctactacttcgccagcaatatgcggctctggctgcaggggccacacacactggatgagctggaacagctggcgcgtaacgttgctgccgcgctgccctccggtcagtggcgacaggatctgccaccgccgccgctgaccagcgatacctgctggcagctggcagagaccgcacctggggcgctatggcgcagctggatactggataacagtgacggtgtcacgttatggcgtgaatttctgctggatgaagcacccggatcgctgctggctacccttcgtgagcaggggctggcggagtcgctggagctgaagtggatctatcaggcgggaggcgcgctctggctggcgctgggcgttgaaacgcatcaacccgaaaccgttaatgtcttgatcgaccgttatctggatgcactgcgccagacgaatgaaccacaacatcaacactaccacaagctggcgcagcagcgatttgtgacactgtcaccgatggagcagttacgccagcgcgcaatcggctttgcgccagatgaagccgtgcctgcgttacagccgctgctggcgcgtctcaccgacgcgccgggcacgctgctgttctgcacgtcgcacccggctgaggaaacccttcagacgcagggattcagccttgcgctgaccgcctggcagccagccccgtctgaggcgctacctccggcgcatttcacattctacccgttcgagactgccttaacgtctgagccgctgcccgcacaggcggtggcattgccgcatcatcagcctgatgacctgcaggcgacgctgatcctgcgaccagagttctggtcaacgttcaccgaagcggcaggcgaagcgctggggcggcggttacgtccgctgtttgccgcgttgcgtcatcagggcggcaacggcagctggcaggaagtggagggcgtgtggcaactgacgctacaactgacgccggatgaggcggtggctgaccgggcgctgagccagattgtcgccgcactgacgctgccggttgaggcggcgcagccttcttcgggggaaagcatcgcgattcgtgcactgctgcggcagttgccttatcagctggccgccactattacgccacattgctggcgggcggcgctgaaaggcggcaacgcggcactgcattcactgattgcccggcggctgagcgcactgtcgctgccggttaaccctgacacgccgccaaagcgcatgacgacgcaaaccggtatgacgcgcctgccacacagcagcgcggacaatgctctgctgctgtttatcccgctgcatcgtcctgaacagctggcggcgctacgcgcgctggcgctgatctacgagccgcgctttttccaacgctatcgcgttgagcagcctatcggttatgtggtcagcagccgctatatgcgctgtgccgatgaagatggggtgctgtttgcgctgcagtcgcccgattacagcgcgctgtcactgctgcgctactgccgcaacttcctgcggtcactgaacgagacgctggcgggttacgatctggcggcactgaaagcgcgtcttctgagccgggaagtggatcagccactggcgtgcttacgcgcagaaaatggcctggtagaaccggatgcggcgcagattgaggcgctgacacttgcggatctgcaacagcttcaccgcacgctgattcaggatcgccgccgctggcgggtgctgttcaccggcggtgaaaatgtgtagcgcccggtataaagttgctgaatttatttgaaaattaccgacaaatctcttcactgtctattccgggcgaactggaccacactcaattcactttgtccgcataaggaattgaccgtgaaaaacttcaaacgtattgcactgcccctgttagccgctgccaccctctacgccccgttgtctcaggctgaggcgatgcactaccagctgaatcctgagcatacgtcggtgattgttgcctggaaccacttcggcttctcaaacccaaccgctgatatccctgatgcaaccggtaacctggtgtttgataaagatcatccagaggcatcacgcgttgacgtgaccctgccagtcagcaaaatcgacagccacgtggctgcgctgaccaaagaattcaaaggcgctgagtacttcgacaccgctaaatatccgactgcgaccttccacagcaccaaagtggtggcgaagggcgacaacaaatttgatgttgaaggcaacctgaccctgaaagggatcaccaagccagttacgctgcacgcgacgctgaacaagcagggcgagcatccgatggtgaaaaagcaggcgattggttttgatgccaccggcaccatcaagcgttctgactttaagctggacaaatatgtcccagcggtaagcgacgaggtcactctgactctgtctactgaagcctacgccaagtaagctttttgggacgtagcggcttgctgctacgccccttattcgttttttctgcgccttcttcccctctgaaatctattctgcccgcctgtttatctgccataaaataatccggatatctcctcatcaactattttctgaacgctttatctggcccggaaccgggaaaaatgaggcgaaagtcacaaatttgcaacagcacggaataagccactcagtgccgctgtgtggcgaaataaaattcagatgccttctgaaataacccgttgatttatatcgtttcgctctaatctgccttcccgcaaatagtgtgattttgatctcataaaccgccgttcagacacccctgtcaataaccccgtccaaaaaataccgctcgtaactgtgatctcctctgcaaatagcaaccccacgaaccggaagaatggccctcagcagattaagacagcgaggtgagggaaatgcgaattggaatggtgatcagtggcggtgatgtaaccggcattaataattttgtcttccagttagggcgtctgacgcaggcggagatcgtgatatttgatggtggcattcccggcctgctggcaaataaccatcgtgatatcagccagcgtgatctgctcgacttttcaattgcctcaattccggttatgcaatcgggacgcacgcaaaagaaactggtgcgcagcgaatatgaatgtattgcccgccagctgaaaaacgcccggattgacgtattaattatggcgggcggtgacgggtcgctgcaatttctccataccctgtcggagtctggcgttaattgtttcggcgtcggcatgaccatcgataatgatgtcttcggcagtgattacaccctgggtttttccaccgcctgcgagcaggtattaaaagaggtcgcgaaactgcggaataccgggcgcgccttacctggccgggtatttatgctggagttactcggcggctactgcggcgaattaaccctgcagtcggcgattaaatccaatgcggacattgcgctgatcccggagtgccagattcctttgccacagctggcgcagcgcatcacccagcgactggcagaacagaaacagcgtgatcattctctgttcagaaggctacacccgcgaatattcgcccggttttcagggggctatcgacaccttaatcaaacagcttgagccgcttattggcgtacgcgtccgtaaaactatcctcggttacgggctgcggaatggtgatcccacctgcgaagagatttatcagggcaccattatggccagtgaagtggtgcgttgtattcagtcaggcatgcggaataaagcggtcattattaacggcagcaataaaccgattccgattgatttaataagcatgcaaaaacgcctggtcgatattgacgggcaccattacaaactcgctaaacaactcaatatattgtgaggagaaaaccatgctgaaaatattatgtgtctgtggttgtggcttaggatccagttttgcgattgagatgagcgcaaaagcggttttaaaaaaactggagattgaggccgatatcgatcacaccaccatttcagaagcgaatgcctttaagtcggacatgattctgacgcaaaaagcctttgccgatgtgttaaatgccgacgccagtccggaacagattaagcgggtcattattcttaaccggctcaccgataaagcggaaatagagcagaagatcctggcctttttaaaagaacgcaacgtaaaggtcgccgcccatgaatagtgtgatcgacttcctggtaaaagatctgctggggcaggcgtctattctgatcgcctttattgccctgattggtctgctgctgcaaaagaaatctgcaggcaaggtggtggaaggcacctttaaaaccctgctcggttttttaattatgatggcgggtatcaatattattgtgggaaccctgacgttcctcaataccatttttacccacggctttggcatgcgcggctatatcaccgatgttgccgccattgccgggctggctaaccgtgagctggggtctgaagtggcactgacgctgctggtgatctttatcgtcaatatcatcatcgcgcgactgacgccctttaagtacatcttcctcaccggccaggccctgctgtggatggcgacgattggcgcggtgattggctataaagcggggctgaccggtctgccgctgatcctgaccggcggtatctttggcgggatcatggccgtggtgatgcctgcgctggcgcagccggtggtacggcgtattaccgattcggacgacgttgccctgggtcacttctgcaccattggttatctggtcactgcggcggtcgccaaagtggtcggcaaaggatcgcgatccactgaagatctgaagctgcccgataacttcaagtttctgcaggatacctatctgtcgatggcgctggtgatggtgccgatgtacctgatccccgctgtggcggccggaccggcgtttatcgcccagtacagcaacggcatgaactacctgatgtacgcctttatgcagtcgattcagttcgtggccggagtctttgtgctctacagcggtgtccgcctgctgcttaacgagctggtgcctgccttccgtggtatcgccatgcgtgtcgtgccggatgccaaaccggcgctggactgcccggtgatgtttccctatgccccgaacgcggtgattgttggcttcctcgccaccacgctcggctcaattgtcggcatgctcgtcttcccgatgtttggtctggcgatgatcctgcctggcctgctgaccaacttctttgccggtggcaccgccggggtatttggtaatgccatgggtggaaggcgcggcgcgatgatcggcggcttcgtccacggcctctttatcaccattctgcccgccatcctggtgccgatgctggagagctatggcttcaccggtgtgaccttcagtgactcagatgtcatcagtaccggcctggtgctcggccacgccttccagaataactggctgtttgtcgccctgtttattgcctttgttaccgcgcttgcctggtttgttaatggcaaatccacaaaacctcaagaggaaaaaatccatgaaactttataacttcgccgatctgttacagctggctaaacagcgcgactttaaagcggtgggttcttttaatcttcactgcctggagatgctgcccgcctattttaaagcggcagagaaaaccaatagtccgttaatgattcagatctccaccggtacggcgaaatatctcggccataaattactggtcgatgccattaaatcgctgtcagagagtatgaatgtcccgacctgtctgcatctcgatcactgttccgatttagcggcgattcagaccgcgattgatgctggattcagttccgtgatgtatgacgggtcccatctgtcaattgaggagaatattgccaatacccgccgggtgattgatatggcgcgtccgcacaatgtttcggtagaagcggagctgggcgcgattggcggctcggaagatggtaaatgtgtggagatggaggcgattgcgtttacgccggtggaagatgcgcgccgctttgtcgaagagaccggcgtcgatatgctggcgatctccatcggcaccgtgcatgggctttacaccggtaaagcgcatattcagcatcagcggctggcagatatcacggcggcaacccacacgccactggtgctgcacggcggcaccggcgtcagcgatgaagatatgcggctggcggtcagcagcggtattgagaaggtcaatgtcggcaccgaaatgaatgttcagtgggtggcgcagtgcaaatcaacctttgaaaaaggcaaggtcaatgacagcgtgcgtaatttcctggtgccggccaatgatgcggtaaccagtgtgctggtagagaagatgcaattattccggtaatcgcccgtttcgccatcaccggcttattgcgtcaaaccttttataattacctattaatctgagccaccccgacatgctacggggcaggagagcctatgtttggattcttaaaaaagtctccggctgtggaacaacccagcgagcagcagcaggatcatctggcggaattaagtcgcgagaaaataacgcaactggagcagcagctggctattaatccgcgtgatggcgaaacgcaaaaacaattaatgctggaatataaccgggcattaagcttatttgcgaaaagccgtcgctatcgcaatgaaattgatgcgctgtttgtcaaaatcgatgaattacgcaatgtggttcgccagtcgatttaaggagagctgatgacgattaagcagttattgcaagaggcaaacgctattcagattggtatcgacgccacggactggcgtcaggttatcgcgctggctgccgaaacccctggtcagtggcggctatctcgatgcttcttatcctgatgcggtcattgccaatacgctggcccatggcgcttactacgtgtttgaagaggggatcgccattccccatgcgcgaccggacgcaggggtgatccgcgactgtttcagtatgattctgttgaatgagccgatctcgtttgagggcagtgataaagcggacattgtgattatgtttggcgcgcgtgacagcaatgcgcatatcgaagaggggatccgcgcgattgtgtcgctgctggaggatgaggagacgctggtccggttacgtcaggccagcagtgtcgcggaggtcatcgatatcttatgacgcaaaacatcccccccaaacgcgtggtgctggttaacggtattccggcatcgggtaaaagcaccctgacgcgcgtgctgtcacaacagtttggctggccggtgctgacgctcgacagcctgaaagagccgtttatgcacgcttttgcgccggtcgatcgccagcgtaaccggcaactgggctgcgcggcctatcaggcgatctggaacatcgtcgcgcaggcgcccgccagtcagatctggctgatcgacgcctggtttgggttccagccccgtacgctgctggagcagggactgaaacaggcgggcgtggaggaggcgctggagctgtggctgaagattgaaccggaagcggcggtggcgcgctaccaggcgcggctgtcgcagcggctgccgggccatccgggtgcggagtatctgccggagctgcgccagctggcacaacaggccactccgatggcgctgggcacggtgtatgaggttgatgcctgcgttcaggatcacgctgccgtcattcactggctgcagcagcaactgaccagaacccgctacacttcagttcatcatcagaggagtgaggagttgcaggatgtcgtcgcccccgtatctgcaaaccggtgaaagcgccgtgctctacgacggcgtctgtaagctgtgcaacggctgggttcagttcctgctgcgtcgccatctggcgcggcaggtccgttttgcctcggtgcagagcgagcagggcaaagcgctgctgcgctgggccggactgccggaagagaacatcagcaccattgtctacattgccgataaccagcactggctgcgggcgcaggcggtgttccgcgtgatgcagcacctgccggcaccctggcgcgggctggcggtgctgcgccactttcccgacgcgatcagtaattttgcctatgaccgcatcgcgttaaaccgctataagctgtttgggcgttacagcgcccagcacgctatccaacccgattatcctggtcgatttctgcatgaggtggagcagacggtcacggaagggtaaataccgtccggcaacggctgtcgtcgctctgccattcctccgcgatatcacttaatggacgcgaccggaaaggaatggtaaaaccgtgcggtccggcggcctgcagcatttcccctattgaggcgatcagttcacggtctggcacactgcccagcccgcttcccatcagtgttagcccggatgagcgcagcagcttactgtgcagggaaatctcctgcccgctcagcgaaccaatctgcacaaagcgcacgattttttcgccaccccgaaccgccgcagtcatgattgccagtgcgctctcaccccacagataatccagtactacatcaacgccctctgccatcagggcggggagtttcggtgggcagcgcatccagcgtcagagtgatatcagcaccctcattgtgcaactgctgcagcgtttctctgttacggccggtggcaatgattttgcctgcacccagcgcgcgggcaatgcggatcgccaggcgacccgaagtgccggtcgcgccattgatcagcacggtctcgccggggcgaagtgcggcccgacgggtcagcgctgtccaggaggacatgcccggattcgcgagagctgctgccagcaccggatcaaggccagaaggcagtgggatgatgtgttctctactgaccaccgtccgctcggccatactgcccgaggcggagtcaaaagccagaaagtagacagcctcgccgttgtcgaggtagcccgttccgtcaatgcccggaataaacgggaattgcgaaacggcgctgtagtggttgcccgccgcccgggctttcgccagctggctgagtgctgcggctctgacggtgatccgctgctgatgctcaccggcctggggttccggtctgtcaccgtagtgaggttttgcgcctgcctgatcgattatcgctgctttcatggttgatccgccttctgtctgggagttattaggtgtaaagtacacacattattcctgcctcaggatggcgtcaatgaaaagtgtgcaaaatacacataaatacgatgcgctgcataattgtctgctgacaattgcaggtgcgcttaaccgcccccagcgcgatatggcgatgattaaagcggcgggtattgaactggatcgggcgctgtttccgctgctggttcaggtcagccggttcgggccgatcggcgtaggcgaactggccgatcgggtggggcgtgactacagcacggtcagccgtcaggtggcgaaactggaggaaaccgggctggtcgtgcggcagaaaaatcagcaggacaaaaggattaacgaggcagccattaccgcagatggccgggcgatgaccgataaaatcgatgcgcagcgcgtgcaggtctatcagcgcgttttccggcactggccggacagcgatcgcgaggcgctggagcaactgctcagcagatttgttaccgattttaccctcacggaaggtgacgaaaatgatgacaagcatgatgcggtttaagggaagagggatttatgccggttaatttcgatctcaacgatctctatgcgtttcgcgcgctggtggagtttggcaattttcgcctggcggcagaatcgatctgtctctcacagtcggcgctgagccgccggatagataagctggaaacctcgctggggatcaaactgtttgagcgtaccacgcgccgcgtcacgctgacccttaaggggcatgcgtttgctcagcgctcggataagttgctggctgattttgaggaggtcatggccgatctcagtgaggtgagcttagcccgcactggcctgattaccgtggcctgcgtgccgtcagccgcctactactttatgcccaacattatccggctgtttcaggcgcgctatcctcgcgtacgagtcaaactgatcgacagcagtgcggctaacgtttatgacgcggtgattggcggtcaggccgactttggcatcagtttttccagccgctcgcagccggatgtgcatttccagccgctgatggatgatccctacgtggcggcctgtcggcgtgaccatcctgtagctggcaaaaagagtctgagctggcaggcgttttatcagtatgaatgggtcgggctggataaaacctccggcaatcgcaacctgctggatcaggcgttgcaggcgatcatgccggagaaaccctgtatctgtgaaacccggcacgtcaccaccatgctggggatggttgaggcggggctcggtattgctgccgtccccgccatgtcgatgcctggctacgatcatgccctgctgatggcggttccattgaccgatccgcaggtgaaacgcaccgtgggtctgctacgtaaaaatggccggacgctgtcgcacattgcgggcgaactggagaacctgattattgaacagtatcagcgtctctgaccggttttgacgctttcacggtgtgcagtccgctggcgtgcaccgcctgttgtgcttcagaagaggcgagccagcgcagcagcttcgccgcctcatccggctgcgctgacttgcgcaccacggcaccggcgaagcgggtggtgtattgcagcttgtccggcagtttcgccaataaaagtgacgcctggcaccggcagcagctcactgacctgctgaaagccgatagcgtatttaccggccgcgacctctgaggccaccgggatgcgctcaaccttcaccgctttccccttaacctgatcttcaatgcccaggcggctgaacagctggctgctgacatacttaccgctggcgctgtcagagtaggcgatggagctggcgttcagcagagcagtacgcagcgcgctttcgctgccgatcttaaccggcgtggcaccctgtctgatcaccgcgccgatgcgggagtccgccagctcaacccgtgaacccggcagcgtctcgccctgtttttgcagatcgcttagcgcatcgccgaccataatcaccacatcggccggttcaccgcgcgccagtcgggccggaatcgcctgcggggttttgcccatagacggaccggcgacggtgttgatagtgatcccttcacgctgggcgaagcggggcgagagcgtatcccacgctgctttaaacccgccggagatcatcaccgtcagctcttttgcctgcgccgtggcgctgcccgccacgctgaacagcagagcagcgtacagcgacatcgttttcagtttcattttacgttcctcagctaacggtttcatgggcaggcgatacggcactgcgtgtacgacgatagagataaagtgttgcccccagggcgcagactgctgcaaaactcatccagtagcctggcgaggctttatcgccggtcatctcaatcaggccggttgacatcaccggcgtaaatccgccaaacagcgcagttgccaggctataggccagcgagaagcccgccacgcgcacttccgctggcatgatttcagtcagcgccgggatcatcgcgccgttgtagagaccatagatcattgaaagccacagcagcacgcccagcatcatcgagaagcccggtgcggcggccagcatgctcagagccggataggtggtgactattgccagcagggtcatggcgaccagcacaggcttacggccaaagcggtcggagatcgcgccgccaatcggcagccagataaagttcgacaccgccaccagcaacgtcaccagcaggctgtcagaggcgctgagcaatagcactttcttgccaaaggtcggcgcgtaaaccgtaatcaggtaaaacgcagtcgtggtcattgctaccatcagcatcccggcaatcaccacctgccagttggcgagcaggatgcggaacacctgcttcacatcgggatggctgcgacggttgttgaactcctgggtctcttccagcttgcgacgcagcacgaaaataaacggcacgatcaggcagccaaacaggaacggaatccgccagccccattcacggatggcactctcttccagcaccgcgttgaggataaagcccatcgccgccgccaccataatcgcgacctgctgactgcccgactgccagctggtgtagaagcccttgcggcctggtgtggcgatctctgccagatagaccgacacgccgcccagctccgcaccggcggaaaagccctgcagcagccgaccaatcagcaccagcagcggcgcccacagaccaatactctggtaagaggggatcagcacgatcataaaggtgcccgccgccatgatggagagcgtgacgatcagccctttacgacggccaaccttatcgatgtacgcccccagcactaccgcgccaatcgggcgcatcaggaaccctgcgccaaacacggcaaaggtcatcatcagtgaggcgaactcactgctggccgggaaaaaggtatgggcgatataggtggcatagaaaccgaacaggaagaagtcgaactgttcgagaaagttgcctgaggtaacacggaatattgcgccaatcctggcgcggtgagtcatgggtgaggttgtctgcatcagtaactccagtaaggtttgacgctttttgccgcgcctgtcactgaagagtggatcagcgcccggcgctaaataagtgcaaaaagggcatcgattaatgtgccagccgcatgattgccaggcgttatcacttaaagtgtttcgcattcaacaggttaaatggcgggatggtttttttgtgcctgttagtgagcctgagaggagtttgcggaaatgtgacagatttcataagcgtgttgcaggcgaatagggggaatctggcttgtctgaggccatcagcgcagagtctggcggcaaagagggttcagaacgcaggcagcaaggcgtcagggaaaggttatgccaaaaatctgatgtaaatgtcggacgcccgctacggtaaacaccacttcacggtagccaggctgccgggttagccagccttgcgtttcaaaggcactcagcagtgctgcacccgcgtagccgccgagatggaaccggcgctcactccagtcgagacagccacagcaggctctgcggcgtccgggttgggacagatcaatctgcaacgccgcaaactgctgctgtccatataaggtgacagcgctgccttccggtgtgatccagccctgttgcgccattacggcatagatctgcaccgcaatatcaccggccagatggtcgtaacaggtgcgggcggtgcgaagcgatgttggggtggtgctcgccggcgcggcaatccgtcgccacgacacgcccatcatgttctcaatcagcgtagcgatgtcactgccggtcagtcggtaataacggtgacgcccctgcgccacgcagacgatcaagccgctggtgatcaaccggttcagatgggcgctggcggttgagggcgccacgtcggtgacggcactgagtttcggtggcggtccaggcgcgtccatccatcagcgcggacagcatcttcacccgtgacggatcggccattgctgcggcgacgcccacaatcgcattctcaagtgcttcgctatcgtcaggtgcgttatgcggttgtggagttgccatcagattacagtgcccattctgtggtcagcccggcggctgatcgattgttatcggtaatcaggatcagctggttagcgtgatcgctgtattgcaccaggatgttgattccggcatcggcaaggcgtgcagtgatcgctcccagctcgccgggacgctgttgcggtaacctgcgaataagcgggacgttaactgcctcgacggcgataccttctgcttcaagcacggcccgcgcccgttcgccttcctcaaccagaaaatgagcgtggctctgctcaccaaaggagaacaggccgccgccttccaggccaatcccatgacggcccagcagcgtggtgagccgggaaagtgtgcctggactattttgcaggatgacatgaatatcgaacatgttaatttactccctgttgtgaggcatattctctgatcagcgtgacgatgcgaagacgataaccggcaaaaagagtctcgcggccttcacgctgtgcggcctggtgacagaggttgcgcttccaggccagcaccgattcttcatcgcgccaccaggagagcgagagaatttttttctcatcggtcaggctttgaaagcgctcaagagagataaacccgctgttttgcatcagcagcggtttaaggtcggcagccagttgcaggtaacgcatctggtgttcgggtcgggcttcggcttcaaatagtacggcaatcatcgctatcctcctttgggtgatagcgcaaaaatagcgggcggggcgggttgatgcttcgtccggtaacgaaatatggctgcaggggcgacctccagccggtgcaatcttgtaatggagcagatgatatgttcagcggactcagtgcgttcccccttactccctttgcggcaggcaagcccgatgaggcggcttttttgcggctgctgcgcaggctgattgatgcaaaagtcgattcccttggcgtgctggggtccaccggcagctacgcctatctcacccgcgcgcagcgcaggcgcatcgcagaactggcggtggaacatgcagagtcgattccggtgatgatctgcattggtgcggtgggcactgacgaggtgctggcgctggcggaggacgcgcagcaggcgggcgcggctgccttactgctgccgccgctgggttatcaggcgttgaatgaagatgaggtgttcacgcttttcgagaccgtaacgcaacacgcctcggtgccagtctgtatctatgacaaccccggcaccacccattttacgttttccgatgcgctgctgagccggatcgccacactttccggtgtcgggtcagtgaaaattcctggggtaccggcagatcaatctgcggctaacgatcgcctcgctcagctgcgcggcacgctgccagatgccgtgtcgattggcgtcagtggcgatgcctcagccgccaacgggctgattgcgggctgtgatggctggtattcggtgtgcggcgggctgtttccgcgcgtcgcaaaagcgatgaccgaagcggcggccgcaggtgaccatcagagcgtcagggcgcagtccgatcgcctgcagccgttatgggcgctgttccgccagcatggcggcagtttccgggtgatcagcgccgcggcggggctgctgggactgaccgaacgcgactgtctgccgcgcccgctgttaccgctctctgcggcggactgccagcagattgctgacgtgctcgcggcactcgacctctcttaagatcccgcgccagaaggcattaaccgtggcgcaccaggttaaagccttcttcctcctgcggcgcttcgaaatagcgggtaatcagcgcgaactgctcgtccgttgcggcaaaggcgtgttcgccgtcctgatttcgggcgtgcaggcgcgatttacacagcgcatccggtacgtccagataatgcaggcgatggtcggcagaggatgccttaatcaccgacatcatccagtcgcgattcgcccgggtgttggcaggaaaatcgagcaccaccgacacacctgcgttaagcagcgcgaccagatgaggcgtcatcgcctttctgagtttttccgcatagcgcacgtaatcggccaccgactgcatctcgtccttatagagcgcggcgagccactgatcctcgctgatcaccacgcaaccgggggcggcgctcagctcagccgccagcgtcgatttcccggaggcaatttttccacacagcagatgcagcgtggcgggggcaaaagtcatggtcacatcactcctgtgtcagcctgatagtgaaccgcgcgcattacgcgaaaggaaggtaaagcgattctctccgaagcgggattcaggctaacaaaacaggggagagataagcaatgagaggcataaagtttaaaacccgaatttaccgcgcgtaacagtctctgctgctgcgggcgttactgcattcagaaaaaaccgcggctttcgctgggcacgttgacacgcctgaacggggaagtgcgctcaggcgtagcgtgggatatcagatacgctttcagaaaggggtgaatcggcgctgaacagctggcaactgacttcatttttgtgccatcagcaacgtcagcagttcgcggcagcatgcctcttcttctgcactgtctgcggatgccaggtggcgcagcagttccatacagcttttttccttgcccgcttccagtaactcttcgatcagaaagttgagtttgtcctgttcagacacggcaaaggatgaactaaactcatttttgaccgggccactgtgattcaccggcaacgtgagggtgttttgcattggcataatattgtcctgtttcgggttaaaaaatgttcggcgattgctattaaacttatacaacgatccggaatttgtacagaaatctggccgattgattttcaggacgaagctaagcgcagcgcggttgcggcgtaaatgtcagctaatcattaagttagcgtgagaaggaatttcagaaaaattctgcgggcctgaagcaggatgcggagacgggaaaaaccaggtcagtcctgcgtcaggtcagcaggcggcccaccgggccgcatgcactatttagcggtcaggaaatcttcgcgctgcggtgtaaacgtatccagtaacgtgcccgcctcaaaacagacacagccatgaaccacattgggcgctttgtagagcgtatctcctgcgcccacctcacgcgtttcaccattgatggtgaaggcaaaacgtccgctcagcacataggtcagctgctcgtggggatggtgatgcagcgggccgacagcctctttctcaaaaatcacttctaccgccatcatggtgccgccgtacgccagcacgcggcgggtcacgccattgcccagatcttccagtggtcgctctttatggtagataaacatcgcaatcctcctgcggttgcccctgctgcggtgaccgttttgtgatggatctcacagcactcgggtgaattagtttatgcactttagtggtttttcactaaaatgaaacggtgtttcaattaatttataagggtagatcatgaaaatcgcgttaatgatggaaaacagccaggccgctaaaaacgttaccgtgctgaaagaactggaaggcgtcgcacagccgctgggccatcaggtcttcaacgtcggtatgagcgatgagcaggatcaccacctgacctatattcacctcggcattcaggccagcgtgttgctcaacagtcaggccgtggatttcgtggtcgcgggctgcggcaccgggcagggtgcgctgatgtcgcttaacattcatccgggcgtcgtctgcggctactgtatcgatccggcggatgcctacctgtttgcgcagatcaacaacggtaatgccttatctctgccgttcgccaaaggctttggctggggcgctgaacttaacctgcgctttatctttgaaaaagccttcaccggcgagaagggcaatggctatccgccagagcgtaaagagccgcaggtgcgtaatgccggtctgctgaatcaggtcaaagctgccgtgatcaaagagaactacctcgacacgctgcgcgccatcgaccctgaactggtgcgtactgccgttagtggcccacgcttccagcagtgtctgtttgagcatggcaaaaatcaggaaatcgtcgcttttgtgcgtcagctgacccactaacgcatccggggtcataaggccggtctgaccggcctttttttattctctcttttccgacatcagctgaacgtcagctctgctgcgccagcgccggattgtaatgacgactcgcctctaccagtatccgggtgtagggcatcgcggcccggtcggccaccagcgtcggcacatccagcgtctccagcaccttgccctgttgcataaccgccacgcgatggcagaggtgcgccaccacgccgagatcgtgcgtcaccatcagataggtcaggttctcctgctgctgcagatcgctgagcagattgaggatctccgcctgcaccgaaacatccagcgcggaggtcggctcatccagcagcagcacgcgcggctctaaaatcagcgcccgggcaatcgccacgcgctgacgctgaccaccggaaagctggtgcggataacgcgtctgccaggcacgattcagcccgaccttatccagcatcgccacgacgcgctgctggcgctgcccgataccctgaatctgtaatggctcttcaaggatatcgcccagcgtgtggcgcggatgcagcgagccataagggtcctgaaacaccatctgcacctgacggcagcgcgcccgatcgatgcggtgcgccagcggctggccatcaatggtcagctctccctgccagtgattaaacaggcccgccagacacttcagcaccgtggttttgcccgagcccgactcaccgaccagcccgaagatttcaccctgtttaacctgcaggctgacgtcgaacagcacctgattacggcgaccctcttcaccaaaactcaggttgagatttttcacctcaatcatcgtaactccttagtcagttagccagctggcgtgacgttgtaacacaggcagacgcgtgcgccgccgatcaaggtcgggcagtgctgccagcagtccctgggtgtagggatgctgcgcgcggtcaagtttcgctggcggccagcgactccaccacgcgcccggcatacatcaccagcacccgatcgcagaagctacgcaccagattgatatcgtgactgataaaaatcagtcccagaccgcgcgctttcaccagatcatccagcagcgccagcacctgcaggcgaaccgagacatccagcgcagaggtaggctcatcggcaatcaccagttccggctcggtgatcagcatcatggcgatcatcacgcgctgcccctggccgccggaaatctcatggggatagagctgatatacccgttcaggatcgcggatctgcacctcctccagcatcgccagcgcccgctgacgtgccgccgatttctggccgcgatggtgactgcgccaggcttcggcaatctgttcgcccacccggatcaccggattcagtgaatatttcgggtcctgcataatcatcgagatgcgtttgccacgaatagcgcgcatctctgccgggctggcgtgcaacaggtcgatatcgccaaactgcatccggctcgcctcaatgcgcgccttagccggatgcagctgcagcagggcgcgacccacggtcgatttaccggagccggactcaccgacaatcgccagcttctcctgaccgagctgaaaggagacgccacgcaccgccggggttatctggcgtccgttaacaaagttcacgtgcaaatcgcgcacgtcgagcaacggcgaggcgttactcactgcggggatcgagcaggtcacgtaggccatctcctaagaagttaaatgccaggctattaatcaggatcgccagaccgggaacggtcaccacccaccagcactccagcatgtaggtgcggccactggcgatcatcgcgccccattccggatccggcggctgcgcgcccagcccgagaaaccccagcccggcggcggtgagaataatgcccgccatgttcatggtgatgcggataattaccgacggcaggcagagcggaataatgtgcttccagagcacccgcaacggcgacgcgccctgtaagcgcaccgccgagataaagtccgcctgacgcagcgacagcgtttcagcgcgggccagacgggcaatgggtggccaggcggtgagcgtaatcgcaatcaccacatgctccagacccggccccagcgcggcaacaaaggccagcgccagtaccaggctcgggaaggaaataaagatatcggtgacgcgcatcagcacgccgtcgactttgccgccaaaataaccggcggtgacgcccagcagcaggcccagcggcccgacggtgaccgataccagcagcacgatgtagagcgtgatgcgtgcgccccacaccagacgactgaagatatcccggccaaactcgtcggtgccgaaccagtgggccgcgccgggaggcgtcagcgcattgttcagatcctgaaccagcgggtgatacggcgcgatccagggcgcgaacagcgccacgatgcagagcaccagcacaatgccaccaccaatcgcggtcaggggattacaggccatgcgccagaggaaatagccgcagcgggcagcaaaacgctgacagcgcaccagccgctcacgggaatgactcacagacgcagcgtcaaaagagatcgtcatactttggtcctcggatcgaacacctgatagagcaggtcggagatcaggttaagcagcacaaaaatcaggcccaccaccagcacacagcccatcaccgcattcatatcgcccagcatcaggctgccggtgaggtaggagccaaagccgggccaggagaagacggtttcaatcagcaccgcgccctccagcagcgagccataggccagcgccaccacggtcagcagctgcaccaggatattgcggaaggcgtgctgccagatcacctgccattcggtcaggcctttgacccgtgcggtcagaatgaactcctgcgacagctgcgcgagcataaagctgcgcgtcatgcggctgatataggccatggagtgaaagccaagcagcgaggcgggcagcaccagatgattcagcgcattccagaacacctgactgttgcccgccagcagggcgtcaatcagcataaagccggtgcgacgtggcacgatgccatccaggctgaagtccacccgacctgcgccgccgacccaaccgagatgggcatagaacagcagcaggccaatcatgccgacccagaagattggggtggagtaaccggccaggctgagcatccgcaccacatagtcgatgacgctgttgcgacgcgccgccgccagcacacccagcggcacgcccagtcctgcgccaatcacaatcgccagcgtggccagctctacggttgccggaaagacgcgcacaatgtcatgcaccaccggctgaccggtgagcagcgcatggccgagatcgccatgcagcagcgcgttaaggtagatgccaaactgcacccacagcggtttatcaaagccgagctggtgataaacctgctgataggtggcctgatcggcgtcggggccgacaatcgccagcaccggatccagcggcattacccggccaataaaaaaggtcagcagcagcaggccgaacagggtaatcactacctgcaccgcgcgatggctgatgcggcggcactgagttcgggtcagggtcaggatcatagggtgcctcccgctttggcttcaggggttttccagacatcgcggaggaaggtggtcgctgagggatgcggctgataatcctgcacccggttactgaccaccacggagtcgagcatttgtgaaatcggcatcagtgcaggcaccagctggtcatagcgctgctggatggcgtaataggcctgctgctggcgggttttgtcgcgctccaccagcgcctgatcgatcatgctgttgagctgcgcgtcgtagaaaccggtgcgccagccctggaagttggtcagccgggcgctgtcagcattattcgggttatagaccagcgcgcgcaggctggagtggggatgcggctccacgccgctgccgccgcgtccgaccagcagactgaactggcgatcgcgcatcgcgccatagatctggttaccggtgccggtgatgatttttgcgcggatcccgccctggagcagcgtcgactgcaccgcgatggcgatgttcagaaatggctgatcggccagcacccgcagcgtggtgtcgaagccgtccggataacccgcttcagccagcagtgcgcgggcgcgcggcacatcgagccagtaaccgggatcgggcagcgtggcgggcatgccagcctgaatcgggcgctgatgcagctcgccatagccggtcatcaggcttttattgatgccctgataatcgaccaggtagcgtaccgcctcccgcactttgatattgtcgaagtgcggatctttcatgctcatcgccaggtagtagatcgttccttttcttaccgcatcaatggtgaggtcggggtcgtgccgcagggcgcgcacgtcggggatcgccatgttactggcgatatccagatcgcctttctccatcatcagccgcagtgtctgcgactcctgcagatggcggaacaccacccgcgacatcttcgcctcgccgcgccagtaatcagccgcacgactcatgcgcagcacatcttttgcctgccatacatccagccggaacgggccggagcccgcttcatgggtggtgagccagcggttgccccagtcgccatccacctcatgctgctgcacggttttgctgtccagcaccaccatgctgcccagcgccgccagcgagtagatcaccagttgcggatcgttaggtctgggcagggtgattaccagcgtgtggtcgtcgggcgcggtaatcatctggtctacattgtcgcggctgaagccgtacgatttccacaccgacgcctgcgccaggttcagatgcagcacccgccgcatcgaccagactgcatcggcgctggtcagcggattgccggagtgaaacctgacgttgtcgcgcaggtgaaaagtcagggtgcggttatccggactgactgaccagcgtttccgccagcgccgggcgcacctcggtgagttgctgcgggttcagctcgaccagtccgtcatagagattcacgacaatgccgaccacttcgttgccggtcatagcggccggatccagggtgagcaggttattcatattcatgccgacgatcagctggtcatccggggtctttgcctggattgacgcgctgcccgtcagcaccagcagcgtgatcagccacgcgccacatcgttgtgtcagggtcataggtaaagtccagcaggtcagaggttttcccgtttacgactctgcctgctgctggccaccgggatggcaggcagcaggcgggcgacggggttattattgtttgccgtacttcggtagtgcgatttaccagcggttcagcgtgtgcgtctcaatccagctgaagttaatatcctcacccagcccgctgcgggtgggcagggtgacaaatccctgatcgtccatcgggtcgatcaggctgttgaggtaggcgggcggtgtttcataatccaggaagggatgcagcaggccgcgctcataccagcggcagttacggatcgccccgaccaccgccaggctggccgcaccgttgccgtgcacttcgcaatccatgccaaaggcttcagccagattcgccactttcagggtgggcgagatgccgcctacgccgttggcaccggctcgcagaatgtcgcaggctccggcacgcacccagtcggcgcggctgtgatgtttaccgcccaggctctccggaccaagcacgtcgatagagaggttttcggccagccaggcgtaagaggccatgctctcttcctccatcggctcctcgaaccaggcgaaattaagcttttccagcgccttgccgatggtcagcgcgtcactgcggctgtaccagtggtagccatccagcatcagcgcgatatcggggcccaccgcttcacgcaccgccgcgcaggctttgatatccatcgccgggctgggggcgaaggagaccggcggcatccaggtgtgcaacttgatcgcctgatacccacgcgccaccagcttttccgcgaactgcgcatactcatccggcgttgataatccaccgctcagctcgtcaccacacatggtgctgccgtaagccgggatcttctcgcgatagccgcccagcagtttgtggacaggctgtttcagcttccgtccaatcagatcccacaatgcctgctccacagcggagagcgcccgctcggtgagctgatgggcgctaccgcgctgccagtgcaccagatcctgccagagacgctcccggtcaaaggcgttctgaccgatcagcactttgcggaaaaaggcattaaccacatgggatcgcaccacttccggcggcgcaaaggcgtaaccacagtcgccttcctcgctggtcagggtcaatagcgccatctgcgcatcattttccgggccagggtgggagtgtccggcgctgtcggcgcagcgttgggtgggataggtaaaaagggtgacatcaatggcgctgatcttcacggttaagctcctgtggcagtctgtcctgatgaattattaaaacgctgtttcattttcaatctagccttcacaattcattaacgcattagccaaaacgatacgattaatggctaatatgtgtgcaactgcccagggtgttgtgaacatattcacgaaagctgaccgttttgtgagcagcgacacgctgcgctttttcctctcaagggatctctttgagtggaactccgccagttaaccccgccgcaaaaaacatttaaccggatgacttcccctgaccactgttttaggtgatagtaacgccgctttacattaataattctcattatcatttgtgcgggtttttacaatgaaaaaatggtttttagcgctggggctgctcacgctggcagggacggcttcggccaaattgattaccgatgtcgcaggccgtcaggtcgaggtgccgcaggaggcaaaacgcatcattctgggtgagggccgtcagatgtatctgctggcggcatttgatactgatgccccatttaaacgggtgattggctggcgtgacgacttcccgaaagcggactgggacggctatcaggcttacgaaaaacgctatccggaaattaaaaaattaccgacctttggcggtgcgaaagatggcactttcaacgtcgagcaggcgttaaccctgaagcccgatctggtgctgatgaatctggaatctaaagccgccaccgatgaaggcaagctgattgaaaaactgcaggcagtaggcgtgccggtggtgtttatcgatttccgcgaagcgccgatggtgaatgctgagaaaagtatccgcatcatgggcgaaaactggtgaacaaaccggcgcgtgcccaggaaattatcaccttccgccagcagcagattgaccttgtcacctcgcgtctgaagaactttaccggctaccgcccgaaagtgatgattgaccgtgcaggcggctacagcgacgagtgctgcatgtcgtttggcaatgagaactttggtcagatggtcgagattgcgggcggtcgtaacatcgctaaagatctgatccctggcaccttcggcaccgttaacccggaacagattatcgccagccagccggatgtggtggtggtgaccggcgctaactggaagaattacaataccgtgggcaaatgggtcggcgtcggtccgggtgccaatgtcaccgaggctaccgcgcgtcttaaggggctgatgatgcgcgatgcttttaaaaccctgccggtggcgcacaacggcaatgtccacgccatctggcatcagttctacgacagcccttaccagtttgtggctatccaggcgctggcgaaatggctgcatcccgatctgtttgccgatctggatccggacgccaccttccgcacgttccacgagaagttcctgccgctgccttatcagccaggatactgggtcactttacccgctgataaaccctgacagaccggcgatgacagggacgtcatccgcctgatttgcaattcctcctgaataaaccctctgtttctcttcagatttactaatcttttacaggcgcggagtcagttgctctgagcagcgcgacgtctgacgcggtccgcattcacgttaaaaatggagagaaacatgcgcaataccctgggaagatcggcctttgccgtgacgctgtacgctctgctggagccggtgccgctgggcttttttgtcgcggcctggctgttcgatattctctatagccagacctttgtgctgttctggacggatgccgcaggctggctgattgcgctgggactgatactggcgattgtgccgcgactcatcgcgctggtttatctgttccgcggcagtgacagtgcggaaaagagtcatttctggctctggctggtggcgattgcgatcgctatcgtcaatgcgtttattcacagccgtgatgccgccgctgtcatcccgctgggcgtgacgctttcgacgctggtggtagcgctgctgctgctggcgaatgtgcaacttgcgttacgtcagcgtagcgcttaaggaggagcaaccatgaagataccgcataaaacgttgctcgcgcttaccctgacagcactgctggcaggctgtgatgatggtgcgcttgtcgatccgcaaaagcagatcggaccgaatcctgaactgccgcaggcacagaacttctttatgccgccgatgcaggtgccggaaggcacgccgtggaaagcgggcgaaatgccaaaagtggctgacgggctgaaaatcgaaaagatcgctgacaatctgcagcatccgcgtcaggtttatgtgctgccgaataacgatgtgctggtggcggaatccaacggcccggccaaacccaccacccggcctaaacagctgatcatgggcattgtgcagaaagcgtcaggtaagggcggcgctggcggcaatcggattacgctgctgcgcaacgtcaatggcaaatgggagcagcaccgctttattgagaatctgcactcgccgtttggtatgcagctgattggcaatacgctttacgtcgcgaatgctgacagcctggtgaagttcccctatcgcgaaggggagacggagatccgcaccgcgcctgaagaggtgacggaaactgccgggcgggccgattaaccaccactggaccaaagcgctgttggccagccccgatggcagcaagctctatgtgggtgtcggctccaacagtaacgtcaccgagaacggcattggcgcagagtatcgccgcgccgcagtgctggaagtggacgcggccagcggtgccagccggatctacgccagcggattgcgcaatccgaccggtttacagtgggaaccgcagagcggaaaactgtgggccatcgtcaacgagcgtgatgaaatcggctccgatctggtgcctgactacatgacctcagtgcaggacaaaggcttttacggctggccctacagctactttggtcagcatgtggatacccgtgccgaaccgcagcgtcccgatctggttgagaaagcgattaagcctgattatgccctgagttcgcatgtcgctccgctggggctgctgttctacggcgcagataacatgccgcaataccagggcggtgcgtttatcagtgaacatggcagctggaaccgtacgccgctgaatggctacaaagtggtgtgggtgaaatttgaaaacggcaagccggtgggtcagccgcagacggtggtctcgggcttcctgacggacgacgaaaagcaggtgcgtggattaccggtcggtctggccagcgacaaacagggcggtgtcctgattgctgacgatgcgggtaataccgtctggcgaatcagcgccgcgaagtaagcattgcgctgcttttttaagcagaaagcaggcataaaaaaaggatttggcatttcgccaaatcctttattttttgttcgctacccggctggtaaccgcgctacgaacgaggtgctcagcactctccacaaacaagattgtaaaatgtgcggctaaggatttcaagtttcgccaaaatgctgtatgtttatacaggtgttgagtgttgagcatcgcctcattgtcgactggccgctcccaggggcacggttttaaaatcccggcaggcatcaggtggtgctggcctgtggctttaaccatgagtgccgctcagctctctccacaaagatgtgcttaggcgcccggcgggtagagtcaaagccctggttgccgaacagcgcgctcctgtaaaaggagaaggaaagtgatggaactgactaagctgattctggatcttatccgggtcatcttgcagatcatcgttgcccttatgcaactgaccggtcacgcaggttaaccggaacttgaaacaaggcggagctaaccactccgccttttttctttgtcaattctctgtcatcggaggcgggtaaggtggtgcggcaaagcacgccgccggggcgctgtttatccagaccgggagttttatgtccattgccgccgttatgcccgcccgattagcgcacacctggattgatgagagtgtgaagatgcgcgaaaccactgtgggtcagcagtgtgagatcctggcgcacagcacgctggagtatagcgagctgggtgacttctcctatgtcggcgaacactgctgcctggccgatacgcaggtggggcgcttctgcgccattgctaatcaggtacgcattggcgcgccgaatcatcccatggaccgcgcctcccagcatcgctttacctactgcccggagtattaccaccccgacgcccgacgcgatcaggggttcttttccgcccgacgcgccgatcgggtgataatcggtcacgatgtgtggataggtcacggcgtaattgtgctgccaggcgtcaccattggtgatggtgcggtgctggccgcgggtgcagtcgtgacgaaaaacgtcgcgccctatagcgtcgtgggcggtgttccggccaggccactgcgggtgcgctttacaccggctatcgccgcccgtctccagcgcattgcctggtggaactggccgctggagaaactgctggcgaatctgcccgattttcagaacggtgacatcgaagcgttctgccagcggcacggtgcatagccaccccacggcgccgtcagccggtttgtacgccgaaatagcgcacaacccgctggccatagagcccgacggccagtccggcgacgatcagcagcagcgcggcgattttctgaggtgaaaccgtttcgccaaatatcgccactgaacccaggatgccgaacaccggtaccagcagcgacagtggcgcgaccgttgaaaccggatagtgtttcagcagccagttccacacccagtagcccagcagggtattgggatagacctgaaacagtatcgacaacaccgccttcacatccagctgagtgaagagtgcgtgatagcccgcgctgccattgaccagcccgtccagcaggaagagtggaatgggtgcaaaggtgctcgaccagaccagaaaagcaaaaacctgccgggtgcccgcttttttattgatgatattggcaatactccatgcgaccgcgcctgccagcaccagcagcatgccggaaaacgtcaccgaaccatcggtaatgaaaaaaatgctcagcagaccggcgcaggccagcgcacaaccggcgatctgatagcggctgagacgctctttaaatacccagccaccgagcagcagcgtgaagaaggcgctgaactgcagcagcagcgaggcgatgcccgccgacagtccggttttaatccccagattcaccagaccccacaggccaatcccgaagaccaggccatagctgatcaggtagcgccacggcacgtccggtttcttaataaagaacaacgctggcagggcgcagagcgtaaagcggatacctgccaggataaacgggtcgaccgcctgcaggccgagcttgataactgaaaagttaaccccccagatggcggtgatcatgacggcgagcagcagatgcgttaatttcatgagtgacgaactccggaccagcagagaaaggcagaggcactgaccgctgcaccggcatagcagacagcctgccatccccagtgcgtataaagctgagtggcggcgatggcccccagcgcactgcccagcgagtaaaagcacatataggcacccaccagacgacttgccgcctcgggtcgggcgcccacgatcaggctctgattaatcacatgtaccgtctggacggcgaaatcgagcaggatcaccccgaaaatcagcaacagtaacgaggtgtgaagcgcggctatcggcagccaggagaaggtcagcaacgccagggctaagccagtggcacgctgccccaggcccaggtcagcccatgcacctgctctggaggccgccagcgcaccggcaagtccggccaggccgaacatcccgatctgggtgtgtgacagtgacaggccggtaagtggcagtaccatcgaagaccagagcatactgaaggccgcaaaaatcagcagcgccaggatcccgcgtctgcgcagctgcggttccgtgaggaagagacggaaaacagacaataagaggtgaggataagatgtgcgccgcgtctgacctgctgtggcgggcagcactttcgccaggatgagcgagatcaggagtaacaggcaggcagccgtcagatagaccgcccgccagcccgccaggtcagcaatcatcccggaaacaaaccgcgccagcaggatgccgatcacgatgccgctggtcacgctgcccaccacctgtccgcgctgttctggtgatgccagcatggcggcccacgccaccatcagctgcgtgaccaccgccattaatcccaccagcagcattgcacagagcagcgtcatcaggtctggcgcaaccgcagcagtgattaacgccagcacggaaaacagcaactgggtaatcaccagttttttgcggttaacgcagtcgcccagcggcaccagaaagaccagcccgagggcgtagccgctctgcgtagccgttaccactgtgccaatggtgccggtggaaacctgcaggctggcggcgatcgattccagcagaggctgtgccgagtaaacattggcgaccgccagcgcagaggtgagtgagaacaaaaagatcatccgggacgagagcaccgggatcgcggctgggggcgaatcggcttcaggatcacgcatcttgccaatcgtacaggtcatgttgctttcctttctggtttttatttgaaactggattggcgatatctttaaccgggctggtttttttttgcaacttcttttcggagtggctaaactgccatcatgagacaggcagcgtgagagaagagcatggctaagcaggaatccctgagaaccagcgagtgtccggtcgccagaaccctggagtcgataggtgagcgctggtgcatgatgatcgtgcgtgaagcctttgatgacgtccgcagattcagtgacttccagcggaatttggggctggcgaaaaatatcctggcgtcacgcctgaagcagctggtggagataggggtgtttgagattgcgcctgcctccgacggcagcgcctacagcgaatatgtcctgaccgaaagaggccgttcgctgtttccggttgtggtcgcgatgcgccagtggggcgagcgttacctgtttgagaagggcgaaacccactccgtgctgctggataatgcggaaggaaagccgctgccacgcctggaggttatctcttcacaggggcaaaaactggaaccggccgactgtcatcgtcagcgggtggtggctgaagggtaaccgtcagggtattttctcctctgcacactctgagactgacaggcctgacatcgcacgcgttacccgatcatcgctgtcgcctgtagcggtgatcgaccaaaatacctcactcccgttttacgccccgccgtaagggcgttatccccggaaacaggtccccgcgcttcctcatcctttcctgccccgcatcatgacaggcctgtcgatatcatcacattttccaatgaccggttgccttgtaacttcccgatgcgcatgacaatatcgctgcttgtatagacatgtactctcaaccctggattgggcaaatcacgctttcagtcaacacgtctctcactgttccagcgaggaatctatgtcggtcaaatcatctgtatcagattattcaggctcagagaaacagggcctgtcagaaacccgctccattgattacatcccgttgggtgaacgtcatggtcatccctttaaccagtttacgctctggtttggtggcaatctgcaaatcacggctattgtcacgggtgcgctggccgtggtgctgggtggagacgtcgtgtggtctcttatcggcttactggtggggcagattctgggtgcagcgatcatgtctttgcatgcgatccagggcccgcgccagggtttaccgcagatgatcaccagccgtatgcagtttggcgtgtttggtgctgttattcctctggtgctggtgtgcattatgtatgtgggattttcagccagcgggacagtattagccgggcaggcgctggctaaacttatccatgtcagtcattcaaccgggatgatcctgttcagcaccctcatcgtgatcattgcggtgctgggctatcgcgtgattcatcaactgggcaagctggcgagcgtcattggcgttttagcctttgcttatctgtttatcacgctgtttctctgcgcatgacttatcagccgtgtggcagaatcagcactttaccccggcaaatttcctgctggcggtctccctgtcttcatcctggcaaattgccttctgtccttatgtctctgactattcacgctatctgccagctgatgtctctgcgaagaaactcttcagttcagtcttttttggcaccgtacttggcacgcaggcgtcaatgacgctgggggtgattgtcgctgccattgccggaagtgcgtttgcaggcaatgaggtcggttacatcgtgagcatgggtagcacggcgaccatggccatggtgatttatttcgccatttgctttggaaaaatcacgtttaccacgctgaacgcctacggcagttttatgtcactgaccaccattgtctctggcttccggcagaaaaccacgctgagtcggggtgggcgcattctgtttgtggtgcttatggttacgctggcctgcgtcattgctctgctcagtgaaccggcctttctgaaatccttcacccacttcctgctgtttctgctggctttctttgtgccgtggagcgcgatcagcctgaccgatttctatctgatcaccaggggcagggttgatgtcccggcactgtcgcagccggacgggcgctatggacgctggaacctggccggtattaccgtctattttctgggcgtgctggtgcaactgccgtttatcgataatccgctgcaccatggatcgctgacctggatttttgccggtaatgatgtctcgtggatcatcggctggtttgcgacggcactgttatggctgatcgccagccgctgggatcgtcggggcatccccgaacagtcaatttatcccgcccaataacaaggtcaggccgcctgagcggcagcctttcagggagtgtcactcttcgcgggtgtgtgatcacccgcgtgtcaggaaatcctcttttaagatcaggcggcagaaacgtccgctgcgccggtctgcgcctctgccaccagcggcttctccggttgcagcagtgtcattgccagcatactgccaaaggcgatcagcgcggtgacggtaaacatcgcgttgtagccgtaatattccgccagccagccgcagagcatcggagagataatcgctgccagattggctatcgccagcgtcatgccactgtaggtgcccaccgacgctttaggggtgacatcaatcaccaccgaccagtagacattgtttaccagtgcattcagcgcattgcccagggtcatcagtgcaataatccccgcagccgactgcacataggggatcgccataaagcagcaggcggtgccgcacagcgtgacggcggcaaacagattgcgcgccagacgcagattacggaagcgagccagcagggcatcggcaatgcgaccgcccagcagcaccgtgatacaggcgccgctccacgggatcatcgcgacgtaccacagtgagtgcaggtcgtaatggaaattatcctgcagatatttcggcatccaggtcaccagggtaaaggtgatgtagaggaatgagaagtagcccagcgcgttgcagaccagggtgcggctggtaaagaagcgccaccagggcagtggtacgctgtcgcccgcgctgcggcgctgaccggtctggataagctgacgtttctgcggcattggtatgtggacttttctccgggctgtcgctgaaggtgcgggcaaacagcgccatcgccagcagggagaaaacaccgagcaggataaacatcatgcgccagtcatgggtcagcagcagcaggcccaccgcaatcggggcggtcagcagcgcgccaacctgggtcgagagcaggccgatgcccagtgcaaagccgcgctcattatcgggtgcccagtgagcaatcgccttgttcatcagcgcataggccgggccttcggaaaaaccaaacatgatgcgaagggcagcaaagcccataatggcggatccgccaaacagcgccatgcccagttcccccgcccaggcggtggcgatctccagcagcgaccagagtacgcctgccagcagccagacttttttcgtgccgatacggtcggcaagaaagccgccacacagcgaaccaaacagatagccaaagccaaagtagcccagcacggctccgagctggactttgctgaagtgatactccgccgcaatggcgttagccgcaaacgacagggcgccgcgatcgatatagttgatcagggcgatcaggaacagcagtgaaaatatggtgtaacggtaacggctggttgtcatctcacttctcctgattaaatgtctcaggagagcagaagcaaaattgatgccggaaagggtatttatccggcaaaccgcggacaagcacagaattcgggcccctgagcccgctccgaagggggttaactgatcccgctaataattcgcctgcgcttcaatgcggtgcagccgctgcctgtcggtggtgaggctcaggcggcgttatgatggttggggctgacgtgtggcagcgggataaccacggcttccgtgactgcttctgtatcagccgtcccgacctggggtatttcgccaacgtgttgtaaaatctgctgctgataagtcgcatctgccaccgtagtctgttcactcagcagtacgcccgcctcattgacgttttttccgtccacttttattttgctggtggcactggccagcatccactcatattcaatatcgacgtggccgctatcaatacagcggataccgtgctgacttaaatcatatgccagcacggttgcggtcggccctaatgaaatcaagaccaggtcaaagttgacggcattctttaaaacggtatcaaacagacgatcatagacggaaaaggcattacggttcagcgtcgtaatacgtttcacttcgctggctccctccagtaaatcattgcctaatcccaggcgcgttccactgccttccacaattaatacccggcggccctgatagagctgtttaaacttatcaaatatcgtccgggataattgcttgcctttataatcgtgatagggacgggtcaccgaggtatttccatactggtactgtttattcagcaggccctcataatatttaaaataaaatgatttatggaagaaccagaacagggccgacccgccccgcatattacgggtggtacgaaaggcatccggcagacagatcagacagtttcgggttggctcctgaatcctgctgcagcaaggctttgagtcgtgcagagagattcgggtcaaatggctggaaaccgatatttttataccaggtcatttccagctcaccgtcgccataacgggccagagataattgtgggttacgtaataacagatcgacagtctcttctatcgacatgacggaataacgctttacccgtgcctgcgcggcaggatagcgaatggcagcattaagaaacttaaaagggaaacgaaacttgcgataaatagcgtgaagtgcggtcatagttaacctgcctggttcattgctgccagaaaaatcccgcctgctggccggataaacgaatataagagagctgatatatatcacagataaaataagcgtcatgctacggaatatctgaaatcgttttcatcggcaaaatccctttgttcattaatctatttcctgcgaattcttttacaggaaataataaaaaacgcgttcaggctggcacaattaaatcatttaaacatcagcgacaccgcaccagcgttgatgaagccgccaataataacagcagggcagtaacattcccgatttcagcaataagagttatttcagagcagagttaataaaccattatgattatttgactctgaaaaactttcgtcgggcacactttagctggcgttacagaagggcggcttgtctgttaattaatcgcctttgaacaaaaggtgcggtcgttagcagcctatggttaattttttgtgatggatatcccgtaatcagcccttcagaaagtaaaaaaagcggcctgaccgcattaacaggtgacatttataataaatatttctaatgattaacgcttatacacgtttttacatatttcgtgcgtaagttaaaatctcgttgaatttatgtttccagcttaacctttcaattgccgctaatgacccgaggatggatcatgatcaataaaataaccagtataatcatggtgatatttgctatcgccctgatttacatgggaggacaactcctgcttgcaggaggcagcgcgtttctatgcgctgatgggcgtgggcgttctgctcagcgcgattctgctgttgatgaacaaacgcagtgcgctgacgctttatgcgctgctgatgtggatcactctgttctggactatctgggaagtgggcttcgacaaatggcagtggattccgcgcggcgacctgtttggcgtgctgggtctctggctggcgctgccgtgggtggtgcgtccgctctatcaggggcagcgtcgtttccatcctttcctcgggggttccgtcgtcctgatggtgctgctggtcatcggtctctgcttctacgatccgctgccgcagcagggcgccattaatacgccgcgcaacgcctctgcgaccggcggtgccgctgaagagtggagcgcatatggcggaaccacagatggccagcgcttctcggcgctgaagcagatcactaaagataacgtgaaagatcttgaagtggcctggacctatcacaccggcgacctgcgtcagggtgatgatgcgaccgaatacacctttgaagcgacaccgctgaaagccaacggcatgctctacttctgtacgccgcacaacgaagtccatgctcttgacccggaaaccggtgcggtgaagtggaaaacgacgccggataaaaaccgctcttatctgcagcagcaccagacctgtcgtggcgtgagctacttcgatgccggtcagcaggcgcagacgggcgcatcgccggccatctgccgcaagcgtatcttcaatgccaccaccgatgcccgcctgctggcgctggatgccgataccggtaaagcctgtgctgactttggtgacaacggtgtggtgaatctgcgcgccaacatgggcgaggtgcgtccgcatgcgctgatgcagactgccgcgccactggtggcgggcaacctggtgattgtcggcggttcggtgatggataacggcttcaacagcggtaacccatcaggtgtgatccgtgcctatgatgccgtcagcggtcgtctggtgtggaacttcgatccggctaacccggataacaccgcaccggtcgctgaaggggcaacctatccgcaggataccccggtcgcctgggccaccctgagcgccgatctgaaaaacggcctggtctatgtgccgtttggtaacgcctcgccggatgaagtgggacttgaacgcgatcccgccagcaacactgaaaaattccgtgatgcgctggtggcactggatctgaaaaccggtgcgttcaaatggcgctatcagagttcaaaccatgacctctgggatcgtgataacccgtcacagccgtcgctggtggacatcaactatcagggcaaaccgcaaccggcggtgatcctgccgaccaaaaccggcaacctgtttgtgctgaaccgcctgaccggcgaaccggtttatccggtagagcaggttaaggtctccacggatggcattaaaggcgagcagtatgcggcgacccagccagtctccagcctgaacttcattccgcagccgctgactgagaagtcaatgtggggcattacgccgtttgaccagatggcctgccgcaccacgttccgtgagctgcgctatgacggtaacccgtggacgccaccaacggagaaaggctcgctgatcttcccgggcaacatcggggtgtttaactggggttcagtagcggttgatccacagcgtcagatgctgattgcggcaccggtgcgcctggcttacaaatacaacctcatcagacgcacgccggaaaccgaaacccagcgtaccttcaccaaagatggtacgccgtactggaatgagaacttccacggtgactacgctatccacatccagcagatggcgtcgggtctgggtattccctgcatcgcgccaccgtggggacggatggtcggtgtggatctgaccaccggcaaaaccgaatggctgcgtcgcgtcggcaccaccaaaaacctcaagaccagcttcctgcctggccgcttcccgctcggtttcccgatgggtatggtggcgcacggcggaccgctgctgacggcgggtgatctggtgttccacggcgcaacggcagataacttcttccgtgcttacgacagcaccaccggcgaactgctgtggcagactgaactgagcgcgggtgcgcaggccacgccatccacctttatgggcaaagatggcaagcagtatgtggtaattgccgcgggcggccacggctcgctcggcaccacggcgggcgacagcgttgtcgctttccgcctgaagtgattttttaaaaaaccgacccgctgagcgccgccctggcgctcagcttttttcacacctctacctgccagatctcacacccggcttagcgcgacaacctgttgtatttcatctcaattctttcatctccgcattcacatcatctgataacgcatcgaaaccatttcgtgacagcgctcccgctttaacgatttctcctgcctgacagacttgcgcattaagccgcgaggcgtagattaatatatgacttcacaattaatcgtgaatacgaaaagtacttcacaatacgcactctgaaggattgatgctcatgtcggaactgaaatttgctacccgtcttaactctttcgcctcgggggcgcacctctactggcccgatcagcagggcaagccctctgtgctgcagatggttgcccgtgcaggcaaggtcaaaggcttaacgcatctcgacctcaactttccgcaacatctcaccagcgatatccccacactgcgccaggcgatcagtgatgcgggtctggccgttaacggtatgcagatgcgctgggacgcgccacagttcaaaatcggcgcgtttacgcatcccgacgcgaaagtgcgtcgcgaagcgattgagctgaccaaacggggcattgacgcgggtcgggaatttggttcacggctgatgacgctgtggatggggcaggacggtttcgattactgcttccaggcggactataagaagatctgggaggatgcggtcagcgccgtgcgtgaagtggcggagtatgcaccggacgttgacgtcagcatcgaatataaacccaatgagccacgtgcctacagcatctttcccaacgccaccacctgtctgctggccgtggaagaggcgggctgcgccaacctggggatcacactggattttgctcatgtactgtttgccaatgagatcccggcttacgccgccgctatggtggcgcgccgatcacggctgctggggctggaccttaacgacggctggggcaagcgtgatgacggcctgatggtcggctcagtcaaccctcgcgccacgctggagtttctctggcagatgcagcgtgatggctaccgcggtgcctactacttcgataccttcccggatgccagcggtcttgacccgatccgtgaggcagaaagcaatattgcgaccgtgacccgtctgctgaggctgtgtgaccagctgcacgacaacgcggcgttactggcggccattgagcgtcaggatgcggtggcctctcagcagatcgtcaatgacatcatgctggcgcgctgacagccgattaatcataaaaacattacacctctacccaacaccctgagaataaaaaatgaaaaaacgcctgcttgctcttatcgcctcctcactgctctgcagcacggtttatgcggcagaactggcaccgctgcaatccgatactgaaccggatcgcaccgactggacccagctcgacaccaaatatggcgcactgccaaaagtcgataagtcgctgaagattggcggggtatcgaaaaccctgaccaatgagtactggcgctcactcggccagggctaccagaacgcggcgaaaaagtatggtttcactgtcgcttatcaggcggcggccaatgaagacgatcagcttggtcagctctccattgcggaaaccctgatctcgcagggctttaacggcctgctggtttcgccgcagaccgatatcaacctggagcctgcactggagagtgccaacagtaaaaatatcccggtggtgaacgttaatgatgcggtgatgccgaatgcgcgctactacgtcggcaacgtccagaaggacaatggcgtgcgggtggcgaaatggtttattcagcaccatccgcagggcggcaacgtggcggtgattgaagggcagccaggggtttatgccgccgggcagcgtacccgtggctttaaagagacgctggacagcgccgggaagttcaccatcgtggccagcgtgcccgctaactggagtcgcgagcaggcctttaacgccgcatcgaccattctgcagcagcatcctgatttgatcggcttctacgccaacaacgacaccatggcgctgggcgtggtggaggcggtacgcgcgcagaacaaagcatcacaggtggccatctttggcactgacggtatttccgatgcctacgcctcgattaagcgcggcgagctgaccggcacggtcgacagtttcccggtgctgaccggtgaagtggcgatggacgtcattatccgtctgatcaacggacagaaactgtcgcgcgttgtctcgacacctcaggcgctgatcacaaaagagaatgttgaggcgttctcaaccaaagacaacaaccggttgcgtcagctgctggctcaacaataggtcagcgggagcgggtatggaacagtttcgcttaatgatgcgtggcatcagcaaaagttacggtaacgccgccgcgctgcaggatgtcgatttctcagtgcggcccggcgaggtgcacgcgctgattggggaaaatggcgcgggtaagtcgacgctgctgaatatcctctccggcgttcgcggcgcggacagcggagagatcagcgtcaatggaaaccgggtgcagatccgcagtccgctcagcgcccgtcaggccgggatcgcgatgatccaccaggagttacagcatgtgcctgagctttccgtggcgcagaacatgtttctgggtcgcccgctgacccgcgccgggggctggtgggtggataaaaaggcccagctggcgcgggccaccctgattctgaagacgctggatcccactatcgatcccgatacgccgatcaggaacctcaaggtatcgcagcagcagatcgttgagattgcccgggcgctgctggatgacgccaaaatcatcgccatggatgagccgacctccagcctgacgccacgcgaatttgaccggctggcagagctgattggcgatctgaagtcgaccggcgtctcgctgatctatgtttcgcacaagatgaatgagattttccgggtctgcgaccgcgccaccattatgcgtgacggaaagcaggtgggggtggtcaacatcagtgatgaggatgaggagagcatcgtcgccaaaatggttggacggaagatcgacaagcttgaccatcaggcgtttgtcaccgatcgcgaagtgctgcgggtagaggatctgacgcgtggcaatgaggtggtggcggcaaacttcagcgtttcgtgcgggcgaagtgctgggcattgccgggctggtcggcgcggggcgcaccgaactgctgaagctgattgccggtatcgacaggcgcacccgtggcacggtgagcgtcaacggtgccgcggtgaagaaccacaacgtgcgtgcggcgatcaaggcgggcattggcctggtaccagaagaccgcaaaaaagagggcattatcaaagagcgggcggtgaagatgaatatggcgctgccgtcgatgcaccgcttcacgtcggcggggctgatgaaccaggccaggctggaccgcgaggcgctgaaggtcatgggcgacctgaaactgcgcccgctcgacattgagaaaaccatcggcacgctgagcggcggcaatcagcaaaaagtgatcatcggccgctgggttgcggcggatgccaatgtgtttctgtttgatgaaccgacgcgcggtatcgatattggtgccaagtctgaaatctatcacctgattgaaaaactggcccaggcgggcaaagccattgtggtggtgtcgtcagaaatgaccgagatcatgcgcatctccgatcgggtgctggtgatgcgcgagggccggataaccaaagagttaaccggcagcgcgatcaccgaagagaacattgcccgttatgccatcaaagatatcgaccagaccgcctgaccgcttacctgacactatttaaggttataactatgacaactcagacatctaccgggccgggtacccgacctgcgctgcggcttaaatttaatctgcgtgatgccggtaccttaattggcttactgattatcgtggtgacattttcgtttctgtcgccggtctttttcacgctgcctaatctgctgaatattctgcagcagtcctcaatcaacgccctgattgcactgggcatgacgctggtgattatctccggcgggattgacctctcggtcggtcccacggcggcgctctctgcggtgctgggtgcaaccctgatggcatcgggcgtgccggtgccgctggcgatccttgcgacgctgggtgtgggcgcgatgtgcgggctgttcagcggcacgctgatcgcctatgccgggctgcagccgtttattgtcacgctgggcggcctgtcgctgttccgggccattgcgctgatctacaccggcggcaatcccatctttggtattccgctggaatttcgcagcctgatcaacagtacgcttttcggtatccccacgccgattgtgattgtggcagtgattgcactgctgctgtggacggtgatgaataagaccccgctgggggaatatattctggcgattggcggcaatgaagaggcggcgcgggtcgcgggtgtgccggttaagcgcaccaaggtcacggtctatatcttctccggcctgcttgcctcactggcctcgctgattctgattggtcgtctgggggctgccgaaccgaccatcggcaacctgtgggaactggatgcgattgcggcggcggctattggcggtgcgtcgttaatgggcggcaagggcagtatcttcgggacgctgatcggcgtggttatcctcggtgcattacgtaatggcttgaccttactgaacattcaggccttttaccaattgctcgctaccggccttattattatcatagcgatgttgattgaccgggcgacccgaggcaagtaatgaagcaagatccgcgagccattggcgctcagattcgtatgcgtttgccccagctgacgccgttagaaacgtcgggtagctgaggcgataattgcccgaaccgacattaccgagcaatcctcattaaaggagattgcgcgggagaataatgtctctgaagcgatgatcgttaagattaccaaaaaacttaacttcaccggcttcaggcatttcagaagtggcctgatctattacaaccagtctgaagtggcagggctgcatgcggaaattgagccggatgattcgtcggagcagttgctggccaaagttttcagaacctctatccaggcgattgaagagaccttatcgattctggatgtttctgaattcaatcgtgcggcggacattatctttaaagcgcgtcatatcgatctttacgccgtgggcggttctgccgccgtggcgcgggacctgtcacacaagatgctgaagattggcattaagtcgacagcctatgacgacgcccacatcatgctgatgtcagccgccgtgttatctgatgacgatgtggttatcgccatcagccattcgggtgctacgcgcgcggtgaatgatccggtcagactggcggggaggaatggcgcgaaagttatcgccattaccaactacgccgaatccccgatcgcgaagagtgcgcatgtggtcctcaattcaacctctcagggatcgcatctgctgggtgaaaacgccgcgtcacgcatcgcccagctcaatattctggatgcgctgtttgtcgctatcgccaagaaagatctgaagcgggcggagaagaacctgatgaaaacccagcatgcggttcaggatctgcgggaattctagctatgagcaaaattgcagtcaccggcagtcttcactacgacattatgctggatgcacaccatcgcccggaaaaaggcgaaacggtgatgggcagcgcctgtcactataagtttggtggcaaggggggtaatcaggctgtcgcagcggcacgcgcgggtgccgcagtgcgcttcgccggttcagtggggcgcgatcagcaggggcaattcctgctggatcatctgcagcaggccggggtcgattgcaccgccgtcagcatcattgatgcgcttccctccgggatgagcgtggcgattaccgatgccgaaggagattacggtgcggtggtggtctccaatgctaatcagcagatcccgctggagacctttgagcagcccggcttctggcaggcggtgtcgctgctggtgctgcaaaatgaagtcccggaagcggtgaacctctgtgcggcccaggcggcacagcagcgggggattacggtctgcgtcaacgccgcgcccgcccggccgttgtcagccgcgtttgaaaactgtattgatctgctggtggtgaacgccattgaagcgcgcgatatgtgcgggattagcgtgcaggatctgacgtcggcgcgctcagcggcggaatcgctggccagccggtttgccagagtggtggttaccgctggtgaacatggtgtggcttacagcgaggcgggagagacgcaaacactggcggcgcagaaggtgacactggtgagcacccacggtgccggggattgttttgtcggcgtgttgtgtcagagcctgagtagcggggtaacgctggcagaagcggtgagtgcggcaaatcgtgcagcagccgagcacgtttcccggcagccgcactgattaatggcgtgccacgtcagtgacgcggcacgctaacgtcgtcaggcaccgacgttcaccacggttttaccgaagtttttgccattcagcatatcgataaacgcctgtggcgcgttctctaatccttcaatcatgtgctcgcgatagtggatttttttgttctccaccagcggacgcatcgcctccaggaactcagggtaacggtcaccataatcctggaagatgataaagccctgcatacggatacggcgtttcagaatgcccgccatgatcagagaggttctgtccgggccttgcggcagctcacgctggctgtaagccgagaccagaccacagaccggcacgcgcgcagcggtgttcagcagcgggaacacggcatcaaacactttgccaccgacgttttcgaagtagatatcgatgccatccgggcaggcatttttcagctgctcttcaaagtcggcgctgtggtgatcgaggcaggcatcaaagcccagcgtatcgaccgcgtaacggcatttctcttcaccgcccgccacaccaacgacacggcagcctttctgtttacccagctggccgaccgttgcgcccaccggaccggttgcggcggcaacgaccagggtttcacccgcttttggctgaccaatatccatcagacccatataggcggtaaagcctggcataccgagaatacccagcgcccatgagggatggggcagatcgttgcccagcttcgcaatctctttgccatcggagacggcatattcctgccagccgctctgcgccagcacccagtcacctgtcttaaagtcgctgtttttcgagtcggcgacctgacagacggtgccgcccaccatcggctgatccagctctgccggcgcggcgtaggatttaccctcgtccatccgcccacgcatgtaggggtcaagcgagagatagatggttttcagcagtacttcaccctctttgatttccgggacgggctgcgccacatggcggaaattctctttggtcggctcaccgtgagggcgtgaagccagtaaccaggcatggttctgggttgcttgttcagtcatattgtcatccttttatagccgggcaatgctcagggcatcaccatatgaataccgggaaagtgtagatgaccacggcgggaatgcgtttagcgctgtgagcggtaagctgatttaccgataacagggcataaggtgctaaccacggggacacagcggatgcaggaccattcgcgtcacggattcagtctgacggctgttcacatccgcttgcaaaaaacgggcaggcgggtcatcagcagtgcggcatgccacgcatccaggtcagagggaggcgactatcattacgcttcaccacaagacttacagggccagggcatattttgcgattgccgaaacagagaagctaaaacgcttctagaccgggttttacagcatccgccccgtgatgtaatgtatgaagtgaataccgccataggcgaagaaggaagaggttatgtactcaaaacacgatatttcaaccctgaaaaaaatgacagttgcagagcgtaaagcggaagcaatgcgtcagctcaaagaatcttttgatcttgcggagcgctcaggcacagtgcgttcacgcgaagcaaaggctggttgactgtcagcttcctccaaaacccgctaaggcgggtttttttatgccttcaatttatgggcatgggaagttgctgcgcatccggcgtcacgggaagctctgaagattgtgataaatatcagtgaactctacagggagagaaccatgattatccagcatctgcgtattgcccgaccggtgacagacctgacgcaaagcagtcagaactattgtgacgggctggggttgcaagaaatcggtgagtttactgatcatcaggggttcagtggcgtgatgctgggcgctgaagggctggcctggcatctcgaattcacgctctgtcacacgcatcccgtccggccatcgccaacagatgaggacctgctggtgctctacattccgcaacggcctgactggctgggccgatgtgcctgtatggatgaggcaggatttatgcggttgaattcatttaatccctattgggaccaacggggcgtgacatttatcgacagggatggttatcgtgttgttatccagcatgcagcctggcaatccgcaatctgacctgtaccggagttcaccctgaacattctttgctttcacacagcagccagtaatatcgcgatatttgatgatgccgcccgcgcactggcgcgtgacaatccgccgctgaatcatctggtgatgcctgcgctgctggcagaagcggaatgcagcggcgggatgacgactgcgttacgccgccgtattgcccaaatgattgaaacgctgctgccgcagttcgatgcggtactgatcacctgctcgacgctgggccccgttgccggtgatttcagcgcgcaggatcgggttatacgcaccgacgaaatgctagcggaggcgctgcagcgtcaggcagggcgcacagtcgcgctctgtgcggcagaatcaacgctggcggcgacgcgggcacttttctgtcagcccggcagccaggtggaggtcgcgctggtggagggagcgtggacggcgtttaaagcgggggagacaacacgctattttgcaatgattgcagcagcagcagagcaggcttatcagcagggagccgttgcggtggccctggcgcaaagctcaatgacgcccgtagcacagcagtttcctgtcaaacagcgaccattgaccggcccgtatcttgcgctgcaggcctgctacgaactcagatgaccgtcacaccctgctggctcagtgcctgtcgcagcgcctcgtccggctgcgtttccacgaccagcgtgctggccagcgacaggtcgccaatggcaaatgccgaggcggagttcagcttttccgctgacgccagcaccacggtttccgctgcgcgtcctgccagcgcacgcttgaccgtcgcctcttcgaaattaccggtggtcaggcccgccgccggatgcacgccggtgacgcccataaaaaagagatcggcattgatgcggttgatcgactccagcatcgctgcgcccaccgtcaccactgaatgtttatagagctgcccgccaatcagtatgatctccacgagtggatgatcggctaacgccagcgccacgctgggactgtgcgtaaccgcggtaaagctcagcgtggcgggtaaccgtcgcaccagtttccgcgctggtggtcccgccatcaatcagtacgatctgtcccggctggatcagtgaaacggctttttgcgcaataacctgtttggaagcagtctgcacgcttttgcgcgtttcaaaggtggccagcgcagcggaaaccggcagcgcgccgccatgtacccgctgcaacaatccttcagccgccagttcacgcaggtcgcggcggatagagtcttcagagaggccaaagcgctggctgagatcgcgcgactgcacctgtttttcctgggcgagcagggcgagaatcgtctgttttcgctggctggatagcatgactggcctttgcatgttttttcttgaagttgcacgattgtgcatgatagcgtgatggctgtctactatcctggagagcatcatgcagcagaaccatccccgcgtgcgcatcatcaatgagcagttgctgtcagacaactggtataccctgaagaaatatacgttctcgctgctgcgccgtgacggtcgctggcaggagcagagccgtgaagcctatgaccgcggtaatggcgcagtgatcctgctctacaaccgtgacaaacgtacggtggtactgacccgtcagtttcgctttccgattttcctgaacgggcatgatggctttctgattgaagcagccgccggtctgctggataacgcctcgccggaagcgcgtattgttgccgaagccgaagaggaaaccggttttcgtgtcagccatgtgcagaaggtgtttgaagcctttatgagccccggttcggttactgaaaaactctacttttttattgccgagtatggcgatcagcagcgtagcggtgaaggcggcggaatagcggaagagggtgaggatattgaggtgcttgagctcggttttgaccaggcgttaaaggcgattgaccagggtgagattgtggatgccaagaccatcatgctgctgcagcatctgcggctgaaaggcattttataagagaaacgggcagaccgccgttaatacggtctgcccgttaaagcttactgatcctgcgtcaggatgccttttacatcgtgcggttcagaacgcagatactgtggcggaacctggactttaccatccagcgcagcggctgcgtgccacggccagcgcggatcgtaaagaataccgcgcgccagcgccaccaggtcagcttcaccctgttgcagcagatcttctgcctgctgcggctcagtaattaagccgaccgcaatcaccggaatcgacacctgctcacgaatatcgcgggcgaacggcacctgatagttgggtccgacgctgattttctggtcttctgacaaaccaccacttgagacatgaatataagcactgttcagcgcttccagctcacgcgagaaggcgattgactgattgatctcccagccgccttcaacccagtcagtggcagaaatgcgcacgcctaccggcacggaagcgggtacggcatcgcgaacggctttgaagacttccagtgggaagcgcatacggttttccagcgagccgccatattcatcactgcgctgattcgacagcggcgacaggaactgatgcagcaggtagccgtgtgcggcatgcacttcgatgagctgaattcccagacgcaccgcacgcagggcgctgtcgacaaaggcctgttttaccctcgccagatcgtcagtgttcatggcaaccggtttcacttcatccgcgctgtagctcagtgcggacggagccacggtttgccagccgccggcttcaggcgcaatctgcttaccgccttcccagggtacggcacacgacgctttgcgtcccgcatggcccagctgaataccaaccggaatagaggagtagcggcggacatcttccagaaccgttttcagcgcagcttcattatcatcattccacaaaccgagatcgcctggggagatgcgaccaatatcctctacggcggtggcttcaatgatcatcagacctgcgccggaaaaggccaactggccaagatggatacggtgccaggcggtcgcattgcccgcctcagcggagtactggcacatcggcgcaatcacaatgcggttatccagcgtaagttcgcccagcgagacagtggaaaaaagttggctcatgttatctccatggtttttatgactgacgtgacaggcaataactatagcgggggatttgccaggcgggtgtttcttcaacgtgacattttatgacggcgtgccggattcaggttaaagatcaacgcagccggatgtctcaggcaggcattgatacgttaacggttcagcctggcgcgctttgctgctcacgcccggcgaaccgggattctacgtaacggataatgacaatcaccagggtctgatattcagctacagggtgactctcagacctgtgccattccgccatcaacaaacagttctgccgcattgataaagctggcggcatccgaggccagaaacgcaacggtgcgggcaacctcctgcggctcacccaggcggccaagcggtatctgtgttgccagcgcatcaaacaagccctgacgctgatcttcactgaccagatcacccagcccaggcgtacggacagggccggggctcacgacattgacccggattccgcgatctttcagatccagcgcccacgaacgggcaaaattgcgcactgccgctttactggcgctgtagacgctaaaagccgcagtaccctgcgctccggcagtcgatccggtcagaattaccgatgcgccatcaaccagcagaggcagggctttctgtacggtaaacagcacgccgcgtacgttagtgccaaagatacggtcaaaatgctcttcagtaatcgcccccagcggcagcatgtcgccgcccccggcgttggcaaagagaatatcgaggcgtcccgcctgcgctgcaattctcgagtaaacctcatcgagatcgtgcagttgtgaggcgtctgcgcggatgccgctgacggttccgccgatttcagcgacggcggcatccagctccgcctgacgacggccggttataaaaacctgtgcgccctgtgccgccagctcccgggcggtagccaggccaattccgcttgttccgcccgtaaccagtgcaatttttcctgcgagtgatgcgttcataagttcttctccggatagtctcatagacagattggttattcccggtcagcggggctgccggactgattgctactgtaagagaggaggattggcggataaatccgctaaaatgaaaatgactatccacatgggtggataatagggggatagaatggatcagctgctggcgataaaagccttttcacgggtggtggaaagcggcagttttacccgggcggcggactcgctgaatatgccgaaggcgacgctgagtaagctggttcaggagctggaggcgcatctttccgtcaggctactgcagcgcaccacccggcgcgtgaccgtcaccgcagaagggcgtgaatactatgagaaagcgctgcgcatcctgcacgatctcgaggatattgatgcctgtttcaattcactgcgcagtaagccgcgtgggcagttacgcatcgatgtcggcggatctaccgccagggacgttctgattccgctgctgcctgatttctttgcccgctatcctgatattacgctggatctgggcgtatccgatcgcccggtcaatcttattagcgacaacgttgattgtgtgatccgcggcggtccgctggtcgattcctcactgattgcccgcctgatagggcacgctacgctcattacctgcgcgacacccgcctaccttaaagcgtttggtgtgcccgcctatcctgatgaactgcgcaacggacaccggctggtgagttatctctcgccgcaaaccggcaagccatttccgcttcggttcgaacgtcagggagagaaaattgagatcaccagtgcgcatcgcattggcgtcaatgaaagcaacgcgcatctggccgcgggactggcagggcttgggatcattcagacatttaattattcgctgtcgtcaattctgcggcagggagaaatggttgagatcctgcacgactggcatccggcgggttatccgtttcatctggtttatccgcaaaaccggcacgtaacgcaacggctacgggtatttatcgactggctggtggagtgctttccggcgcgggtagcgggagaggggaaatccggcacctgagtgccggatcgggatcagttgccgcgataggtagagtaaccaaacgggctcagcagcaacgggatatggtagtgctcaccgctggcttccatgttgaactcaaccgggatctccgggaagaaggttttctggttgttctttttatagaagtcaccggttttaaacaccacgcggtagctacccgcactggctgttttgtcctgcgggaacagggcgctgatgcgaccattgttatcggtgacgcctgacgccagtttcacccagttatcctgctgcttctgatccagttcaacttcgatgcctgccgttggctggccagtttgaaggttaagaacgtgcacgctcagtgggtttttagcggtagcaggctgagctgcaatagcggatgcgccagaggtcatcagtaatgttgcgatcaaggcatatgaagttttcatcaatgtttcctttattgattgtctgaagtcgggtgacagtgcagagagagtaatgcgcctgagggcaaagagatatttagccgcaggaaatgtgaaatttctgagaaagaaggaaaatgtctttagttacatcatacagtgtttctgcttaatcatagtccagcacctgtgcagtcatagctaatcagggaacagaggcaccagatgaaatcctctctgaattcagcaataaaacaaagcctggcccctggcgggcaacgtagcgatagcaatcctctgatctatccacagaatcgtctcgtcagttatcaactgccgtatatgtgtcgactcgcgggcgggctgttttctggcgcgaatggcgtgagaaagtgaatccggcacacctgatcagcgagccggattcgtaaaaaagtctgaccgtgacagggtgtgtaaccgaacggactcagcagcggcagcgggatagggtagcgagcaccgttggcgtccatgctgaacttaaccagaaaaaaactctatgcttttaactttttcaggtgctcaggcgtcgtgcttaattgctgaaaataggtacaaatagtcagagagggtaaaagcatgatataaatagtgtgctatttagtagtttacaatccaggttcgccgtgtcattgtcctgccaaccagatagcacactacttaatagcaagttaattggaaccctgtgatgaaaatgaaactgatcgccagtgcattattgttagccagccagatgagtaccgcgtttgctgcacccactgaaaacagtccgcaaccgaccgcagacgtggccgctttcctgaaggcgctcaacagcggtagtggtaaaccgattgagcaactctccgtcaaagatgcccgagcggtgttgacgggggcgcagaagggcgcagaactgccgccggcacagatttcacagaagatcatcaccgtacagggcaagcctctgacgctgaccatcgttaagcccgagcatgccagcagcaccttgccggtgtttatgttcttccacggcggtggctgggtgctgggcgattttccgacccatgagcgactggtacgtgacatggtgaatgcatccggcgctgctgcggtatttgtcaattatcaaccatcgccagaagcccatttcccggtggcaattactcaggcttatgacgccactaaatgggtcgccgaacatggcgctgaaattggcgttgacggaaaacgtctggcgctggttggtaatagcgttggcggtaacatggtggcggcggttgccttgcaggcgaagcagtttaaaacgccggccatccgttatgatgtgatgctgtggccggttaccgatgcgcgtttcgacaccgcgtcgtatgatcaatttgctgacggacatttcctgacgaagaacatgatgaagtggttctgggataactataccgtttcggaaaaagatcgtaataacatcctggcatcaccgttgcgtgccaccactgaacagctgaaggggctgccgccaacattgattcagactgcagagctggatgtgttacgtgatgaaggtgaagcgttcggtcgtaagctggatgcagcaggcgtgccggttaccgtgacgcgttacaatggcatgattcatgattacggtttgctgaacgcgttaagtcaggaacccacggtcagaacagctattaatcaggcgggtgaagagttgcgttcgcatctcaaataactgaccggtcatgaaaccaaccccggaccgaatcgtcgtccggggttcttatcgggcagtaagtttgaaggaatcagttctaagacgcagggcagtgcgattgccggaacaccaggaaagaacggagcagtatccagccgataagtgcgctgttaatatctaatttaacataatatacattatgcgcatattgattatgatcgggagcgtgatgctctattgtatggtctgctcaccattttgggctgatcctgactgttttactctttacagcaaaatctgtcagaaacgatcacaatgtctgcctgaccttgttactgtcgcttattctgttccgaaactgaaataatgtgatgctacgttattcagcatggctttccctgcgggacatcttcttcagcgactctacacgctatcctctcatcaacaaacctgatatcggagatttgcagccggacgatgcaatgacgacttcgccctttgcggctggctggatgcactgctgcgcattctgaccgtttctctgctcaggtgctttgcacaacttaagcagtgacgtcgctacgtgaaaattagcgcattcatcagggctgtcggccacaaaaatgctgtagaggcgtctatgcatcaccgctttatgttcatcctcgttgtctgccgtgcgtaccactaaattgtcgtaaacgcgtccacgtgtaactacgctttcttcactctgtttccttgccaggttaatcctgtaatgagcaagaaagcctgagtcagctttctgctggctgtctggtcagccggactcataccggctattcgcattgcgattgcaaggcagtcaacgcagcgcagtgatgcttttgccctgagcattgaaaataagagtcagtaacatccggtcgttttcagcactatcagcgacacgcaaaatgaggtgtaacgtccctgctctgtcctgtcatccaataactatcttgtataatctgacaaaaaagcagaacgtaaatttcgcacagcaagaatgattcttcgtatacaaaatctgaatgataacgcccgggaaagaaataaatatagatctcttttcttttaatgacactgaccaaaatagtgatgtttccatgcactaaataactgatttagatcaatatttatagcaagtgcgtcaattaacatctttgttaccaggagtattcttaataaaatgggatgtgaactataaatatcgtcgctaatttttttataaaagccatttaaaatgcagatcgtttcaatgaagtaagggagaaagcaataatagagtcagtaaaaagtcatttatcaatgccatcttagtggccgctgtatacaaaattgatcactgaacaaaattcgctcatatttagcattgagtgcggaatttttattgatcaaagtggcgttatttgcgaaatattcctaacggacgtaaaaaaatcctggtctctcagcactgctgagggcgtcgtcgccctttttgtcccgaattttcaacaaatattactcccgcccgtggaggtgaccccttaagaaaaatccgaatgaagaaaatagcggataattttcatcgccttgaaacgcggagatttttatcgataaaataatcacaactctcgcaacaacgccaaaatattatgataaagataaccagagaggaaattcgctgcgccagttgtaaatatggctgtgatctcacccatcgcgcatcagacatttataacagatgtccgttgcaaaaaattaccacctggcctggagggaatcattttttctcttcatccatactcagcatggtcgctggaaaatatgagagcctcttttgcagaggatgtgtattcgttgacttctccagggaaaatgtcaggtattttaccaatagcaactggattgagtatttgaaacatacgggattaatgctgattatcgtcagtgatcgccatatggagccgcttgcggcgtactggcaaaaagaggacctgcgtatacaaactgtgatttatgccgatttttccctggaggagataaacagacaaatccagggctgttatttcggtttaaaaggcgaggtcaggaaaaaagtgaatgcacttaaacaggatgaagttcggttccttgatctggcgatgaacggactgtcactaccgattattgccagagaaatgggagttgaagtcaagcgtgtttataacatcaaagatgccattcgccggaaaatgggcatcagcctcaatcagttattttccgcataattatgataaaggagtattaaatgaacaccaaattcagaacgcttaatcttgctgtgttaatcagtgccgggctggtgtcagccagcgtgtttgcagcttcagataacaccatcaactttcagggagaagtgaccactgaaacctgttctgtttccgtaaatggcaacaatgcgtcccctgtcgtgctgctgccaacggtcagtactacggaccttgctgcctctggtgcaactgcgggtgataccaccttcaccgtgggcgttagcggctgcgccggggacagtacctcggccaccaaaatctcgacggtgtttgtggggaataacgttagcgctgccggtaatttatctaacaccggaaccgcaaaaaatgttgaggtacaaatcctcgatccgaaagatgcggtggttaatctgaccagtggttataccggcagcggtgatctgacactgcagaccggtgaaacttctggctctgccacctactctgcccgttattacgcatccggcacgccaacggcgggtaccgttaccgcatcactgcaatatgccgtgacttaccagtaatatttttcgtgcgtatctggatagccagatacgcacaccacgcttgagatatccgacatgtattcgcgcattatgctgttcccattaaaaatggtaatactgatttttttgatgacgtttatttcggataacgtccaggcaagcgtcactattcttggcagccgaattatttatccgggtaatgctctctccgtcgatgttcagttaaagaacaacgataatattccttatgtcattcaggcctggcttgataatggcaatatggattcgcaacctggcgataagagtgacgtgccttttattatcacgccaccgctgtttcggatccagcctctgaccggccaggttttaagaatccgattcatacctaatgtctcattaccacaggatcgcgagacgatttactggttcaactccctgcagatcccccccggtaatattcaggcggaatcaggccgtaacagtattgttttaatgttacgtaaccgcatgaaactcttttatcgtcctaaagcgattggtcagccggttaatgttttcgacggtgtaaaagtaacgatgcaaaaagagggggttgaaatcaacaacactcaaccctggtatctctcacttacagaggttgtaataaaaacagcaggcaaaaaaatagcctgcgaagccgaaatgattgcaccctttgccaaaaaaatagtcaggtgtaaaccggcaacgcactctttatcagctaatagcgtgatttctctttcagcaatgaatgaccagggagctaaagtcagtgaagactatccgattgcaggcaggtaatatccgcatcttttttttgcctctctgtgcatcatttactttttcaccgtatggacacgctgatgaatactacttcgatccttcgctgtttaaaggttccgcctttggccagaatattgatcagtttaaccatcagactatcgcccccggcaactattatgtcgatatctatgttaacaataagctggttaaaagcggcgtcaccctgaactttctgtcagcagagaaaggtcagccgatagaaccttgtctcccgctgacggtggctgaatcattaagccttaagtcactgaataaatcctcaaccagcgagggctgtcagcccttgcgtcactggtcatcagcggcccgctggcaatttgatcaggcttcactgcggctgcagttcaccattccggatgcggagttaattcatctgcccaggggaaatattcccgtcgccgaatgggataatgggatctccgcccttttcatccggcataacaccaattatagctggacggaaaatagcgcttccggttacagataccagtatttctggagtggcatcacggcgggcactaatattgataactggcagctgcgccatcagggcaatctgcggtttatcgacaataacgttaccggcagcgatgttcgctacacaacggtcagaacctggcttcagcgccccattgaaccgctgaacagtctgctgacactgggcgacagctatacagaaagttcgcagtttggcagcctttcttataatggcattaagctcactaccgatgaaaggatgcgtccgcaaagccggcgtggttatgcgcccgaaattcgcggtgtggcctcctccagtgcccgggttatcgtcaggcaactgaatcgcgttatttatgagaccagcgtggcgcctggtcccttcgtgatcaacgatttgtacaatacccgtagccagggcgatctcgatgttgagattattgaagccaatggcaaaacgtcctcgtttaccgttccttatgcctctgtgcctgattcggtcaggccgggaaactggcattactcggttgcactgggtcgggtacggcaattctactcagttaataacaccttcttcgaagggctgttgcagcgcggtatcagtaaccgactgaccgctacggcaggatcgcggctggctcaggactatcaggcctggctgcttggcggtgtctggacttcggcagcgggcgcagtgggattaaacaccaccttttctgatgcaaaggtcgcacagaacagaaatgcctcgggatggcgcgccgagctgagctacagcaaaacctttgctaccggcaccaacctggtcctggccgcctatcgttactcaaccagcggttatcgcgacctgcaggatgtgctgggcgttcggcgccagcaggacaatggcatcagttactattcagatacgctgcatcagcgtaataatttttctgtgaccctgagtcagtcaatggccgattatggcttaatcagcctgagcggcagcacggcggattactataataaccggtcacgtattactcagcttcagttaggttacagcaacagctggaataacatcagttacagtctcaacgttgcccgtcagcgtactacctggaattatgatcgtttcgggctgaacctggacgatggtgataacgcataccgcgagaaatataccgaaaataccgtttcactgaatgtctcggttccgctgaactggggcaatcacactacctctgtggcctataactacaaccagtctaaagaaacgcgcaattcgacgctctcactgaccggttcatctggcgagaacaatcagcgatcctggtccctgtatggcggaaccgaaaatacgcaaagtaacagcggccaccgtgtctcgttcggcggaaatattcagcagaatacgcgcgcaggcgcggtcagagcgaattatggtcaggggggtaattatcgccaggctggattagggctttctggtacgttgctgattcatcgcggcggcgtcaccgccggaccttataccagcgacacttttgcgcttatccatgcggatggtgcccagggcgccagcgtacgcaatggtcagggtgccgtcattgatcattttggttacgctatcctgccgtcgctgacgccatatcaggccaacaccgtcagccttgatacacgctatatgaatgctgatgccgaattaagcggtggaagccagcgcgttgtgccctatgccggttccgttacccgaattaattttgccacgctgcagggtaaggccgtcttaatcgcgctcaaaaatgaagatcatgaaatcccgccaatgggcaccgaggtccgtgatgctgataataccgtgataggtattgtgggccagggtggtcaattatatgcacgtgtaccgcatgactctggaaccttaaaggtaaactgggaatataagggcaataaaacatgttttgttaattatcaaataaccggtcgcgtgaatgagaatattgttcgcctggatgctgtctgccataagggttaatcgtgtgagaatcgaaaaatatttcctgtatatcttattattgctgttcaatgtgcccgcctgggctaattgcagtgttgttaccgccacatcctcgttgtctcaaagcgcgattgcagcaggctataccgccgcctactggaccggcgcctgcgacacctgctcagggaatgtgggcctgccatctgtgatcagcatcaatagcggaaagaccttccagccctctggcacactgctggccagctcggtaggcagctttctgtcatcggccagcaatgtttcctactcagctaaccagattctttaccgctgcgccgtggcagatgcagacagtttgtatgagatgtatgccaccaatggcgacagcccctatgccggtcaatatattacctctgaagtggacggcgcctattatgatgtcgctgcaaatgttgccgtcaggctaactaacctgacaaccggcgaatattacagtcgctactggaaagcccgacagctgacagccagtgactggtattctgatggcacctatatttatattccggccagtgctttcagcaatgtgctgtatgaaatgtttaaaatagactctacgcgctattacgccagcaacagcaatcgctatgtggacaactggacacaacctcgcggatatattgcttttaaaggacccgggctggataccaataatctgaaagtgggccaggatagtctctcttactggtatggtttttaccgtaactggcccgctgcctggagcaccttctcaaatgtcacctatgtgcgtggcgcgctatgcgaagtccaggattatccttcggtggtgctgctgcctaccgtaagcgtgaatacccttgccgcgggcgggaaaagtcaggctccttttactatcactatccagtgcgagtccggtgccatctccggcaccagtacatcgacgatcacgtcagcaaatgtcgctatgggctttctcgttaaccagtcaaatgcggtaacgcaggcaagaaatctggggctgactacagctggcggcgggttaacctggctgctggatacccactatggtagcagcgctgccgcctccggcgtcggtataaaaatttatgacagtcataatatggcgctcaatttactgcctgacagaaacagtgacgggcacgggcaacagccgtggctggtatgcctataaagatttaacgtcgcaaatctcctcaggaggcgctgatatttacagtggtgatttcaccgcctctcttgaagcgctcagcgggcaaactattacagcaggaacagtcaatgcgcagttacaggttgtggtcagttttcagtaacgtcgttgtgttatctggcgtcctgctctcattcagcgtctgggcggtggtcaatgtggataaaacccggatcgttttcaatcaatcggatctgagccagtctgttaacgtcgtcaacagcggcggaaacgaaacgtatttgcaaatctggacagatgacggtgacctgactctctcacccgacgccagcatcacgcccgtcatagtcataccgccggtggtaaaaatgtatccgggagaaatgcgatcgttgcgtctggtactcacttcacgtcaggcgctgcccgcggacaaagagagcctctactggttaaatatttatcagatccctgcgctgaaaaaagagcttaacgcggctgaacgtaaagtggtgttaccgctgcgaatccggctaaaaatctttatacggcctgagggactaaacgccccgctgaccaacgatccggaaaagctccgtttcgcggtaaagggaaataaaatcgccataaccaaccctactccctggttcatgagcatgaatgtctattctgaaggtcagccatcaataaaaaatctcactcttgccccacaatctgatgcttacattgacagtcacactccgcctaaatccggtgagtcagtgagttatgcggtgatcaatgaccaggggattccggttaactacacgacaaccttgaagtaaccggacgggagtgccatctgccgacaggcatagtgcacataaatctgaccttttgcggcagtccagggcgtcgctacatgaattctgcgcatctgatggggctggcagtacgcagaatttacctacgcatggcgttttgagaggctcaagaggcagttccgcaagacaatccattttagccgcgctagagttgctggcttccactgtttcaacgacgagaaaaaatgaaacgcttatttgtctatggcacgctctgtccgggccgcgagaatgcccatatcctggaaaatattggcggagaatggctggccggtttctgtgaacggtatcttctatcagcgcggctggggcgcagcggctgattttccgggcatcgttctggatgagcatgggcccgacgtgccgggttatctgtttctctccgaccagctggacgcccactggccgatgctggatgcgtttgaagatggctacgatcgcgtcgaggttcgcgtttctgccgaagataatcggcaatacagtgcgtggatttatcagcttcagccgcaggaaagccgctgagctatttccgctgaacttttcctgcatcaaccctgctttcctgcattgggatgcgcgcgccctgctcttattgtctgctgaccttattttcctgtcagacaatatatacgggcacgttgcctgattctcaatttaattaagatctaatgtatgatgtaactaaaataagattgtccgctctggtcccggcaagcgctctcttagccccaccagccagccctgttataccgggttaatctggccagcgctgatgtggaaacagtgatacccgaatattaaacagatggattaagggcgcaacagccacactctcctctcgggcgatcggctccagtcttagcagcaacagatccagctcttccagcagatcctgatgtggcgctaactgcagcgatttcatcttgcgcttcaggtatagcgccagctcgtgaaacatctgaccactatcaatctgatgactctccagcacctcacgataacgtgcgtagaagtcataacagttggcgcccagccaggtttcagtaatcagatagccccccaccacgatatccggcaccggatcgagccttttacgcggcagaatgatattcacccggtcgagcatccgcgcaataaattgctgccgtgacagtagcgtggcggaattgcgctccaccattttaataaaccctaacagatcgcgcagccctcgttgcaccgctcttctggctatccatgacggccgtttgttgcggatcaacgccgtcagcactaccgcaaacataatccccaccatcgaggagatggccgcattcagcgtgacgatcagattcgggacatagtgatggcttaagccgataaaaccggggatctggatggcgacactcagccctaccagattggtcgccggattggcaatcaccaggctcagcagcatcagaccgggcagcagtatgatcatcagcgcctgtaaggtattggcctgcgggatcagaaaagcgatgtagaacaggctgaccaccagcgcaatcatcacccctttcacgaacagcttcatcggcgttaccggggaatcgacaccagcaaaaaatgaactgataatcgccgccattagaggtgcattcgccccatcggcccagccgctgccgatccagaacaggctggagaggaaggtcgccagaaatgccgtcagcgcggacagccgtaacagtcccttatcgatatgccggtgttcccggatattgcggatcgccgccccatccccgtggctgtagagatcccctgcgcgcgcactgacattctcataagcatcggcaatgcgcacaaagttagccagccgctcaagcagaccaatcagcagcaggctctcttcggttgccagcagcccggcccgccattcgtgctccagggttgcctgactggcagcaatcgcttcacgcagtccggcaatatcgttaatccgatcgtggtgcagccacaacaggaactgctgaaacacgtcggtgacgcacggcggaaaacgaatattgagttcggccagcacacccagccgtgactcaatcgccgtcagtgtcggcagcagataagtcagatgctgatactgtacgctgaccagacggatgacattacgcgccgcttcgccctcatagacgcagtgggtcagcagcgtttcaacattcaacggataacccgccatctgaatcaggatatcttcgcgctccagcgatttgttctttgccattccgctgatcagttcatcacagagtttgcgcgcgtttctgaaaccagagattaacgctctgccccagcagatgatgcatcgaaaccggaaacaccagccggtgaaccagcgtgctgcaaaggatgcccagcgtaatctcctcaatacgtgaaactacggtgttgatgattgccaacggtgactccacgtcaggaaatcccataatcgctgcgctgtagccagccagcataaagatatagctcttcggcgtgcggtcatgcagagagagccagaggcaaaccgttacccatagcgatacgcacaggctgaacaacactggcgactgcaccgtttcggggtagatcagcagaataaagatgccgcccagcagcgtgcccagcaggcgaaacagcgatttcgagacggtcgatgctgcatagagttgcgaggtgacaaacaccgtggtcagcgcccaggcgggtttttcgaagttaagaacgagcgccacagagagtgcgataaacgcggcaaaggaggttttgcaggcaaacaaaaccgcgtttttggtaaaccatttcatcgaatgagagcaaccaggaactttctgaggcgcgtatcctgacagatgcgcctgcgttttactctcagttaaattttacaaattattaccggccgcatcaggccggttaagcccctgctggcgcaccagcgcacggcgcttatccagtaaaaaagggcgcagatagcctaccgtgttcgagagcaaaatcacctcttcggcaagctcaatcctcagcacatctgtcaggtacgctttgcgctgagtcattcgctgccagagatcgggaaaacgacgcgccagctcatcacgcaatgccgcgtccgccagtgcgaccgtatcctcgatactgcagccgccataacccggcaccgacgggataatatcgatctgcagcagcataccgcttttcagtgtcacggctgaatcgggatagatgggcgagcttagccactcctcgtcagccaccagatgccccggattaagatgccagccatactgcgctttcggcagcaccgtttcgataagcgaatagagttcgccgccggtgatcccgatccgcaactgctccagccagctgaccaccgcatgataataggggatcgccagcctggtcagccagtcggagacgttacactgtaactcagaggcttcactgaccacgtaagccgagcggctggtcagcccgcctttgtagccggtggtaagagaaagcttatcaccacgcgcaatccgtttatcagacggatagagccgggcctgggcgaaacgatcgctggtcgcggcaatcgtcaccaccgtgtttggctgcccttctgcgttcagacgtgcgcctaacgccttctctgtgacgcccggcgctatgctatccagcgcagccagcatcgcggttgaagcaagattagcccccgcctcataaaacgccacttcatcggcgccgttaacgcagcgtgcaccgttgtcaggcgagataaacaatccggtggcgtttaccagttgcgcatcgccgcccgctgcctgcgccgccgaggcatagatgaactgcggcagatcaaacatccctcgctccctgccggtaaataacttccagcccaccagcccggtgcgtttcgcctgctacaatccctgcctctgctaacagctgatccaggggctgctccccgcgcataggctggttgggcagagaaaagaccgccgcatgcagacagcgtcccggattgcgggcaaacggcaccagcttgaggttctcattacccatgatataggtgagctcgccctgctgagtcaccaccagcagcgcctcctcgaagcgcggaatgaatcccgccagatattcaaaattgctgccgtgctctttgtcggcatagataatcagttgcgcaatctgctgctgctgcatccgctcaataatggcggccagacggcgatgcagtgtttcatcagacatcacagggctggcagcaccgggaaatgccggcggtgacgggattgtttccagggcatagcgattggcatccataacgcactccagtggccagattgacggggtttgatttccattcccagggtaaacctgaggtttagcctgtagggtgccacaatcacacaacttactcgttgcgtgttatcaaaagagggacattcacctgtaacagagacaaagaagcccgcgctaaacgggctctctgtgttatttgatgggcacgcctgcattctccagcgcttcagccttttcgggatataactccgacgttccggcattcataatcaccgctccacagcggatgcagtgatcgccctttacatctggcacaacgtcctccggattacccgtattaagactgacatcgcgcgtggcgtacacaaacgcctctccttcacatcccggacacttcataccatgactctcctgttaagcctgtcagataagcatagccgacaggcttttagccatacacatgaggagaggtttttcaggatattgccagctcataagcgccatcactctttttgccgtagccgctccagcataatgagtgaatgactgaagatggcgtcggcgatgtgctgcgggaaatcgggcggcaaagcatcgcgcaccgagaccactgcctggggaaaggccttaataaagaagtcgaagatctgctgcaaactgtcacgatcaaaactgacgctttttgccgtggcgataaaatggcgcgggaagattttatcgatttctgtcttcttccccttagtggcacgcagacccatcgccagtttcagcgctcgcttgttcagaccggtgccgcccagtaccgggtaagcggagatcacatcataaaagggagtcagtcgataactgccaccgcgctcaataaacagtgagaagttcttggcgtgaccgtcagttgcgccaatcagccactgaaacacctggaacatcataaagcgatagcgatcttcgatggcgttgctcgatcccatcagtatctgcatgatctccacaatgcccggcccgccatccgactcatatttggttgaagatggcagtcccagcgcctgacagaaatcctcctgcggcaggcgaatcaaccgggttttatcgcgtgaccagcggcggtcgaaacgttctaccgccagggcgcgcatctgtccggcacgaataatcgttgcctgcggcacgtcgataccgagtgcacgggccagcgccagacagagatactcattctccacactttcacgcatatccagcgtcgcggccggctgtttaatctctccgatcggcagcttaatgatgtgcgaggtgggcgtggcaccggcaggaatgctccagccttcatcggtcagcagcagtgcggttttctcctgcgcccccgcgaccgagatacggaaatcggtctcttcacgcagcatccccagcgggatatctgactgataggccgacagcacgctttcgagccgggtttcatccagcacttcatagcgggcctgcagtgcgggcagtggcatatcgggcggcagcagcatagtcgccccgacgctgtcacgtcccacttcctgcaacagatcaaacggctgacaggatttaatctggtaacgcgccacgattctgtcgcgaatcaatgggctatccggcagcagattatcgaagaagttaatcacggcgtgtgaggtgagagccttaacctgcaacggcatcgaaagtgacagcggcctggagagcggattactcagccagccggtatcatactgaaactcatgagcgccgtttcgctgccgggtgagtacgcctacccgctcgccgttcatccacgcaatcagcctttgcattaccactcatcctcatcatgcagctgaggcgcaccggcctcctctttctcgtgaacttccagactcagctcaagcgactgtaacagcttaaacagcgttgccagcgaggtactgtcaggggcattttcaaagtgagagatggtggcctgtttcaggccgacctttttcgccagctcactctgggtccagccattgcgctgacgaatgagctttagccggtttgccagctgtagcgggctgtatatcatggggtggctccttctggatcacaggctgtaagcatagcgcaggggcattatccccgacagggtataaaacagcttttaccccctgtagaggataataattactttataccctataacggataatctcacaattatccttttcaggggataagccggaaccacaattaaaagaggacgaggatgagcacatttacccttacccatcaggacaacgacgacgatcgggaagagttgctggcaggactgggggcttacaaccggcaatttatcagccgcgataactggggaccgctgtcggtttctcacagggacgaacagggaacgttgcgcgggggagtgatcgccgcacgcaaaggaaactggctctgtatcgattatctctgggtggacgaaacgctccgtggcagtggtctgggcagcgcactgctggaagccgcagagcaggaggcgggaaagatgggatgtctctatgcgctggtggatacctttagttttcaggccctgccgttttatcagaaacagggttatcagccgcagatgtccctgcccgattttccgcaaaccggtatgcagcgtcactatctgaccaaaacgctacggccaaaggcatcacgctgaccgcagtaccatcagcgtgacagggtcacataattacaaaccggcaatgcgccgcagatccgcttcggctcccggtgccacggccagtacctgcgcgcctttagtgatgcgatcgccttcggtgttaaacgggtggtaccagccgcccgcctctttcaccaggcagtaacccgccaggcaatcccaggcatgcatatagggttcgtagtaacccacgacccgaccggcggcaacccaggccagcatcagtgcgccggaaccaatacggataaagttaccgcctgccgacagcagcgctgccacaatctcgcctacctgctgagggctgacatagctgttggcaccaaaaccggtaacgtggttttgcagcgtgcgtgtgggatcgacctccagacgatgaccgttgagcgtcgcgccctgccccagtgccgccacgtagcactcctgataggtcggcgcgaaaatcaccccgatgacgggcacatcaccgcgcagcaccgcgacggaaacacaccagctcggcatcccattgagaaacgggctggtgccatcgatcggatcaaccacccaggtgtagtcagactctcctgcctgcaggcctgactcctcacccagaaagccatcatcgggaaacgcatcccgtatacggctggcgatcagctgctccacttcacggtcggcaatcgacaccacatcctgcaaatcgtacttggtctccaccaccagcgtctcgcgacggttgaagtaagataacgccgtcgcgccaccttcacgggcaacggcttccgctaaagccagacgcgccattatttcatcatgcgattccatgcgaactccttgagttagtcagattaacgggcaatcagggcaaggccctgcggcttaaagttgacgccaactgtggtggcgagcggcagacgctgttccatctgcggatcgataatgaacagcgcgcccagtttcggtggcgacttcatattcgatatggtcgcccagccaggtgctgtgaatgatctccccctgcagcgccccctgaccgtcgcctgacaacgtaataaactgcggtcgcaccgccagctgagcactgccggtttttgcaccggcacctcgtacccggaagcgctgattacccaggcggaccagcgcgtcatccgcatccgcctcttccacttcacagggcagaatattcgcctcccccataaagtccgcgataaagaccgaattgggcgaatggtaaagcgtctccggcgcgccctgctgggcaatatccccctctttcatgacaataatcttatcggagaccgccagcgcctcctcctggtcatgggtcacataaaccgccgtaaacccgagccgctgctgcagatcgcggatgtcggtgcgcacccgacggcgcagacgctcatcaaggttcgacagcggctcatcaagcagcagcacctgcggttccagcaccagcgcgcgggcgaccgcaatacgctgctgctgtccgccagagagctccgacggcagccgctgcccctgactctccagacccaccagcttcagcccctcgcgcgccctgtcctgcgcctcgcgtttgttcatgcccgaggaaagcagcccgtagagaatattgtcgatggcgttcatatggggaaacagcgcgtaggactgaaacaccatcgccacgtcgcgctcgttggcgggcagatgggtgacatctttgccgccaatcagaatccgccctgcggtgggatgctccagcccggccagcagtcgcagcgtagtggtcttgccgcagccggacggcccgagcagcgtcaccagcgtacccggctctacggtgagcgacagatccggcacagcagtaaaaccggcaaaacgctttgcgacatgttcaaacaccaccgatccggcgttaagggtcgtcatacggctctctcctgagtcagagtggatgcagagggtgcggcaataatcaccgccggttggattgcacgacgcaggcgacgttcgcccaccagcagctggaaaaggccaatgatcagcagcatcaccactatcaataccgaggagtaggcaatcgccacgccatactcaccgttctccaccagcccgacaatgtacgaggtcgccatgttgtactgggcgctgaccaggaaaatcaccgcgctgatagaggtaatggcccgcacaaaggcgtacaccagcgcggcgctgatggccggtttcagcagcggcagcaccactttacgcagggtgcggaaactgtttgcgcccagcgtcagtgaagcttcatccaggcttttatccagctggctcatcgccgcaataccaccacgcacgccgaccggcatattacggaagacaaagcaggcgatcaggatcatcgcggtaccggtgatctccagtggcggcaggttatacgccatcacatagctcacaccaatcaccgtgccgggaatggcaaagctcagcatcagcatgaactcaaaggtctgacgaccggcaaacttctgtcgcacaatcagccaggcggtcagcagtccgacaatggccgtgagcggcgcggcaatcagggcgatctccagcgtggtccagaaagagctccaggcgacgccgctccagaccagttgcccctgattaacgctgacgctaaaggcgcggatatagtgatccagcgtcaggttgttattcagcccccaggactgcacaaagccgccaatcatgatcatgccgtagatcaccagggtgaacagaccccagggtatcaccatgccatagacgctgtagcgcaccggacgcggcagcatcacatgacggccgccatcgcctttgccggtgacagtggcgaagcttttgccggagagccagacgcgctgcaccagaaaagcggccagggtgaagcccagcaggatcatcgccagcaccgccgcgcgactcgggtcgttctgtgcgccaaccacggagaagaagatctccgtcgacagcacgccgtgactgccgcccagcaccatcgggttaccgaaatcggccatgctttcgataaagctgattaagaaggcgttggccagccccggcgccatcagcggcagcgagatgcgggagaaagtgcgccagcggctggcacgcagggtctgtgacgcctcttccagtgacggactgacgccctcgaccaccccaatcagcaccagaaaggcgatgggggtaaaggagagtacctgggcaatccagatgccggtcatgccatagagccagcggcccggctcgatgccgaacagcgtcgccagcgattcggtgaccacgccagagcggccaaacagtaggatcagcgccagaccgatgacaaacggcggcgtgataatcggcagaatggtcagcatccgcagcgcttttttaaacggcagcgaggtgcgcgtcgccgccagtgcaaacgccagtcccagcagcgtagcgccactggccgtcatcagcgccagtcccagcgtgcgccaggcggtgccgcaggtgccaccggtaaaacagccgaggctccagatggcgggatcctgcatattggcaatcagtccgtcaggtttaaaactgccatcaatatcctgcaccgaggcgacaaacaggctcagcaccggatagagcacaaaggtcgtgaccagcgccaccagcagcacaatcgacgccaccacaaaggcatcgcctctcagcacgccgcgctccgccagggcaaaggcgaaaatcagcaaaaatatggtcagcagcagcagcgcacccgcacccatcgcgggttgtccctgcgccagcgggccggcgaggtttctccagccataaccagttccagccactgaaaccgatagcatgcccttccagcaccagaaacagaatgccgcaggtgctgaacagcaacagcagcgtgctgcgggtgcggcccgggggcagaaaggcgctgccagcacagagcagccacagcgccacggcgatgcccagccagctgtgtaacgcgagctgccccagcgcaggcgcattgttctcatcaccccataagctgaacagccagtcacccgagaagaagccctgctccaggctataccagggcagcagcgtcagcgcgatggcgcccgccagcagcgcgccggttaagcgacgattgtgcgcattcataaatcacctcgatcaggaagcggacatcaggcttacgccaccgcggtctggcacagacccggctcaggtggccggggcgcaccaccgttattgtgcgctggcaccaatctctttatcccagcggcccagcagcgctttgcgttttgctgagtcaccataggttttaaagtcataatcgatcagcctgatgttctcgaagcgcggtgcatattcagagatctccgccttgcggttagagggcagctggaacgatttcgcctctttcatatgcgactgtgctttagcgctgagcgcccagtcataccaggctttggcattggccaggtttcgtgcccctttgatgatcgacatcgaacctatttcatagccagtgccttcacagggcgcgacgggcttaatcgggaagccatctacttccatcgcgacggcatcatgcataaagacaatgccgatggtggtttcaccgcgcgcggcggctttgaccggagcagagccggacttggtatattgcgagatgttggcgttgagcttcttcaggtagtcaaaggctttgtcttcgcccatgatctgcaccagcgtcgccagggtgttataggccgtgccggaagagttgggattggcgatctgaatctcgcctttaaagccagggtcgagtaaatccgcccagcaggcaggcactttctgctttttctccgccagcagtctggtgttatagccccagcccagcgcaccggcataaacgcccacggtgcgataaccggagatctccgccactttttgtgaccagggctgttgctgatcgagcagtggcgatttataggcctgggtcagcccctcttcggcggcctgcatatgcggatcgccggtaccggcccaccagatatcggtacggggattgcgtgcctcgctgcggatacgggcataggcttcaccggcagagagccgcaccatgctgagtttaatatcgggatgggactggctgaacagcgtggtcatctgttcgcacaccaccacatcggctgagcagatcatattaagattgcccgccgccgaggcagcaaacggcactatagggcagacgattacagcagcgagcagagaggaataacgcatggtgttctcctgggctggatgacgcaggcgcgccagcttttgcacatgtgtgcaaacatatgtgcagattagtacggcggccctgctgcagtgtcaattcagttgttaagcaattgtcagtcgctgtcacaaatatgaaacctttcgcccatctgtattttttgcacagccttgcaacttcaggcaaactcagtgcagacaatgtcaggcgaggagagaacatgcagcagctaaaggcggtggtgagtgcgcaggatgtggctgaccgggcgggcgtctcccgctcagcagtctcccgcacctttacaccgggggccagcgtgtcagatgctacccgtcagcgggtgatgaaagcggcggaggaactgggctatcacgtcaatcatctggcgcgcggcctggtgcgcaaccgcagcggcatcgtctgcttaattgcctccgaggttgacacgccctaccgtgccagcctggtgcgctggatgacccagtatctgcaggaagcgggaaaagtggcgatgctgattaacactgaccgatccgatgcgcgcgtttccgccgcgctgcagcaggcgattaattttcgcgccgacgcatcgattattctctccggcatgccggacagcggtatcacccggctctgctacaaacatggtcagcatctggtgctgattaaccgcgacgaatccctgcccggcacgctcagtatcaacctcgactcccgccccgccgcagaaatggcggttaacgcgtttgtgcgggcgggatgcagccgcatcgcctttgtcaattcgctggcgggaacgccgagtctgctgaagcgcgaagcggattttctggccgccgcgcagaaagtgggcgtcacggtccaggtggagcggttcggcaccacctcgtacgaaagcggccagattctggcccagcgtctgctgacgcgtaaagtttcgccctgatgcggtgtactgtgccaccgacctgctcgcctgcggctttatggatgaggcgcgtcaccgctttgcgctgcgtattccggacgatctctgcatcatcggacacgataatatcgcgcagtcgggctgggcctcttacaacctcacgacctttgcacagccggtggagcaattcgcccgcgatgccattgcctggctggtggagacggaagcgcaaccggagacgctgatgccaaaaaatgaacagcagcaggagcggagaatatatccggtagatgtggtctggcgcggttcggtacgcggcggttaaccgcccttttttattttcttccgctatgtaattacgtcctgaaataatccacaaccgatcttacgcttcgctttaaatatcccgcccctgcactgaaaaataatcggacgctactgcacagtgttccgattttctgtctacgctttatctgcattattaagttcttctggttttaactgctcaatgaatcagcagtcagatgtgacaaatatcacatttgtgccaggcttaatgtctcagataactctgttcaaggagcatacaatggctacaccaactaacaagacgctcgatctggatcaatttcctaaacctccttttgaggaccagccacaacaggcgccaggcctggccagtaaaatgatcccggttcccgaccacggtgaaaccagctatcgcggcacgggacgactgaccggccgcaaggcgctgatcacaggcggtgactccggtattggccgcgcggtggctatcgcttatgcccgtgaaggcgcagatgtggtgattaactacctgccggaagaacagcccgacgctgatgaagtgattaaattaatcgaagcggaaggccgtaaagtttttgctattccgggcgacattcgttctgaagaattctgtcagcaactggtcaaagaggcagccgataaattaggtggcctggatattctggttaataacgccggtcgtcagcaatttaatgagtccatccgtaccctgagtacggaagattttgacgcgacgtttaaaaccaacgtttatgcgatgttctggatcacaaaagcggcgctggaatatctgccacgcggtgcgtccattattaatacctcgtctgtacaggcgtttaaacccagcgatattctgctcgactatgcgcagaccaaagcggccatcgtcgcctttaccaaatccctggcgaagcagctgggtggtgacggtatccgggtcaacgccgttgcaccagggccgtactggaccgtgctgcagtccagcggcggacagccgatggagaaagtgaagcagtttggcgccgactccccgatgggccgtccgggccagccggttgagatcgccccactctacgttaccctggcctcaaccgagagcagttactcctccgggcaggtctggtgttctgatggcggcaccggtacgctgtaatctcactcaggtggccgcataatgcggccatttttttgtcccgcttttgccccgcttaagaaacctcgccaccgtgatataaggaagcagattatggaaaacccgatctttcattcgccggtcagaaaagagggctttgcgggcctgggtgattatgccgccattggtgaaggccgtttctgttgcgctgattgcgccggacggttccattgactggtggtgcgcgcccaatctcgacgcaaagcccctgtttgatcgcctgcttgatgccggactcggtggctacttccagattgtcccgcgtgcgccttatcaggtctcacgccgctaccgcgataacagcaacgtgctggagacccgcttcgaaacccgtgacggcaccgtgctgctgaccgaatcgattaacagcacgctggcgggccgtctgccctggtgcgaactggctcgccgcatagagggtgtcagcggtgaagtggaattagcgatcaccctgcgcttcggcaccgccgccgaaacccgttcaccgtgggtggccgataatgagaaaggcaaggtgtttcacatcgcggagatcatggcgatgttgcgcaccagcgaagatattcagatcacggagctggatgacgagcaggtctgcgccacgctgcgtacctatgccggttcccgctcgctctgcgcgctgctggtgaccgagaaagagccactggcggtgccgccgctggaggctatcgatcagcggattgaaaccagccacaccggctggaccagctgggtggagagcctgagttatgagggccgctacccgacgctggtgaagcgctcagccctgtcgctgaagtttctctggtactctccgaccggcgcactggctgctgctgccaccacctccctgccggaggggatcggcggcgaaaaaaattatgattaccgctacgcctgggtgcgcgatgcctgcctgattattaaagccttcgtctatctcggggcgctggaagattgtaaggcggccttttcctggctgtcgcagaccatcatgcgccatggcgtcaggctgcgcgcctgctatgccctgaatggtgatgaggtccccgctgaacgttatccgctgctgagcggttatcagaactctcagccggtgcgggtcggcaataatgcccgcgaccagctgcagctcagtatgtatggcgacatgctggtgacagcccagcattttatcgaggcgggacacgtgctggatatcaccacctcgcgcatgctgggcgagctggcgaactgctgcgccgatcactggcggcagaaggattgcggcatctgggagctgccggagctgcaacactacacccactccaaaatggcctgctggatggcgctggatcgggcggtggcgctggcagaaagccagcatatcgaaccgacctggctgggacgctggcagcgggaaacgtgaccgtatccgcgactggattgagtcgcactgctggtcagagcaacagcaggcttatctcttttacgccggcagtgacgatcgcctcgacgcgtcgctggcgctggttcacagctacggcaacgcggtcaatccgcagcggatgctctcgacctaccgtgctatccggcaaaaactgggtgacggcagcgccatgctctatcgctacagcggggtaagagaagaagagagtacctttctcgcctgcgccttctggctggtggaagcctgggcagagataggtgaggcggatgaggcagaacaggcgatgcaggagatcctgactacgctgaacggccacggtaacgtcgatatcttcaatgagatgtatgacgtccgcagccagagctggcgcggcaatatgccacaggggctgagtcatctggcgctgatctgcgcggcgcaggcgctatcggaatcgcaggcgcctgcgtgatgtgagatgttgcggtgagaaaagtggcgaatccggcgccctattgcagcctgaaacgcggatcgaagaaaaatggctctaccaccaccttactgatgatgccagccgctgccggatgacggggattgaacagcgcattccactcgccggtcagcgtgctcggtaccttcagcaccaggccgttatccgggctggcaagccagtcgtcaccaatttgccgcgtggacgatggcgcaggatcggcctgccagtcatcggggagtgccgccagcgagagctcggtaatcagcgattcagggacgctaatcgacagcattgagtagtcgtgtgacagatcctgaatggtgagatgaaccagcgcctcaagtacacagagcgcccggcttgatcccatatagacacagaccgttcccacggaattccagcgccccccgtaagtgcgggcaccaaaaccatcaaaggcgctcatcgcatactcactcttcaccaggcgaaagaaacgtactgccatcaggtaatcacgccatgctcaagctggccaatcaggttaatcaccgcttctgcacccgccaccgtggtggtcatctccgccggtttcttaccgcccagcgctttggcgggcgtttccagccactgcaccagacgctgcctgtcgtcgcggaacagtttgctggcggcagagaggacgcggatcagcatgtagatccgtccgctctgatcgggcgaaaaggtctgctgcggatctttgactttgcggttgtaggtggtgcgatcaatgcccgccagacggcacagccagccctcgtcaaaggtggacaacgacgccgtgcgtttcagcacgccgctgctgaaccctaccgcaatacgctggtgcgcatcaggcagtgtttccggcagattcagggcatgcagcagcgaattgtcgcgacgatgctgagcgggtgtgtagatggcgatagacatagcagcctcctgttcatttgatttttattttagcgcaaatgaacaggcggtgccagctttaccccgtcgctgagcaagcgtgatgcctgttactcaggcttctcctgctgtaacgcctgcagaatctgccacgccgcctttatacgcagcggattagggtaattcttgttggcgagtatcacgatgccgctgttcctctcaggaataaaggcgatataggcaccaaatccattggttgtaccggttttatgcacccagctggcgctctgcgacggcccgaccggattgagcagcgttgccgggcggggttgcagcgcaacaccattatcgctgtcacccatcagcgtgtcggcagtcaccggccagtcgtagatctcccagcccagtccctgaaacaaggtgccgactttgaagtagcgcgcctgcgcggtgcgaatggcattacgcagcacggcattccccgaagagaggcggttaggatccacatttgcctgcataaaggtgagcatgtcacgcgcggtggatttaacgccgtaggcttctgcatccagcatgccgggtgagacccgtaccggctggccatttttatagccccaggcgtagtccagcatcatcgagggcggcacggtgatataggtgcgcgtcagacgcagtggctgaaacacatttcgcgccatcgcctgctcataatcccctttcaccatcagcgaaccaaacagaccgatgctggcgttagagtactgccggagcgtgccgggcgctgcctctggctgccattcctgatagaaacgcagcagcgaagcctgatcggtgacgtcatccggcaactgtaaaggcaggccgcccgcggtataggtcgccagatgcagcatccgcaccggacgccactgctcaccggtcagctgcggccagtacttttgcaccggatcgttaaggcgtatttcgccgttgcggatcatgacgccagccagggtgccggtaaaggttttgctcacggagcccagctcaaacagcgtgttttccgtgacccggcggcgtgattcgagatcggccacgccgaagttcacaaactgcgcccggcctttgtaaagcaccgccaccgacatgccggggatctcctgctgctccatcagcggttcgatcgcggctttaaccagagaagtaacctgctgtgaagagagatcggcggcgacacagctggcagaaagagagaataacaagagataaaacaaagactttttcattggcaactaagggattcttcactgaattaaattatttacactggtcggcacaggcctgcacgcacatctgagcctgagaactgcagccaccgttgtcccgggtgttgcagtgcgattgttctgtgtagcagttggtctgacaggcggagacatcgcagcgggcagcgacgggcgtcagctgtgccaggggcgcgcgggccggaaaaagcggtgcgggctgagcgaaggcgctgctgcccagtaatccggacagcagcaggctgatgatcattttcataagagttctccagagggacgctgcactaagtatggccagtctggcgcgccccgtcagagaaatctaatcaaattgagactacagggggatgttgagtgacattaatcacgccacggctgtagatatcgttgagccgggcaatgtaacgctgggtgtcatgctgatctttgatgcgcagaatcgccgcctcacctttctcctgcagcatctcaggacggtcgataatggcgagcagtatcgatttcagcccctccaccagcgactggcgtagctgcgttttctgctctggcgaggtaatactgtattcacggtcagcgttaagcggactcgcaatcacccagcctgcgctggcaggattaatctctggcaacgcgcgcacgttgctggtgatcaccgggcagccgttagcctgcatctccagtaccgagaaaccgtacgtctcctgccaggttggtagcagtccggcatcgctctggcggaacagctgcatcagggcgccgttatccatctgtgaatgatgcgtgaagcagcgatagcgtttgatgcggttctcaatgccactatagaaggtctcatcatcctggaaactggcggtgcgccacgttacgacgcttggcgagatcgccaatcagctgcacatccagctgcgactcttccagtttgcgctcttcaatcagctcactgatcgccagcacgacttcagccccgcctttgcggtagaactcgttaccggcaaaggtcagtttcagaataccgggctgacgcggcgttttctgctgtacaaacagcttctgcggcggatgcagcaccagggttttacggcggatttgctgggcaatatccggcctgaacagtttcatctgaatgttcagggtggcatctgagatggcaatcaaccccaggcagttatcttttaacagataaggaatgaggcgtttcagctcggggttgtcctgcttggcgacgcccgccaccggcagcacacgcggcagctccgtttcaaacgacgcgacccacttctgaggggttatcgcaacttcattgaacagatgcaggatgtcagcccgcgatgcccctgaaaaaggcacaggctgaaagacaaaggttttattttttttgagcaatcgggttcgtagcgggttaataaagtagaacagattgctctttttcagattgatatattcgttatccggattaactaagatattacgctgctccggatactggttattcgtgattccaattttcatgttcgccttccagagtccttgtgtccggagtgatctatatcacgtgaacgtgactggcgggtctgagcaatatcctaaaagcccgtaatgacacggcctgaacgcttttgctaatgattgcgcacggtgctaaaacagtcacaattgtgtctggttatgaatttgcattttttattaacaggtgtgtttaactgtgtcaggctaaccccttattgaatatggcgattattttccgggaaatattcgcgccagttgttatgtaaatgtttaattaattgtcaggaatattagcgaagcggatgaggattttagttaataacttttaaagtaataagaatgaccatgctgaaaagtacctggcgcgttccactggctgatgattaacacaaacacagacgggcgataatgaaacaaatgatgcagcacggttatatccgcaccctttttgcacgcctgtttgccacaattcagtgcaacagtttaagaggatggcgggtgccatgcgcctcacatcattcattaagcctatgatttacatcattatttaaatgaggcgccctacaaccccctttctggtacaaaagttgcaggaagtgacgtatgcagacaggagagcattatgaaagcaatcgtgattggtggcggtataggcggcatgagtagtgccattgcgctggagaaatccggaattgacgttgaggtctttgaagccgtaaaggagatgaagcccgtcggcgcggcgatttccatctggcccaacggtgttaaatgcctgaatgcgctgggcatgaaaaccgcgctgcgtgagctgggcgggaacatggcctatatggcctatcacgatggcaccaccggcgcccccctgacccgcttcagtatggcgccgctggtgcagcaggttggcgaatatccctgtccggtggcgcgggcagaaactgcaggcgatgctgattgataccttcgggcgtgaacgggtgcagtttggtaagcgggtgatccaggtcgagcagaccggtagtggcgtgattgccaccttttccgacaacactcaggccaccggcgatttcctgattgccgccgatggcacccattcggtgatccgcgagtatgtgctggagcagaagctggaacgacgttacgccggttacgttaactggaatggcctggtcaccattgatgagaagattgcgcccgccgatcagtggaccacctttgtcggtgacggcaagcgggtgtcgctgatgccggtcagcggcaatcgattctacttcttctttgatgtgccgctgccgaagggactgccgcaggatcgcagtacggtgaaagcggacttaaccggctattttcagggctgggcggagccggtacagcagctgatcgcggcaatcaatcctgacaccaccaatcgggttgagattcacgacatcgaacctttcagccgctttgttaaaggacgtgtggccctgctgggcgatgctgcccacagcaccacgcccgatatcggccagggcggctgcgcggcgatggaggatgccgtggtactggcctcaacgctggcttctcattcactgggtattgaagatgcactgctgcgctatcaggcgcgacgggttgaacgagtaaaagatctggtgctgaaagcgcgcaaacgctgtgacgtcacccatgcgcgcgatccggcaatcacggcagaatggtatgactctctgaaaagcgaaaccggtgaacgagtgctggccggaatgtgcgaaaccattgaaggtggcccgctgggttaacactaataaaaccgggctgtcagcgcgaccagcgcgtgacagcccgttctgctatgactccgccagaccacgatttttcagcatgggctccagctgcggaggcccgccccgccagctttcatacagtgttttgagatcgctgctgttcccccgggacagaattttctgtcggaagaggtcgccgttctcacgcgtcagtccgccctgttccgcaaaccactgatagccatcgtcggcgagcatctgcgtccagatataggcgtaataacctgcagcatagccaccgccccagatgtgctggaaatagctggaacgatagcgcggcggcaccgccgtcagcgccagattatcgctctgtaacgcctgctgctcgaatccctccacgctttgcggcgcggaatcacggttaaggctgtgccagtgcagatccagcagcgcggcagccagcagctcgctcatctcgtagcctttgttgaacgtggcggcccggacgattttttcatgcagctcagcgggcatcagcgcctgagtctgatagtggcgagcgtagttgcggaacaccgctggctcgctggcccagtgctcgttgatctgcgaaggaaactcaacgaaatcgcgcggggtttccgttcccgacaggctcggatagcgctggctggcaaacagaccgtgcagcgtgtgaccgaactcgtgaaacatcgtgataacgtcgtcccagctcagcagcgccggttcaccggctggcggtttggtgtagttacagacgttgtagatcaccggtttgctgtcgagcagcgtagactggttgacgaagttgctcatccaggcgccgccgcctttgctgtcgcgcttaaagaagtcggtgtaaaacagcgccagcggggtctcatcggcgtcaaaaatctcatagacctggacgtcgggatggtaaaccggcagatcctgtcgcggcgtgaaacggatgccatagagctgcgtcgccgcccagaacacgccattctgcaacaccgaattcagttcaaagtagggcttaatctggctctcatccagatcgtaacgggcacgccgcacctgttcggcataaaaacgccagtcccaggcctgcagggtaaaatcgccctgctgctgatcgatagtctgctggatagccgccgcttcacgctccgcacgaccgcgcgcggcaggcacgatgttatgcataaacgccagcgccgccttaggcgttttggccatctgatcctgtaacttccactcggcatagctggcaaatcccagcagccgcgcctgctcggccctgacctgcgccagacgtaataccagctcgcgggtgtcgttctcatcgcctttttcagtgcgcgtcacgcccgccttaaacagcgcttcacgggttgcgcgatcggccaggctctgtagcgcgggttgctgggtggtgttttgcagcaccagcagccagcgcttttccagtccgcgtgcctgcgcttccgcctgcgccaccgccagatcggccggtgagagtcccgccagcttctgcagatcatcgacgaccagcccgcccgctttagtggcggccagcaatttgttggtgaagcgggtaccgaggcgggccgcttcctgattcagtgtcttgagctgctgtttctgcgcttccggcagattggctcccgccagctggaaacgctgccagatcacctcgaccagccgttttgattcggcatccagtttagcgcgctgcagatagaccgcatcgagccgcgaaaacagcgggcgattaagcatgatgtcatcgttgagcgcggtgagctgaggcgcaatctcctcatccacctgctgcagatacgggctggtatgcgccgaggtcatggcactgaacaccagattcacccggttgagcagttgtccgctcctctccagcgcctcataagtgttgaaaaagctgggcgcgtcgctgttcagtgcgatcgcctcgatctcctgacgcttctcctcaatgcccgcctgcagcgcgggcagaaaatcctgctcctcaatctggtcaaaaggaggagtctggtaaggcagtgtgctgacgctaaagaagggattctgacgggcgttcatggttcgctcctggtgggcatcgcaaagtcttatcctgacaggttgccgcgcaggcgacaactcaggcgacgtgctgctgataaacgctgatgatttcaccggcaatcgccaccgcaatctcggcgggcagcttgcctttgacgtccggcaggccaatcggacagcgcaggcgcgccagcgcttcgctcgcgacgcccttgcccgccagcctgtagcggaaacgctggtttttcgtttcagaaccgatcaccccggcatagcggaaatcgccgcgcttcagcaccgcctcgcacagttcaaagtcgaggggatgatgatgggtcatgatgatgaagtagctgcctgcgggtgcctgtgctacgcagtcgagcggatcgtccggctgcagcgtcaccacgccagcgggaacgtggctgaactgcgccggacggctatcgatccagtttatgtgacagggtaacgttgacagcagattgaccagggcctgtcccacatggcctgcgccaaaaaggtagatctctggctgcgcctgcagcagcggctcaaacagcagcgtggttttgccgccacagcactggccaagccgagcgcccaggctgaaatcctcggtgtgtggcgcagtcgccccactctgcaacatcgccctggcctgggcgatgcactcaaactccagatgaccgccaccgatggtgagataactctcctgctgcgtcaccaccattttgctgccactgtcgcgcggcaccgaaccgtgctcactgagcacggtgattaatacgcagctctgacgtttttcacgcagctgatgcagcacgccaatccagtcatgataaatcatcaacccctcccgtcaggcgttgcacgccccagaagatgcgctccggcgtggcgggcgcatccagcagtgggtgctgccggtaatcggagacgctggcgaccgcatcctgcagggcacaccaggcggcgatgcccagcataaacggcggttcacctacggccttggagtggaacaccgtgtctttagggtttttacggttctccaccagcgtgacccgcaggtccgccggaaacgtcgctgatggcgggaattttgtagctcgccggtccatcggtcagcagctggcctttatcactccacaccagctcttcgcaggtaagccagccgacgccctgaataaagccaccttcaacctggccgatgtcgatggccggattcagcgacgccccgacgtcatgcagaatgtcggcgcgcagcaggcgggattcgccggttaaggtatcaatcaccacttcacagcaggctgcaccgtaagcgtagtaatagaacggcgtcccgcgacccgcgacccggtcgtaatgaatccccggcacgcggtagtagccggtggcggagagcggcacctgattcagccacgccagcttcgccacctcggcgaaggtgtaatgtttatctccggcgcgcactaccccgttgcggaagctcaccgccgccgcgtcgcactggtgtagctcgcagagcatggcggtcatgcggtcgcgcaggatctctgcaccattctgcgccgctttgccattgaggtcagccccgctggaggccgcggttggcgaggtgttgggcactttgccggtgtcggtggcggtgatctgaattttatcgatctcaatctgcagcacttcggcgacaatctgaatcaccttggtgttcaggccctggcccatctcggtgccgccgtggttaagctgcaccgtgccgtcggtgtagatcagaatcagcgcccccgcctgattgagaaagctggaggtaaaggagatgccgaattttaccggcgtcagcgccagaccgcgtttcagcagcggactgcgggcattaaacgccttaatctccgcgcggcgagcctgatagtcgctgctctgctccagctgttcggtaatctcatccagcagattatcctctacctgctggtggtaatgggtgatgttgcgatcctgcttgccatagtagttacgcttgcgcagcgccagcggatccagcccgcgctcacgggcgatatgatccatgatctgttcaatcgccaccatgccctgtggcccgccaaaaccccgataggcggtgttcgaggcggtgttcgtgcggcagcgatagccggttacccgtgcatccccgaggtaataggcgttatcggcgtggaacatggcgcgatcgacaatcgatccgctaagatccagcgaataaccgcagtttccggccagatcgattttgatgccgcacagacgcccatcctcttcaacacccgcttcgtagcgcacaaagaacggatggcgtttgccggtgacgcgcatatcgtcgcgacgtgaaagccgcatcttcgccgcccggccggtctggcgcgccacgatggcacagagacaggcgacaccggccgcctgcgtctctttaccaccaaagccaccgcccatccggcgcatatctatcgtcacctgattcaggctgatgcccatcacttccgccaccagtttctgcacttcggtggggttctgggttgaggagaagacctgcaactgctgatcttcaccgggaataaccattgccgtctgggtttccagatagaaatgctcctggccgccaatgtgaaacgccccactgacccgatgcggcgcacgcgccagggccgcttccacatcaccgcgctggtgaatgtgaggttcctgcacaaagctgccctgagccagcgcctgttccacatccagcagcggttccagcacctcatattcaattaccgcagcggccgcgccaaggcgggcagcctcgggggaatccgccgccaccgcgatcacgatctgtcccagatactccactttgtcatgggccagcagcgggtcgcccggctccagcggcccgacatcattgatgcccggcacatcctgccaggtcaggacgctgacgacgccgggaacggcataacagggctgcacatcaatatgcaggatgcgcgcatgagcatactcactcaggcgcggacagagatgcagcagacccggcagctctggcttgtcatcgataaaacgcgcctcgccggagacatgtttttccgcgctctcatggcggttactgcgaccaacgccgctctgtaaatcagcggcatactgcgccttaatgacctcttcgttgagttcaggacggttatgagacatagcgggccacctcaatacaggttatttcgccgttgtggcgatgccagtagcggcgcagcaggttgcgtgcgacctgcagacggtagtcactgctggcgcggaaatcggagagcggctggaaatcctctgccagcgccgcggctgcgcgtgacaccgtcacggcattcagtggctgaccgatgaatgcctgttcacagtgacgggcacgctgcggtgtggccgccatgccgccaaaggcgatgcgggcactactgactacgccctgttcaatctgcagattaaaagcggcgaacacggcggagatatcatcgtccagccgtttggacactttccaggccacaaaatcaggtgacaccgtcactttatcgatgcgaatggcgcgaataaactcccctttttcgagccgggtctggcgatagccggtaaagaactgatccagcggcaggctgcgctgctgctcaccgcgctgtaacaacaggctggcgtttaaggccagcagcgccggcgaggcgtcgccaatgggggaagcgttaccgatgttgccgcctaatgtgccctgcagacggatttgcagcgaggcaaagcgttgcagcatctcgctgacgccgggaatgcggctggcaagaaattcgctgacctgctgcagcgaagcccctgcgcccagcaggtagtgatcatcaaattcgctgcagactttgagcgcggcaacctgctccagcgcaatcagcaacggtattcttttatgctgctgggtaatctgcaggctgagatcggtgccaccggcaatcagcctcgcctcgggatgtgccagatagatcgccgccagctgagccggagttttgggcaggaagcaacggcggccctcaccccctaattcctgcatctccggggttgccagcgcctcaagccgctgcacggttgcggcggcaccttgatcgaactggtctgtcaccggctgcgagcagagctgttcggcggcggccataatcggccggtaaccggtacagcggcagaggttgcccgccagcgcagtttccgcctgatggcgatcccagcccgaagcggttttttgcaggctgaacagcgacatcacaaagcccggcgtgcagaatccgcattgcgagccgtgacagtcgaccatcgcctgctgcgccggatgcagtgcgcggccgtgacgcagatcctcaaccgtaatcagctgcttgccctgtaacgcggagaccagcgtcaggcagctgttgaccgtttcatactgcattgttcccccgacggctttgcccagggttacgctgcaggcgccacagtcgccagatgcacagccctctttggtgccagggcgttgctgacgggtgcgcaggtagttgagtaccgtgaggttggggtcgagcgcgtcctcgctgaccagctggttatttaacagaaactggatcatgcggcttgctcctgtgcgtcgcgctgccagaccggacgaccggctacccaggtctgggcaatattgcggtcgtcgccgagcgtcattaatacaaacagtttttcccagatatctttgctgttgccgatgcgcagttgctgcagggcagaaaccgccgggtccagcaccacaaagtccgcttctttaccgatgttgaaatttccgatggcgtggtcgagatccagcgcgcgcgccccgcccagcgtggcgtgataaaaggcttcggccgcgctgagccggtagtgctgcagctggcccaccttgtaggcttcgcccagggtctgcagcatattaaaggtggtgcccgccccaacatcggtgccgatccccactttcaccccctgctgccagctgcgtttcaggttgaacaggccgctgccgagaaacaggtttgaggtgggacagaaagcaatggatgaatcggtatcgtgcagacactgccattcgttctcttccagatgcagacagtgagcaaagacgctgcggcggccggtcagctggtgatgatgataaacatccagatagccttcacgctccgggaacagtttctttgacccaggcgacctcctgcgggttttcgctgagatgggtatgcagccaggtatccgggaactcctgacgcagctgctgcactttttccagcagctgtggggatgaggtcggcgcaaagcgcggcgtcagggcgtagctcaggcgtccgcgctggtgccagcgctcaatcagcgcccgggtctgctggtagctctgttcaggggtttcgatcaggttgtcgggcgcattgcgatccatcatcactttcccggcaatcagccgcatgttcagcgcttcggcggcgctgaacagcgcctccaccgattgcggatggacggtgccaaacaccagcgcgctggtggtgccgttggaaagcagctgatgcaggaagaaggcggacatccgcgcagcatgatcgggacagtgatactgcgcttcaaccgggaaggtgtagtgattcagccactccagtagctgttcgccaaatgcgccaatcatctctgtctgcggatagtgaatgtgggtatcgacaaagcccggcacgatcagtctgccgcgcaggtcgatgaccggatgccccgccagcatcgcctcgctattctcccagctatccagccccactacgcatccatcacgcagcagcagcaccgcatcctcaagatagcgggcctggccggccaggtcgtcgggacgatccaccacgccggtaaagtcaaagaagctggcgcgtatcgccgtgtcggttgctgaaagcatgggtagtcctttctgaaagcgcgatgttatatctgcagatgattatctgaataatcctgtgcaacctgcgtgccagaattgaaatagaataaattctttaaatatcagtcaaataagttaaaagaggaaagttgcgcaacaaataaggactgagatggcttagcaaccgtttgcggaacggatgcaaacggttgctactcaatattgcgcgccctgaacattttgagtatggcgggttacccgcaaacctgccctttaacggtgcaatctgccctgaaaaggcgcagctggctacccgttaaaatccgtttacaggtcaggcagtttttccacgcgcagaagcggaaatgaaatgctatggtgaagccatcgactctgaaaatggcataaggaacagtgagatgattatttttgtcaccggtgcgaccgccggttttggtcaaagcatcacccgtcgctttattgagaatggtcataaagtgattgccactggacgacgggctgaacgtttaaaagcgctgaaggaagaactgggcgagaatatttatacggtacagctcgatgtgcgtaaccgtgccgccatcgaagaggcggtggcgcagttaccggcggaatggcgcaatatcgacgtgctggtcaacaacgccggtctggcgctgggcgtcgaaaccggcgcacaaagccaacgtcgaagactgggaaaacatgatcgacaccaacaccaaaggcctggtctatatgacccgcgccctgctgccacagatggtggagcgtgatgtcggtcatatcattaatatcggatcgattgccggcagctggccctatgccggcggcaacgtctacggcgccaccaaagcctttttgcgccagttcagcctgaatctgcgaaccgatttacacggcaccgcgctgcgcgtgaccgacattgaaccgggtctggtcggcggcacagagttttccaacgtgcgctttaagggcgatgatgacaaggcgggtcaggtctacgaaggggctaccgccttaacgccggaagatgtgacagaagccgtatactgggtggccacactgcctaaacatgtcaacatcaatagccttgagatgatgccggtcagccagacgctggcggggctgaaagtgcataaaccttaactccctgcagcgccagccctcacggctggcgttacccgcgtccccagcccatcacgataatcagcatgccgctgaatgcgatcagagccccgctccagtcccacacacttagcttcacgccatccaccacccgcaaccagagcagcgcggtaagcacatagacgccaccgtaggcggcataaacccgtccgctggccgcgggatgcagcgtcagcagccagacaaacagcgccagacttgctgccgcagggagtagcaaccaggctgacccgccttttttcagccataaccacggcagaaagcagccggtaatctccgccagcgcggtaataaaaaacagcaaggcggttttaatcagcatccttacctctccttaacgtaaacaaacgactcactgctggtgagcaaagaaacggcgatgatatactaagagccaggcccatcaggctgttttatttgtccgtctgaacccgggcagtgctcatcctcctcacgtacaccctgtacgcgccggttgtcatgcgctgtctgtgtccagactgtctgcctcaatgacccctgatgagccaggctctaagcatgcccgctgcaaccgctgtcgtggatggcgatgtttgcgttaactaaaggatagtgtgatgaaaaaaatgatccctgccgtgctgatggttctcctctccactgcggcattcactgccactgcgaatactaatcgtctgattatcgaagatggcagttccgcgctgagcaatgaagcagcgcgccaggataaagagcaatggaatgacacgcgcatgctgcgcaacaaagtgaacacccgcgtcgaaaaagagtttgataaaaccgatcgtgcgtttgatacccgcgacaagtgcgagcagagcctcaatctcaacgcatactgggagcccaacaccctgcgttgtctggatcgccgttccggtcgcccggtagcgccgtaaatttgagctatagtaatgacgacgactaacataaggaagacgtgatgaagctacagagggttttgttaagcgcggcgttatttgctctgccgctaatggcgcaggcatcctgtgaatcggtaaaaaccgaaatcagccagaaaattattcagaacggtgtgcctgagtcgggttttagtctcgacatcgtcgccaacgatcaggttgatcaggcgggtggccaggtcgtcggacattgtgagaacgacacacaaaaaattgtttataagcgctcaggcagtgacaacgaagccagcgtacctgccagtgccggcagtttcgcaggactcatctgcccagtagttctgttcaaatcagggcgacatcctgtcgccctgcctgttagtccgcctgttccggccgctgacgcggcatcatccatgccacacacaccgcaaacagcgcaatcaccagtgccaccacgaacacccagtgcagtgagacggcaatcgaccctaccatctgctgcagggtttccggctgtaactgctgacggctgggttcggacataatcttctgaaccggatcctcgacctgcggcaaacgccactgcagattgagattcagcaccgcgcccatgatcgccgtccctaccgccgacccgatcatccggctgaacataattgaagcggtacagatgccgcgaatctggtaatccgcctgattttgcactgaaaccaggaacgtggtgctggtcattcccatgccggtaccgatcagaaacgccgtaaagcccgcctgatagagtgagcttgcgggctgtaaaaacagcagcaaggcactgccggtcaccagcaacagcgccccaagctgggcggtgaagcggtaggaggtgtgcagcatcagtctgccgctgagggtgctggccagcggccagccaatcgacatcatcgccagcacactgcccgcctgtaacggtgaaccgccgctgatcccctgaatccaggtgggcagaaaagcgctgatgcccatcatggccgccccgatgatgaggttgcccgcattgcccgccacgataagccggctgcgccagattatcagcggaaacagcggtgccgctgaattcagctcgtggcgtctgagctgccagccagcgaacagtgagaagagcagaaacggcaccagccagacgcccagctgttccgcctgcaacagcgcaatcagcaaggccgtcacgcagagcatcagccagccgctgcccgccaggttcagcggctgcgatttctcctccttctggtgcgacggtagccagcgccacagcatcagcatgctgatcaggccgatgggcagattgacccagaaaatcaccgaccagctaaagtgctgtaccagccacgcgccggtcagcggtcccactatcgccgctacaccccagacgctggagagccagccctgcacgctggcgcgttcgcgcggcgaatagatatccgccacgatggtggagctgagcggcatgatcgcccccgctcccaggccctgaaacgcccggaacaggatcagccaggtcatggtatgggcaaagccacacagcaccgaccccaccaggaaaatcgacgtgccgacaaaaaacatcgttttgcgacccaccatatccgccagccgcccatagagcggcacgctgaccgcctgggtcagcagatagatcgagaagacccagccaaactgcgaaaaaccgccgaggtcagcaatgatggtgggcatcgcggtggccacaatagtgacttcaatggccgccataaacatcgccagcatgcaggcgattaagatccagtggcgatgtccggtctggagttgtgcgctttcagtcatagggttccttttttaatctgcaaggctagctgaaaaacagacaatgcagtttcccgcgcgtgcgcattttctgcgccctctgtgacagtgtcaccagaagtcgatgaaaattttttattgtcgcattagcccagcggctacgcggctttaacaccattttaacctatttctatctctctgatttgtggcttaaaagctggcttgtgcaataaagggctgctatagcattacaccatcttattcagtattcactgaaaaagagtgggtaaacagtcattttatctacattttatcgcagtttcggtattgggcgcggcggcaatttttgccgtacctgtcgggctgtttatggttgttataacaattgagatcgtaatcagggagattctccgatgcaaaatgcttcactggcccgacgcgccggtctggcactgcttgcagtggtcgcggtgatcgcggtgctgatctggggccttggctgggatcagctggtcgcacgtaaagtcgatctgctttatctcgggcaacaacacctcttcttagtcttctggtcaatgctgttcgctttgctggtcggtatccccagcggcatcctgcttagtcgcccgtttgcacgtcgctgggcagagtacgtgatgcagattttcaatatcggtaacaccctgccaccgctggcggtactggctctggcgatggttattatcgggattggcgaccgtccggcgctgattgcgctgtttctggcttcgctgctgcctatcgtccgcaacaccttctctggtctgagcgcggttcccccgtcgctgattgaggcggccaacggcatcggcatgaccaaatggcagcgtctgcgtcaggtagagctgccgaatgccttgccggtcatcctctctggcgtgcgcatcgccaccgccatcaatgtcggcaccgccccactggcgttcctgattggcgccagcagctttggcgagctgatcttcccgggcatctatctgaatgactttccgacgctgatactcggcgccgtcgccactgcactggtggcactggtactggatatgatgctggccgcgctgggccgctttctgagtccgcacgctgcggcctgaccacaaggagctttgcaatgctaacgcgttggattaagaaaagcgttgtcgcgctgaccgcgacactgctgttaagccagacggcacaggctgctgcaccgctggtgatggcgaccaaaagtttcaccgagcagcatatcctgtcagcaatgacggtgctctggctgcagaagaaaggcttcgaggtggtgcctaaacgcaatatcgccaccaccattggccgtaatgcgctgctgaataagcagattgatatggtctgggaatataccggcacctcgctgatcatctttaaccatatcaaccagccgatgtcttcacagcaggcatatgagacggtgaaaaagctggatgccagactggggctggtctggcttaacccggcaccaatgaacaacacctatgcctttgccatgacccgtgaacgggccgaaaaagagggcatcagcaccatgtcgcagctggttgcgaagattgagcaggtgcgtaaaaccgatccggatcataactggcgactgggtctggacctggagttctcgggtcgttcagacggcatgaagccgctgcagaaaacctacaacctgacgctggatcgcccgcagatccgccagatggatccgggcctcgtctataacgcgatacgcgacggattcgtggatgccggtctgatctataccaccgatggccgggttaagggcttcaacatgaaagtactggaggatgataagcacttcttcccaagctacaacgtgacgccggttgtgcgtcaggatgtgctggcgagtcatccggggctggataccgcgcttaatcagctttctgcgcaaatcaccgatgaggcgataacggagctgaacaagcgggtcgatatcgatcatcagtcaccggaaaccgtggcgcgtgatttccttaaatccaaaaacatgctgtaaggaggcactgtggatacccttcactacatcatggataactggagcaccctgctcaccctgagctggcagcacagctggctggtgctggtcgcggtcggactggcaattgtgattggcgtgccgcttggcattctgatcgtgcgtgtaagatggctggcaacgccgattctcggtatcgccaccgtagtgctgactattcccaccattgcgctgtttggtctgatgatcccgctgttttcactcatcggtcagggcattggcgcgctgccggcgattaccgccgtgttcctctactcgctgctgccgattgtgcgcaacacccacaccgcgctggagaatctgccggacggtctgcgagaagcgggccgtggtatcggcatgacgttctggcagcgcctgcgctgggttgaaatcccgatggcgctgccggtgatcttcggtggcatccgtaccgccgtggtgatgaacgttggcgtcatggcgattgccgccgtgattggcgcgggcggtctgggccagctgctgctggatggtatcagcggcagtgatattcgtatgttaattgccggggcattgatgatctgtctgctggctatttttcttgactggctgctgcaccgtttgcagcaggcgctgactccaaaggggattcgataatgattacgctggaaaacctgacgaaaacctttacacagaaaaacggcacgaccaataaagccgtcgataacgtcagcctgcacgtgccagccggtgagatgtgcgtgctgctgggaccctcgggctgcgggaaaaccaccacgctgaagatgattaaccgcctgattcccgccaccagtggccggatcctgattaatggtgaagataccagtacacaggacaccaccaccctgcgccgcaacattggctatgttatccagcagattggtctgtttcccaacatgaccatcgaagagaacattaccgtggtgccacgcatgctgggctggaacaaaaagcagtgccacgagcgggctaccgagctgatgagcatggttgcgctggatcccaccaaattcctgcatcgctatccgcgagagatgtccggcggtcagcagcagcgtatcggggttattcgtgccctggcggcggatccaccggtgctgctgatggatgagccgtttggcgccgttgacccgattaaccgcgaagtgatccagaatgagtttctcgacatgcagcgtcagctgaaaaaaaccgtaatgctggtgagccacgatattgacgaggcactgaagctcggcgatcgcattgcggtatttggtcagggtaaaatcgtgcagtgcgccagcccggatgaactgctggcgacccctgccaatgagttcgtcggctcgtttgtgggtcaggaccgtacgcttaagcgcctgttactggtgcaggcgggcgatgtgactgaccagcagccgaccatcaccgtccgccgctctactccgctggaagaagcctttggcaccatggatgagaacgatatgcggtcgattaccgtggtcgatgaggatggcaaaccgctgggcttcgtgaagcgtcgcgaggcgcgtaacgtcagtggccgctgtgaagagcgactgcacacctttaaggtcaccggtaaagcggaagagaacctgcgcgtggtgctgtcaaaactctatgagcacaacacggtctggatgccgattgtcgatgaagagggtcggtacagcggtgagatttcgcaggattatattgcggattacctcagtttctggtcgtacccgccgtcgtctgaatccataatttcgtcacctaaatgggtcttaccggcccattaaaacagcagatataagcagatatacccaagcctgggtaaatcagacagcaacaaacaagcttaacgcgcagggaaccgggtcagaggaggaaagcgtcccgcgccatggacaaaaacgccgggagcgtttttgaacaacgcaacgcgttggcccggtacgggcgcacctcagggatgaggtgcgtaattgcgcgggccgagcgtgccacggatggcggcttttgcgactttccgatctgaccctgttcccttcgcagactccatcttaaagccagttaagtcacggcctgtcctgtctgtcaattcaggtagtagctcagggagcatacgcctgtagcaaagacgcaaaagatgccatccatggcatgctcagcgcggcccatccctggtccgcgatgctttgatacaggcgtatgctcccatcgctttggatttttgagccgtatgtgagagatacatcggctcttctgctttttagctctccgtcagcgtttccgcctccacctcttccaccacaggcgcctcgtccggcagcaccatgttcagcacaatcgccagaataccgccggtcgtcaccgcatgaccaaacagactgttaatcagcggcgggaactgcttcagcacatccggcaccgcctccacgcccagaccaataccaaaagcgatcgccacaatcagcatctcgcggcgacccagcggcgtctgggtcatcacacggatgcccgcggcaaccacgctgccaaacatcacgattgtcgccccgcccagcaccggcggcgggatctgctgcaacagggagccaataaagggaaacagccccagcagcgccagcatgattcccagcagcataccgacgtaacggctggcgacgccggtcatctggataacgccattgttctgcgcaaacgtggtgttgggaaaggcggagaagaccgctgccagcacacagctcaggccgtcggcgacaatgccaccctgcaaccgctgctgaaaaggtttgccggtgatcggctgctgtgaaatcaggcagttagcggtaaggtcaccgacggcttcaattaccgcgatcactgacaccagcgcgatcggcaggaaaatggtccagtcaaaggcaaaaccaaaccggaagaacgcgggcagcaccagccagttgctctccggcgcaacattaagttgcagatgaccggtcaaggccgcggcaacgcatcccaccgcgattccggccaccaccgccaccagccgcgcccagcgatttcgcgagcggttcagcgccacgatcaccagcaacgtcagcgcccccagcgccagatttcccggcgatccaaaatctgtggcgttgtgcccgcccgcccagtcggtaatgctgacttttatcaggctgatgccaatcagggtgatcaccgtgccggtcaccaccggcgtcagaactttgcgcagcgagccaacgcagcggctgatcagaatcggaatcaacgccgccaccaggttacagccaaacagcatcgccataatctcttccggcgaaccaccgcgccctttcaccatcagaccaccagagaggatcacccccagaaacgcgaagctggtgccctgcagacagatcatgcccgccccgatgccataaaagcgtctggcctgcataaacgtgcctaagccggaaacgaacaatgacatgctgatcagataaggaatataggcctgcaaccccagaacggagccaataatcagcggcggcgtgatgattcccaccacgctggcaagcagatgttgcagtgcggcaaaaaacgccggggcggggccaatgcgggcttcaagcccatataacaaacctttctcgtgcgagtgcgacatgatggggctccagctcagtgtgataagcggagttaatgcattttctgcgccatgacgccacgatttcgcgatatccgagccaggtctttcaattctaaatggaaatagttaaagacagccgacaacgagcctgaaactttaggctcactgccgactcagatgacttagtttgtttcataatcaggcgatctttgcactcacagcatgcagattgttctgctccagcagagaaatatcgatgtaagacgtcagatcacgctgttctgcacgcggcagataaggcagctcgcccagcagcggcgcactaattttttcacgcagaatctcaataatatcgctgtactgcgccagtcccggattgatgcgattggccacccagcccaccagtggcagtccatcctgcgctatcgcttctgctgttaacagggcatggctgatacagcccgactggataccgaccaccagcaccaccggcagctgctgctcaacgacccagcaggagagcggacgtccgtcgttcatcaggctccgccagccgccggtgccttccacaactacgcgatcggcctgcgccgtcaggctgcttaagccctgtgtcagcaatgcgtaatcaatgatctggctcggatgggtgcagatctcctcttcctgaaaggccagcggattgatcgcctgatagggtaaatcgatggatgaagcgctttgcagaacctgtgcatctttgttacgcaggccgtcagcggttttgaccgcgcagcgcgcgacgggcttgtagccgacggcactgagcctggcctggataaaactttgtaacagggcgcgtgacaccaccgttttgcccactgcggtgtcagtgccggtaacaaatagtctgttcactcaacttctcctctcgaaccgttgtggttaatcggtgattaaccttgctgcgaaccggcattttaaggaatggaggatgagaacagattgcgttagcgcaagattaggcccgcttaaccttgcaacagtttcactaacaggtgtccgttatagagcgcgtctttgatcagcgctgcgccgcctaacgttcccggctcgctaaattcggtaggtgccagctggatactcgcgctgtaggccgggagtgattgctgcagaatggtgttgctcacggccggaaacagcacatccgcggcggcattcaggggggaaccgataagaatatgttgaggattgaagatgttgaccatcatcgccagaatccggccaacatgatgacccacgctggcgatggtgtcgcgcgccagacggtcgccagactgcgccgccgcgcacagcgactcaagcgtcagcggctgattattgagcaggctgtcgggctgggccggcagacgctgcgccgccagcgccagcagactgccggtgctggccacggtctccagacagccatgattaccgcagtagcactgctgaccatacgggtcgatctgagtatgcccgatctcgaccagcgccctgccacttttatgcagcagctgaccgccactgatcaccccggctcccacggtttcatcaatcacaatctgaatcacatcctgcgccccacgtgaggcaccaaacagcgactccgccagcgtccaggctgaaatatcgtgctgcacaaacaccggtaagccggttcgtgccgccagcgcatcgcccagcggcatatcgcgcacctcataacccggtagccgatgcaccacacctgacgcggcgttgatcagccctggcaatgtaatggcaatggccgtaaggcgttccagcttcttctgatgacgaataaagaaggcatcaacctgttcaatcagcgcggtaagtaacggctgagcagactcatcaggcagcggcaggctctcttccaccagttccttgctgctgagatcgcgcagcgtaaacgtcatggcgccgcgatgcaggcgaatagccagatagtgccaggcgtcggtatccagtatcaggcctatcgccggacgaccacgactgccgggatcctgaaactcggtctcctgcactaaatgtgcgtccagcatttcacgcacaattttggtaatgctggccggagcaagctgggcacggcgggaaagttcgatacgcgaaatgggaccataacggtcaattaatcgatatacgacacctgcattagtctgcttgatctggtcaatgtggccaggttgactgtccggattcacaaccctgctcccggttattttcgcgcttctaaataaacatgcgccatggtgagccagatccggcgacagcgtcaaatatttgattagaaatgtgatttatcgcacagattgatgcggtgttgcccgcgcatcagtgccggtttcgccgcagcaacgccatcatgttttccatctgcgcatttatttcgcgtccggctgaccagaccagccacagctctgaaatggcatcctcttccgttaatggcaaccagaccagatcggccagccgcgcccgacgaaatgaggcaggcagaatggagacgcctaacccggttgccaccagcccaaggatggtcatcgcctcacccacttcctgagtaataaagggcttgatatggtagcggtgcagcagcgccagaatatcgctgtagagcgcggttccgccctgagggtcaaagaatacaaagggttccgccgccagggcagtgacagagattttatcggcgtcagccaacggatgcgccttatgcaccacggcataaagcggctcactcagcagcagctgatgacgcagatcggcgggcagcggcgtgttgcgcatcacgccaagatcgagccgtccatcatgaagcggtgcgagctgctggcgggtattaatctcctgcatctgaatatgtacctgcggccagcgctgacgaaaccggaatagcgcgtcagagaccacggcggtaaacggggccgaggaggtaaagccaatccgcagctccccctcttcaccacgatgcagccgggcggcgcgatcggccgcctgttcaacctgtaacagaatcgcgcgggcgtcactcagcagttgctgtccggcagcggtaagctgcacgctgcggttagtgcgattgaacagccttgcgcccgtttctgtttccagctgaataatctgctggctgagcggcggctgagaaatgttcagtcgctgggccgcccgcccgaaatgtaattcttccgccaccgcaacaaagtagcgcagatgacgcagttcgatattcatatcttaaacgtctcatttgagattattaatatattagacatcataatgccgctttcctaagctgacgataggttttctaaatttgaggaagatgtgtgagtcgctcaacacatgctgtcacagtggatgagaatgcggtctctgcgccgccagagtcagttgccgcttcaggtcatatccgccgggattcgccacagtttatgcgcgtgacgctggcgcttttctccgccgggctggcgacctttgccctgctctactgtgtgcagccgattctgccggtgctgtcacagcagtttggtatctctccggcaaccagcagcctgtcactctccatctcgaccggcctgatggcgctgggcctgctggtcaccgggccgctctctgatgctatcggtcgtaaatcggtgatggtcacagccctgatgctggccgccatctgcacgctggtctcggccaccatgaccagctggcacggcattctgatcatgcgggcgctgatggggttgtcgctgagtggcgtggcggcggtcggcatgacctacctcagcgaggagatggatgcacgggtcgtcgccttttccatggggttatatatcagcggtaactcgataggcgggatgagcggtcgactgctgagcggcgtgctgactgacctcttctcatggcgactcgccgtggcggtaatcggctgtttttcgctggcctcggcgctgatgttctggaagattctgcctgcgtcgcgccatttccggcccattacgctgcgtccgcgtaatctgctgattaacttccggctgcactggcgcgatccgggcctgccctggctgtttgccgaagggttcctgctgatgggagcctttgtcaccctgtttaactatattggctaccgtttactggatgcgccctggcatctcagccaggctgtggtcggactgttatcagtggtctatctcaccggctcctggagtttcgcctaaagcgggcgcgctgaccaaccggttggggcggggtcccgtgatgctgggtgctaccgccatcatgctgctgggtttgctgattaccgccttcaactccctctggctgatcctgcctgggatgatgctgttcaccgccggtttttttgccgcccatgcagtcgccagcggctggattggcccccgggcgcgccgggcacgaggccaggcctcttcgctctatctgttcagctactacgtgggttccagcgtcgcgggtacgctgggtggcgtgttctggcataactttggctggagcgggattacgctgtttatcagcgtgctgctgatcctggcgttactggttgcctggcgtctgcacagtaaaaaactctgagaacgtcttctcatgccaggcctggcttctcctgcgggcctggcggtttatcacaataaacgcgctattcagagccacagcaaacaaaatgcaggtttcccgctataatcgtttttattgtaataattcatctgctttgccttttaacacggcaacaaggaacgcctgtggctctctactactacgtcaataaacaatcaggatataacaataatcatgtggttcatgccgcaggctgcccccatcttcccgacatcgataaccgtatgtttctgggcagtttttaccatgtgaatgccgccatcctgcaggctaaaaaatattatgctggcgcaatcggctgtgaaaattgttgtccactcaaaaatgttgaccagcaggccacccagctcagcgtggccctgaagcacaccccggcttcgcgttaatctgatccacctggtaagggggaaaaaatttttcccgctgcgctaatttgttaagaattaccgctgttttccgttatgttaatctttctgattctctttaatggaatgcacaatgcgggataagtttgcacgcgctcagatagcccttcactggctcacctttttactggtggtgacggcctacgccaccattgaactgcgcggttttgcacagcgcggatcctggcagggttatgccatgatcattacccatttcagcgccggcgcgaccatcctggtattgatgcttgcccgcctctttttacgcacccggcatcgcacaccgcccattactcccgccgcgccgcgctggcaaaccgggctggcacatctgactcataccctgctctatgctctgtttatcactctgccgatcctcggcctgacatcgcgttatcttaaaggtcgggaatggtggctgtttggcatcagcatgccggtcgcgcctgaacctgactttgatatggcggatatgctgattggctggcatgaaaccctggcaccgctgggttactggctgatcggactgcatgctgctgccgcactgttccatcactatctgcttaaagacaatactctgctgcgaatgatgcccgcccggcgtcgcggtcaataacctcaggctatcgccctgtgatggggcgataaaaaaatttcagcattaaaaggcgtttataaggtttctcttcccgctttattcactacaatggtcagtaatttgtgacgcaggtcactttcgctggatgtttctgccacatccgattcgctgtactgactgacttgactcctcatgcaaccaactactgtttcacgtaaaactgcctggctacgcgtggtattgctggccatcgccgcctttgtatttaataccaccgaatttgtgccggttggcctgttatctgacatcgctgctgacttttcaatgcagacggctgacgtcgggatcatgctgaccatctatgcctgggtggttgcactgctctcactgccgctgatgctgctgacccgcaatattgagcgacgactgctgctgggtgtgctgttcctgatctttatcgtcagccacgttctttctaccgttgcctgggatttccgttcgctgatggtgtcacgcgtgggtatcgccttgtctcacgcggtgttctggtcgatcaccgcctcgctggcgattcgcgtcgctccggccggtaagaaaactcaggcgctaagtatgctggcaaccggtaccgcgctggcgatggtgctgggcgtgccgattggtcgtgtggtgggtcagtatcttggctggcgtacgaccttcggcgcgattggcctttcggcactggtgctgatgattatgctggtgcgcatcctgccgcgtctgccgagtgaacataccggctcgctgagcagtgtgccgatgctgtttcgccgtccggcgctggtcagcatgtatctgctggtgacgctggtcgttaccgcgcattacaccgcttacagctatatcgagccctttatgcaaaccgtggcccattccagtggcaacttcaccaccctgctactgctgctgtttggctctgcgggcattgtgggtagcgtactgttcagcacactcggtaataagtttccctccggactgctgattgcggccatcgcgctgatcaccctgtgcatgggcctgctgatttttgctgccgttcgccctgcggctatttcaacgctatgcgttgtctggggaatggcgatgatgatgatcggactgggtatgcaggtgcgggtgttgtcgctggcaccggatgccacggatgtggcgatgtcgctgatgtccggtatctacaatatcggtatcggcgcgggtgcgctgctgggtaatcaggtcagcctgcatctgagcatggcggaagtcggcaatgtcggcgggatgattggcctggtggcgttactctggtgtgtttatatcttccgtcgttatccacagttacgcagtaacggataataaaaaaggcttcagataagcgggttatctgaagcctgttcagggttatttaccgatcactttatctataaagaaacggctgtgccatgcaggttgttgctgccagaggtcgaagtgatgcggaaagactttgctcctgcatcgctggccttttctgacagttgctgctccagcgaaagcagattagtactgcccgttgcgctgatgacaccgattttttgctgatccagcggtgtgctgctgacctgctgggccgctacgctggcaaatgacagaccgcttagcaccgccgccacgaccatcatattgatatttttcataacgaaccccttctcacttattctgttgaaatcaaaattactgataaatcacagccgtgccgtgcagtttgttctggccgctggttgaggtgatgcggaacgatttcgcacccgcttcatccgctttagcactcaactgcgcttcaacagaagacagattggtgccgcccagtacagaaatggtgccaactggctgctgattaacaggttcgctggtcaccaggtcagcggcagatgcgccaaaagtcagagtcgtcagtgccagtgctgccagggtggttttgatgtttttcataataatctctctattcaatattgaaattcggttggtctgaatgggttgtcactatttaattaatgaccgttaaacaaatgatagaccccgatacggtttgtcgtcaacatttatttaatgagcgttattttattcgcgaagtggcgtgattatgggcttcagcctcttttctgacttaacctaaggggctgtaataatgcgctggcgcacaaaatggcaacccctgccggcgacatccacgccaggccttgcacatttttataatgatcggtaatttaatagggtgttttactgtcagtgagggtgtatgagtcaggttcaggattgcgatgtaaagaaatgccgcggccgaccaaaagtgttcgatcgcgaagcagcgctcgataaagctctgaccctgttctggacgcacggttacgagggaacttctctggccgatctggtggccgcaaccggcgcgaaagcgccaaccctctacgccgagtttgttaataaagagggactgtttcgcgcggcgatggagcgctacgtggagaagttcagtgcatggcgtgaagcggcattgggcgatgaccagttaccggtggatcgggctattgaagcctatttccgcgccaccgcggcctgttttaccgaacgcgactctcccggcggctgtttctttatctgcacctcaaccgccctgtcggcggcttcagcagagattgccaccatgctgcaacagcagcatcagtcgcaggagcatgtgttaaaagattttctgctggcgcgtcagcagcgtggtgaactgagtgcgtcagtaaacattcccgcgctgtcacgttatctgagttgtatgctgcagggcatgtcggtgcgggcgcgtgaaggcgttgagcgtgacgatctggagagcattattgatacgctgatggcgatgtggccgacactcaccggcctgtgtcaggctaagcgttaaaaatatcagggcggcgatgccgcccttttcatcttttattcccgattttattccagaaagaaaaccggttttaacggctcactgatcgggctgttatctgcattagacggcatcaaatctttcattgatgcccaccagcgctgacagacctccgtttccgccaccgcgttccagcgctcctcagattcaatctcaacactggcgaaacagcagatgccgctcggcgtccagccagatggcatagttatgcgcgccgtgcgctttcagggtttcggccagttcaggccagatcggtgagtgccgacgctcatactctgcatggcaataaggattcacctgcatcacaaaggctttacgcagcattagcaggccctgcatccagcgccggttgccacggcttcacaccaaagcgctcacccaatgcaaccagctgttctgtggtgatactctgacgaataccgcccatcgacagcactttgacgatcacttctgacgatttctccgccgtatcaatcagaccaaaagtctcatcgagtgtcgggcccgtgccaaagacaccgtggaatggccacatcaccagggtatgtgactgcatctgtccggcggtcgcggtgccgatttcatcggtgccgggtaccatccagggtaaaacacccacaccgtccgggaacaccaccagacattcggtactcccttcccacagcaggcgggtaaagcgggcggaatccatctcaaccacatagcttaaggccataaagttggtggcgtgacagtgcatgatcacccggtctgcacccttgctgaccgctttacgcaccgcatgagactgaaagtgtgacgccagttcagaggtcggcaaaccgccattcgacaggccccagtgaattttataagagagccctttgtcatcgacctgcagcagtgccagacaatccgccggatcaagctggacattacgcatgaattttcctgacccggtcaccagaaaccagtcgttcgccagcgccggcgcaggttgtgtcagctcaatacagcgcggttgcaggcagaaatcagcggcaaatggtttaacctcctcttccagcagacgcaggctgacgttgccgccgttacgttcgtcccagcccttcagccacatatcgctggttgctttgaccattcccttaacaaacccggaagaaagaatgctttgcatagtgaaatccttaacgttggctcaaaatctgttgttcataatggcggacgtcgcctaaccagctggcatcagccgggacgtcatggcgcaggcaccaggcttcccataccgcctgccacggcaatgatttttgctcttccagcagcgtcagccgcgcggtgtaatcaccctcgttctcggcctggcgcagacgatcggttggctccagcagggcacgcagcagcgcttttttggtgttacgggtgccgataacccaggcggcaatccggttgatagaggcgtcgaagaaatcgagtccgatatgcactttgtcgaacagttgatggcggacgatctcgctggcgatcgcctgagtttcatcatccagcagcaccacatggtcgctgtcccagcgcaccgggcggctgacgtgcagcagcagatgcggcacatagagcatcgcggcagaaattttgtcggagatcacttcggtgggatgaaaatgtcccgcatccaggcatagtgccgtctggcggctggcggcgtaaccaagataaaactcattggagcccacggtgtagctctctgcgccaatgccaaacagcttgctctcaaccgcgtcgatatggtgctgcggattcagtttttctgagatgacctcatccagtgcgctcatcagacgctgacgcggggccagtcgatccacggtaatatctttcatgccgtccggcacccagatattcatcactgacggcgtgccaagctgctcaccaaacgaagcggagatgcggcgactcgctttgcagtgatcgatccagaactgacgcacggttttatcactgtgcgacagcgtaaaaccgtcggcactcatcggatgcgagaagcagctggggttaaaatccagccctaagttgtgctctttcgcccaagcgacccagttggcgaaatgggcaggttcaatggcatcccgatcgactggcttgtcactttccagatagatagcgtgcaggttcagacgttttgcgcctgggatcagagacatcgccttgtcgatatcgctgcgcaattcactggcattgcgtgcccgccccggatagttgccggtcgcctggatgccgccagtcaatgcgccctgtgggttctcaaagccccggacatcgtccccctgccagcagtgcatcgagacaggaatgctgtccagctggcgaatggcctgttcaacatcaactccattgtcagcgtagcgttgtttagccagttcaaaagcctgttcaatctgcttagtcataagcgggttccttagcgggttgactcagcgtcgcgaagcgtgcctgactggcactgaagacgctgtgagtttgcggttcgaatttttccagtgggaagttgttgatgacgctgcagcggaaatcagccacatcgatcagttcgccaagtgcaatcagctggcaaccaacgttacccagcgtggaggcttcaaccggacctgccagcaccggaatctggcaggcatcggcacagagctggttaagaaaacggttctgactgccgccccctaccacgtgaagctggctgaaaggtttgcctcgcagctctgccagctcctggatcacctcgcgatagagcagtgccaggctgtcaaatatgcagcgggccagcgcggcggcagattgtggcaccggcattccctgctctgcgcaggcgttctgaatctcgttaaccatgctgtcgggattgatgaagcgcgcatcattgggactaatcagtgaaacacaggcgggctggcgggccgtctgatcaatcagtgcgctgagatcgtcaatctgcagttcgccgcagatgcgctgcaacagccataagcccatgatatttttcagtacgcggtagccttctgcgccgccctcattggtgatattggcgcgtaacgcgccatcgcaggcataaggctgcaaactttcaaagcccatcagcgaccaggttccggaactgatataggcggcatcgtcctgcatcagcggcgttgccagaaccgcgctggcggtgtcgtgggtggcgacggcaatcaccgggaccgggacacctgcgctattgacccagtggccgacggtgttgcccggtgcctgcggctggccgaaccattcagaagcaacgcccgcccaggcgagcagatcacgatcccattcgccgctgtgaatattgagcatttgcgtagtggtggcgttggtgtattcccagttgagattaccggtcaggcgataatgcagatagtccggcatcatcagcgcatgcgccacgcgggcctgccagtcgggctgctgctgatgcagggcgcgcatctgatagagcgtattgaatggcaggaactgaatgccggttcgggcgtagatggcactgcggctcagttcgtgctgcgcctgctccatcaggccgtgggtgcgcgcatcgcggtagctgaccgcctcacccaccggctcgccctctgcatccagcagcaccatatcaacgccccaggtgtcgataccgatactgtctggcacgatcttctcttcatctaactgagccagcccggcgcgtatctcctgctcaagcattgtcagatcccagcagtcataaccggcacgacgctggcgcttatttttaaagcgccggacctcacgaagcgcgagctggcgctgcgcagcatcccagcttgcgagcatgacccgcccgctggatgccccgagatcaatagcaacaatgtttctcctggtcatggcgacttttccctgtgattgagtggtcacagagtaaaaacctggccggttaaagaccttccccggagtgccagcggctgataagccctggcagacttgcaaagaacttcgtgagagagatcacagaggcgaaaggcaggaggatgtgacccctgccgcaaatctgttaactgctgaggatttcttgaaaaatcagcatgattcctgctgagtcaggctgaaaattcaaggtaaggttagagcgtgctgattagactgcgttacggttttgttaagcagcgagagatgaccatgaccatattgcacagtgcggattttttccccgaaggcgattacgccattgcgattgaaccccgcgtaccccaggccgccttcccggaacatcatcatgatttccatgaaattgtgctggttgagcaaggctctggcattcatgtgtttaatggtcagccacaaacgctgtgcgccggttgcgtctgctttgtgcgcgatcacgatcgtcatctttatgagcagaccgacaacctttgtctgaccaacgtgctttatcgcagccccggcgcgtttcgctttctctccgggttacaggctttactgccctgcgatcaggacgggcaatatgcttcccactggcgcatcaatcaaaaggtgatgacgcaggcgctgagtgtggcggcgcagatgcagccggatgatacctggtcgatggaaaaacaggcgcgccaggaacagctctttttacagttgctggtgctgttgcgtgaggcgtgcattgatggacagagtcaggatcaggaggcgcggctgcatcgtctgctcgactggctgggtgagcattacagtgatgagattatctgggatgaactggctgaccgcttctccctgtcgctgcgtaccctgcatcggcaaatgaagcagcaaaccggcagcacgccgcagcgctacctgaaccgtgtgcgactgttgcaggcccgtcatctgctgcgtcacagtgatatgcgaattaccgatatcgccttccagtgtggatttggtgacagcaaccatttctcaaccctgttcaggcgcgaatttggctgcgcaccgcgagcggagcgccagcagatgatgtaaaggagccaatcatggcgttgatactcagtcgggatgactattttcccgccactactctaccggtggcggtcgccgaaaggatgccacaaccctctttcccgccgcatcgacacgagttcagtgaaatcgtgattgtctggcgcggcaatggcttgcacgtcctcaacgatcgcccctggctgattacctgtggcgacgttttttatatccgcgacagtgactgccacagctacgacagcgttaacgatctggtgctggataacatcctctactgtcgggatcgctttggtcttgcccttgactggaatcagctgctgccgcaacagggaccggatgcgccaggcggctggcggctgaccacgcgagggatggcgctggcccggggagtgatcagccagctggagcgtgaaagccgcaaaagcgaccccctttcagttcagctctcggaggcgctgtttttacagctggcgctgattctgcgccgccacggctacgcggccgaccgcccctgggcgttgccggagggggaacagctcgatctgctgatgtcagcgttacagggtgcgattgcccgcccctttgatctcgcggagttttgtcagcagaaccagctcagcgaacgggcactgaggcagcttttccgtcagcagaccgggatgaccatcggtcattacctgcgtcagctgcagctctgtcaggcaaaatatctgctgcgcacccaggattgtctgattagtgaggttgccgcccgctgcggctttgatgacagtaactatttttcggtggttttcacccgtgacaccggtttacctcccagcgcctggcgacagcaatttatcgcgccacgccaggcactgaaaagtgccgagtcttaataaaacgggccttcattgaacgctgtcgagcaatttactgcacaaaagcagcaataaatcagctaaaaggcgcagggaacacgctcagaagaggaaagcgtcccgcaccatggacaaaaacgccgggagcgtttttgaacaacgcaacgcgttggcccggctacgggcgcatttcagggatgaggtgcgtaatcgtgcgggccgggcatgccatggatggcggcttttgcgtctttccgatctgaccgtgttccctgagcgggcacgatctgaccgccattctgctaacgctaagggcctgcatagcaggcccgtttctgtattaaaacagcgtctctgtattcgcaatcaggccgccatgccaagtcccactatattggcggcaatgataatcaccacacagccgattgataacacgctgaccgggcgacgtcccgcagacttccactccttcatcagcagccccaccagaccaccacacaggacgtatagactcatgtgcagcatccagctgacatagtcatactgcgccgggattctggcatggccccaggcatagaagaagaactgcagataccacatggtgccgccgagcaccgcaaaagcggtattggtaatcagcagcgacttcccgaccgagaagtctttacgcaccgacagctctggccgggtggccagccgccagaaacagaaggccagattaaccagtgccccgccgcccataatgatcacgtagctgggcagagctacatacagcggatcgatgccaagattagcggcggcctgatgcatgggtttagccgcatccatggcaaaggacatccccgccgagaagatgccgcacatcaccgccagcatcagtccttttctgagattaaactcttctgcgttaatccccagcgcccgctcttttaacagcccggcacgcgacacaatcccgacgccaatcagtgccaccagtacgcccagcagggttaaccggccacccgccgacgcgaagagctcaccaaagcgcccctgcagaagcggtgtcatcagcgtgccgaccaccagggtaatgccaatcgcgataccgattcccatcgacatgccgagataacgcatggtcaggccgtagttgatattgcctatgccccacatcgcgccaaacagaaataccggcgtcagttgcgaaagcgagaagctgctgtaataggccataaaatctggcagtaaaatggcacttaccgcccacggcaggatcagccacgacatcaggccaccgatcgaccacatggtttcccatgaccatcttttcacctgtttaaaaggcgcgtagaaacacgcggcgctggcagctccgacaaaatgccagaagatacccgcaataatggcactgttcattgttattccccggttaggttgaggcctgtcggaaacctgtctgcttccgctcagcaggcagtctacgttcagcaggaattcctcagcctttggataaatgccggaagccacagtgaagtggcaatatttacccgttgtgcccatcagggatcacaatttcaccgttgtcagaaaaccggacgattagttaagtaagtaacttattattcaatgtttttttcatttttgctgtgtggcgcagcacaattctgatctgactgccattcacaagggaaggttggcaaatgtgctaagaagcctttcattaacgcgggcaaggtcgtataaactggggaaaattgatcggatcagggaatgggatgacgacaaagtggttaacgctgtttctttcgcagtcagtcagccaggtcatgctggatgatctgcgcgcgatattacctgcagatgcgataaaggtgtttgtgaatggcctggatgaaacccactatgccacccttgagtgtgtgcaggcggatcagcattgcgccctgatcgcctcagcgatagtggtctggcgtcagctcggacatgttcaccatattctctataaaaaaggtgaggtgttgcgggaggaaaatgatgcaacgcagttccagctgttcactctgctgaaaacccaccgcgccgtattgcagatctcatgataagatcgcagcccctgaaatcgctgtttgcagcaggtaaattatgagaattggaattctgtttccgatcgccatcattgtggcgggcgtgggctttctggcgtggtttattggcagtggcctggcgatgccaggctcctgaaggtcagcgcaactgactgtctttactgccccgacggttatataaactgctggtctgctgctgcttgtcgattttttcctgacacgccacacaatagtgcacgcctttaagcgcctgacgacgcgcttcgggaatcggctcgccgcagagctcacattcggtggcgctttcgccctgtccgatcgactgtcttacccgctcaatgccgtcattgacggtgctatcgatctgttcctgtactgcgccttctgacgcccatccatttgccatgatttaacccctttattaccacttcactcctttaaatctacaacatattgacgtttttgccgcagaactcaccgatatctgtgattggctgccagccgctcccggcagctggcaatcagctaaaggaagccctgagcaatctgtttcaccctgctatcacattactgcaacgtatcgatagcggagagctaagcgaatgacaacacatcatcaacatttcattaatggcgaatttgtagcccatcagggtgaccggtggattgaagtgatcaatccgtccacggaggcgttgctgtcccgtattccccagggcagtcgtcaggatgccagccttgccatcagcgccgcagaagtggctcagcctggatgggaagcgctgcctgcagtagagcgcggcgtctggctgcacaaaattgccaccgccatccgccagcgtgagcctgaaatgacggcaaccattgtggctgagggtggaaaaacccaggggctggcgaagaccgaagtgatgttcaccgccgactacctcgactacatggcggagtgggcgcgtcgctatgaaggtgagatcatcaacagtgaccgccccaacgaaaatatcttcctgttcaaaaaagcgatcggcgtcactaccggaatactgccgtggaatttccccttcttcctcattgcccgcaaagcggcaccggccctgatcaccggaaacaccatcgtgatcaaacccagtgagctgacaccgaataatgcggcactttttgccgacatcatacaaaagctaggcctgcctgctggcgtcattaactttgtttatggtctgggaccggaagtgggacaggagctggcagcaaatcctaaggtcggtctggtgagtctgaccggaagcgtcggtgcgggcattgccaccatggaagccgcggctaaaaatgtcaccaaagtgtcgctggaaactgggtggcaaagcccctgccatcgtgatggatgatgccgacctcgagctggctgtgcgggcggtcgtcagctcgcggatcattaacagcggacaggtctgcaattgcgtagagcggctctatgtgcaggaaggcatttacgatcgttttatcagcgcactgaccgccgcgtttcagcaggtgacatttggcgacccggccgaacgcagcgatatcgatatgggtccgctgattaatgccgcagcacgggatcgggtggagcagaaggtggcagaggccgtcgccgcaggggcgaaagtggttctgggcggcaagcgcgccggagacagaggcttctttttccaacccaccttgctgactgaggtgcgccaggagatggcgattatgcaggaggagatttttggcccggttctgccggtgatgagttttaaaacgcttgacgaggcgattacgctggccaacgactgcgagtatgggctgacctcctcgatttatacgcagaatctgaataccaccatgaccgcgctgcgaaagctgaagttcggcgaaacctatgttaaccgtgaaaacttcgaagcgatgcagggatttcatgccgggtggcgtaaatcgggtgtcggcggtgccgatggaaaacatggtctggaggagtatctgcagacccatgttgcctatttacagttcagttaatcactggctcgatcttacctcctcccgtacctgacgttgtcagtaccagagtgggccagtaattggcccactcttttatgccacccgcttactgcagcgcagcagcgcgatgccactcagcaccgccacagccatcaggtagtatccaggcgccagactgctgccggtggcggcaatcagcatgctgcaaatcagcggtgcaaacccgccaaataccgtcacggccacgttgtagctgatcgccatgccgctggcgcgcgtggtcgccgggaagagatcggccatcaccgacggcaccgtggagaaatagaccgacttgagtagcgccatccacgccaccagcaggatcagcgtggtgggcgtagtgtgatcgaccatccatttgaaggcgggatagatcgtgaccatcaacagcagcagcgatccccacatcagcggcaatcggcctatccgctccgcccacaatcccattatgggcgtcaccaccgtcaggataatccctgcgaccagcgtggcggtgaaggccaccgatcccggcagatgcagcgttttggtggcgtaggtcggaatgtaattgagcatgtagttgaccgcggtcgagatcaccatcaccccaatcgccagggtgatcagcgctttctgccgcccgaacagcgttttcagcggtgcggcttccttctcctgcgtcgcaaagctggcgggctcctgcacgtgacggcgaatgtagatccccagcggtccaatcagtaagccgaaagcaaacgggatacgccagccccacgcctgaatctcgctttcgctcagccagtgtgtcagccccaggccgaacgccgatgccatcagagtactggcgccctgtgtggcgaactgccagctggcgataaaggctttgcgctcgggaaagtgctctaccaggaaagcggtggaactgccaaactcgcccccggcagagaagccctgaatcaggcgcgccaggataatcagcagcggcgccgccagaccaatagtggcgtaacccggcataaaggtaatgatcgccccgcccagcatcatcagattgattgagagcagcagcgcttttttacggccatgacggtcggcatagttgcccagcacgatggcacccagcggacggatcaggaatgagatgccgaagctgccgaaggtcagcagtagcgacaccgacggatcgctgaccggaaagaagacgtgcgcgatgtagctggcgaagaagccatacaccgcgatgtcgaaccactccagcgcgttaccaatgcaggtagcgaacagcgttttgtgcaggctcggtttcacctgcggagtactctgtgcgatgctgctcattgttcacctctccgccactgatggtggcgcgacatcagttgttcgccctcttcacccagttgccagaaaaggcgggtcatgatcgccagcccttcacgtgcaacagaggtgagcatgtgttcgttaacgccgtgctggccgcaggccggataggaatggggcacccacagcgtcgggaggccgaggatatcggcaaatacctcattgggcagtgaaccgccgagattgggcaacagcgccggttttttaccgctgctgcgggccagcgtgtccagcgcccaggccaccagcggatcctgcggatcgagtcgcgttgcaggtgaaccgcgcataaactctacgctgacgttatcgaagccgtgctgatgcaggtgactttcgacatgccggaccagattttcccagtcggtgccgaccacaaatcgcagctgacacaccgccgtggcgctgccgggaatggcgttcatcgggcgcgccgggttaccggtttcaaacgccagcacctccagcgtgttccagccataaagacgctccgcaggcgtcaggcccggttctccccagccgtcggccagcgccggatcgcccggcatgccgcccacctcgatatcactgaggatggcgcgcaccgcatcggtaagggagtccggtttcagtgcggcgacctgcaaaacaccctgtgcattcaccaggcaggcgagcgcattcgccagctgggtgccgggattgctcagcaatccgccccagttgccggagtgataggcgttgtcgcgcgccctgatagtcagacgaaagttcgccgcgccacgcgaacccaggaacagtgtcggccgcaccgcgttcagtcgcgggccatcagaggcgataaagaggtcggcctgtaacagcgcccgctgctgctgacaaatctccgccagccctggcgagctgatctcttcacccatttcaaacaggattttgcagttgaagcccagtgcgccaccgcgtgcctgccacacctgctccagcgccgcgagattgatgcagtgctgtcctttgttatccgcactgccgcgcccatacaggcggtcatcttcagccgtgagtcgccaaggtgataaaccgtcgcgccagttctcatcgtcgccgaacaccacatcgccgtggccatagcagagcagcgtcggtctggagggatcttcaatgagcgtggcaatcagaaacggcgggctgccgggctgcggattctcaaacgggtgcagcgtaaagcccatcgccgccagctgcgggccaatctcctgctgcagatagctctccagctccacctgcctgctggcgtgctggctttcggtcacgcaggaaattcgtcgtgccagcagctgctgaaactcgccactgtcgaaatagtgcatcgcctggtcaacggtctgttgctctgtcatgtttgccctgtctgttctttttatcgtgctttatctttgacaaacttctctctttgccacaattattaatttatcgagtgagccttgcttttaaagcaagccacgcctgcccttttatgatgcgttttgccggagtgaccatgttaagcagtgagatccgctatttcctggcggtcgtacagtgcggatcgctcagcgccgccagcgagcagctctttgtggcggtgtcggcgattagtcgccagatccagcgcctggaaacgcaggtgggtgtgccgctgtttgagcggcatgcacgcggcatggtattgaacgaagccggtgaaatattcgcgcatcatgtgcgcaagagtcagctcgatatggaatatgcgcttgcggagattaaggggctgaaagcaatacggcgcagcctgatccgcatcgcctgtaccgacggaatggcgttcagtctgctcccgggtctgctggcggagttccgtcaggccaaccccggcgtgctgtttgcgcttaacgtgacgcactctcagggcgtggcggcatgcgtcagagctggtgaatgcgatgttgcgctgcagttcagtctgcaaccggagcgcagcgttgaggtgctcggctcgtggccggcgccggtgttactggcgatgcatcagtcacatccgctggcgtcgcgtcaggtgacgctggccgatctgcatggctggccgctggcgttgccaggtcagcatactaccgtgcggcagttgtttgacctctcctgtcagatgaacgactgcgtggtcgagccggtgctgacctgcgactatttcgctacgctctaccactttttgctgcataccccgcaggcagtaaccatttgcagtgcgtttaccctgttgtttgagcgcgacacgcaaaatctggtgttgcgttcgatgggggtggatcagctgagtcagcgtacgttgcagcttcagacggtgtccggccgccagcggaatgcggcgctgacgctgtttctgcattttttgcagcagcggctaacggagatggatcagcaggtgaggatgggatgaggggtacagggttgtgggttaaccagctcggtaccagattgccatgtgattcaggttgctaagggaatatgggttaacgtcctggctgcttccgtgagagggtgctggctaaggaacacgggttacgtctgcaccgattcgctgtgagagggtgccggcgaagggaacacgacccgatcggaaagtcgcaaaagccgacctccatggcatgcccggcccgcgcgattacgcacctcatccctgaggtgcgcccgtagccgggccaacgcgttgcgttgttcaaaaacgctcccggtgtttttgtccatggcgcgggacgctttcctcttcggggcatgttcccttcgcattgaacttatttattgctgtcggttctttttaagctgagccagacagcagaggcccacatgtgtatgcgcccctgctgatagctgttaccgtttactgcttaatatcaacctgatagaagatgtgtttgccgaacggatcgacctgatagccgctgaccgatttgcgcaccggctcaaagatggtggagtgcgcaatcatcaccgcaggcatctggtcatgcatcatctgctgtgcctgcagataaagcgcggtgcgtttgccctgatccggctcggcgcgggcttcggtgattaacttctcgaacggctgatagcaccattttgaagagttggaaccgccctgtgccgaggtacagctgtaaagcgggccaaagaagttgtccggatcgccggtggcggtggtccagcccatcagtgccgcctgatgctcgccgctgcgcacgcgtttcaggtattcgccccactcatagctgacgatattggctttgatgcccactttagcccagtccgactgaatcatctccgccatgcggcgcgcattcgggttgtaaggccgctgaaccggcatcgcccagagcgcaatttcggtacccggtttcacacccgcctgttgcagcagggctttggccttctctgggtcgtagtcgtaatctttcagatctttgtcggcgctccagacgcccggtggcaggatatttttcgcaaccgtgccggtgcctttaaaaatcgcctcgattattgccggtttgttgatcgccatcgccagcgcctggcgcactttgacgttatcggttggcgctttagtagtgttaaacgccaggaagccggtattcagacccgccttctgttccagggtgatatccgggttagcgcgcatcttttcaagatcggcgggattagggaatggcattacctgacactcgttcttctccagcttggcatagcgcacggaggcatccggcgtgatgctgaacaccagccgatcgagcttcgccttgccctgccagtagtccaggaacgctttgtagagaatgcgggaatctttctgatactgcaccagctcaaacgggccggtgccgatcgggttcatatcgaccttctccggcgtccccgctttcagcatcgcgtctgcatattccgccgagtggatcgaggcgaagtaccaggcgagatcggcaaggaaacggcgcttccggatgggacagcgtaaaacgtacggtgtggtcatcgacccggtcgatacttttaatcagcgtggagagctccaggctttcgaagttggaataggtgccgccagagacattgtggtagggatttttagggtccatctggcgcataaacgagaagatcacatcgtcggcgttgaagtcgcggctgggtttgaaggctttattgctctgaaacttcacgttcttgcgcagatggaaggtgtaaaccgtgccatccgggctgatttcccagcgttctgccaggctgggcaccaggttggtggtgccgggcgtgaagtccaccagccggttgaagaccggcaccgcactggcgtcaacgctggtccccgaggtatagagctgcgggttaaagttctctggcgatccctcagaacagaagaccagcgttttggcgttaacgctgccagccagcgctatcccagccgtaacaagcgctaaggtggctatcttgattttcattattatcctcgctttgtattgacttccggtgatcacaatatctaaatgaatcattcagatgcttcattgatagcacgattcggcaccataacgaaccccgccggtggctgactaataaggaatagtgatgacagacaaacttgagtcgcagctcacagaacgttttttccgttacctcgccatcagcagtcagagcgatgccaaatccaccaccctgcccagcacgccgagccagcacgccatggcggaactgctggcggatgagctgcgcgcgtcagggctggatgaggtggtgattgatgagcatgccacggtgacggcggtgaaacgcggcaaccggcctgacgcgccgcgcatcgggtttattacgcatatcgataccgttgatgtcggtttgtcgcccgatatccacccgcagatcctcacctggcagggcgaagatctctgtctgaatgcagagcaggatatctggctgcgccgcgatgaacatccggagatcgtgccctacgtcggtcagcaggtgatcttcagcgacggcaccagcgtgctgggcgcggacaacaaagcggcggtcaccgtggtgatgacgctgatggagaaccttaacggcgaccacggcgacatcgtggtggcctttgtgccggacgaagagattgggctgcgcggcgcgaaagcgctggatctggaaacgcgctttaatgttgatttcgcctggaccatcgactgctgcgaactgggcgaagtggtctatgaaaacttcaatgctgccgctgcagaaattgtgtttaccggcgtaccggcccatccgatgtcgggcaaaggggtgctggtcaatccgctgctgatggcccatgactatatcagcctgtttgatcggcagcagaccccggagcacactgaaggccgtgaaggctatatctggttcaatgagattcaggccaacgccagcaaggcgacgctgaaggcctcaatccgtgattttgatctgaccagctttgcggcacgtaagcagcagttgcagcaggcagcagaggatctggcggcgcgttaccccaccggcaaggtgagcgtgggtatcagcgatacctacagcaatatcagcaatgccctgggtgaggatcgtcgggcgatagacctgatcttcagtgcctttgccgcgctggagattgagccgaaggtgattccgatgcgtggcggtacagacggtgccgcgttgtcagccaaaggtctgctgacgccgaacttctttaccggcgcgcacaacttccattcacgcttcgaatttctgccggtaacgtcgtttgtgaagtcctatcaggtggcggaaaaactctgttatctggcggcggaataagcggaggaatcgggcgcagaaacgcgcccgattgcgattatggcttcgcgctgacatcaatgcctgggaaatatttttcagccagctttttgatggtgccatcgccctgcactttagcaatcgccgcatccagtgactgcttcagctgcgcatcatctttgcgcaggccgtagccgatgcctgaaccaagaatcgcgtcatcttcgactggcttgccaacaaaaccaaagcctttgccctgcggtttatcgaggaagccagactgaccggcagcggacatcaccagtgtgccatccaggcggcccgcgaccatgtcgttgtaaacctggttttgatcctgatacgaggtcacggtcacaccctgcggctcccagtgcttcttggcataggtttcctggatggatccctgtaatacaccgatgttcttgcccttcagaccttcggcggtcggtgccagattttcaccggtcttcgccactaacatggtcggaatacggtagatcggctgcgtaaacgcaatgcttctggcgcgcgcttcggtgatgttcatcgccgagttaatggcgtcgaactttttcgcctgcagtgccgggatcagcgcatcaaaactgctctcaacccagtggcagctgaagttgcccgccttacagatggcattgcccagctcgatatcaaagccttccagttcccctttagcattgcggctttcaaaaggcggatattgtgactccacgccgtagcgtaaatcctgtgccagtgcctgtaccgatgtcatcatgcccagagcgagaaaaagcgcgttcagtttcttcattatgtcatttaccccgaaaagtcctggttacctgttccccgagctgcctcacgcggtggcgtgaatcagcgagaaaaagcacatagcgcagccgcgccagcctcaagtgtcgcctcgtctttagcaaaagagagccgaatcagtttgttatctgtgccatccatataaaacgccgacagcggtatggtcgccacaccgtgatcgacgataagacgttttaccatttcactgtccggttcgtcactgaaatgtccatagctggcgagcataaagaacgaacccgcactcggcagcagccggaacggggagttctgcatcagggcgatcagccggtcgcgcttctgctgatagaaggcgctgagcgacagatagttctctggcgtctgcagatagtgtgcgaaaccgacctgcatcggcgtatcggcggcgtacatcataaactgatgcactttcaccagctcagtcatcagctctgccggtgccagacagtagcctacccgccagccggtgacgtggaaggttttgccaaacgaagagacaatgacgctgcgggctgccagttccggatgcgtcgccatcccacaatgcgggcggccatcaaacagaatatgctcgtaaacctcatcggagagcaccacgatatcggtgttgcggattaaggctgccagctgattcaggtcgtcgggggtcagcacctgcgcgctggggttatgcggcgtattaataatgatcatccgggtgcgcggcgtgattgctgcccgcaactgatcccagtcgatagcaaatgacggcacctgcaacttcaggccaatcggtttaccgccctgcaaccgcaccaccggcgcgtagctgtcaaacgccggttcaaagaagatcacctcatcgccctgatgaaccagcgcggtaatcgccatatagagcccctggctggcgctgccggtgatcagcacttcactggcggcatcatattgttgtccatagagcgcctgcactttgctggcaagcgcgtcgcgtaaggcgggcaagcccatcatggcggcatactgattatgtccttcctgcatcgcgcggctgactgagtcgaccagcgccggatcacaggggaaattgggcgcgccctgcgacaggttaatcgcctgatgctgcgccgaaagctggccaatcacgctgaaaatagtggtgccgacgtccggcaattttgagtggatagcgacaggcgttttcagggacatactctctccgtcaggggcttaaccgctcagatgcggtaaatagctattcaacgggctgcgacttgagtcggcaagcgaaatgtcgtcataatagccatgacaaaaatgcatagctgaggttcaccgtgtcacgcttatcgctgccgcttaatgccattcacgcctttctggtgaccgcccgacatctcaatctgacccacgctgcccgcgaactttgcctgacgcagggcgccgtcagtcgtaagattgccgccctggagcagtggctgggcgtgacgctgtttgaccgccacgcgcgcggtctgcgcctgacccctcagggcgcggcgctgctgcccgacttacagcagggttttgagctgatggttcaggccagcgagaaggtccgccgtagtcaggtcagcattcgcctgaaagcgccaacctgtgcgatgcgctggctggtgccccggctgatggcgctggagcatcatcgtcctgaactgcatgtggccctgaccaccacgctggatcatgccgcgcagctggagaacttcgatgtggcgattgtctatggtaagccgcaccctgacggaatttgcctgttcagtgagtcgctgacgccagtgatggcagccgatcaaccccgcccggactccccggcggcactggccacaatgacctttttgcatccgacggcagatacgcgtgactggcagtgctggctgcaggcgcagcaggtgacactgaacatgaagcggaaccagcattttgccaccatggacttagcgatcagtgcagcgattcaggggtttggtgtggcgatggccgacagcaatctggtggagagtgatatagccagcggcaggctgattaagccgttcgctggcgaggcaaaaaccggtgcggtttacagtttactgaaacggcccgcgcaggatgcgccaccgttcctggcggagctggtggcgtggctgtgcagggatcagaaggtgacccagtcgccgttatccgccggtttagcctgaggcgcattcagcacggttgctttcggcgcggcaggtttattcgtgatgaccggtgcggtctggcggttgctggagagacggaacttcgacacagaagcctgcagcgcttccgtctgcaatgccagtgcgctcgccgcggcagaaacctcttcaaccagtgaggcgttctgctgggtcacgctatccatttcggttaccgcagcacccacctgagagatgcctttgctctgctcttctgaggcggaagcaatctgtttcatgatcgcatcaacatcctgcaccgatttcagaatattgttcatggtgccgccggtggtgctgaccagctcggcgcctttacctacacgctgaaccgaatcttcaatcagcgtcgcaatctctttcgcggcattggcgctgcgctgtgcaaggttacgcacttcagaggcaacgaccgcaaaaccccgcccctgtttcgccagcacgtgccgcttcgacggcggcgttcagcgccagaatattggtctggaaagcgatgccgttgatcacgttagtgatttcagcgattttcttcgagctgcctgagatgccatccatagtgctgacgacttcactgaccagctgaccgccacgttgtgccgtggtggtggcggtttctgccagcaggctggcctggcgggcattatcggcgttgaattttaccgtggccgtcaactgctccatgctggccgcagtctgttcgagcgcagcggcctgctcttcggtacgtgaagagaggtcgttgttaccggcagaaatctctgcggcaccgcgcgagatattctcagtgccgctgcgaatggcgctgaccgcttcacgcaggctatcctgcatggcgctcagcagcggcaccagtttaccgacgcagttgcgtccgaaatcggataccggctgactcaggtcgcccgtggcaattaccgcgaagtgggtacgaatactttccagcggacggaccagcatcgccaccagatagcggtcggtaaacagcagaataaacaggccgataattaccgtgatggtaataatcgttttggtcatcgcggtgagatgatccacttcaacccgggttgcatccagcttttcagctgcgccctggctgaatttctctgcgctgatgccaaaggcacgactgagtggcggcgtgacgttattagcctgctgacgataagcatcaggcgaggcctgacgggccagctgcaactgtggcgtgacgcccgcatccagcagcttttgccagctctgaatcaccccatccaccacatccgggttcatcgggccgggtgccagttgtttaaagcgcgccagttgctgggtcatgctgtccagcgcctgctgcaccggagcataagcctcatcgttcagggtctgacctgcggctttgctttccatcacgcgggataagcgcgtgataacacgaaaatattgatcgttgcctttgctcagcaccgtcatttgctcaaccagatgacggtccacatcattcccttcgctgagcgcgccaagagagtgaatgctatacagcccgacgccgctccacagtaaacaaaacagtcccagaatagagagcatcactgcgcgaatggtaaaatttttgagcattcccataccaaaatcctatacacgttgacccgcaagcgtcgggcataggaggtttatcggcatgcgattgtgaagatgtaactgttttgttacctaatattttacagcgtccctaaggcaaatttcactttatagcctttttattcagcaggttaacctttaaaaagcagattaattccattcgcgcaatttgatggttagcaggctaaccatgagccactccttaaagcctgaccatacggctcattaatagccggaaaagccgcatacgggcgcgcataaagttccgcttcagaaccagcccgctcttccgattatcaccaagtgacatcgtcacgtcagagcccgggtgccaggctggccacacgacttccccctccagctgatgcttatattccgtagcatcacgggcaaaggtaaaccagtactcgctgacccgtgccgcaaatgcccgatcggcctcactgaagggtcgttcttcgttgggatccggcatctgactcagcgtgttcagcacataaggcacttcgttgccgtgccaggtgccgtgcggatagaggtcacgggcatgttcagagacataatcaaaccagtagcgccagcctggcattccggcattgtgctgcgcccgcatcaccagccacggcaccaggctgaaggccatatcgcgcgccacggcacgtcccagccgctgatcgtcatgaatgtcatacatccatttcagcgtccggtaagtgagacgatttttatcgcgtagctgatgcaacactgcggtggcatccacgccaaaatattccagcacgctggcttcatcgctgttgctgcccgccatcagcggcagacggtgctgttttgcagccataaaggttttcagcatcggctcaggcagaacagcgtcacccgcaatcggcaccggcgggatcgccagcggcccttccagcgaccagaaggcatcggcaggcagtgcgcgcaggtcatcagcgctggcatcgggcggcagaccgaaatggcgggccaccgccataccctgctgacgcgcttttttcagcggcgtatcaggcaggctgtaggcgctctgcacaatccctttatgaaacagcccttcggccagtggcgaaacagcagagtgacagcacgctgcgtgcgcctgaggattcaccgaaaagtgtcacattgcggcggtcgccgccaaaggcaggaatgttgcgctgcacccactgcagtgcggcaatctgatccagcaggccaaaattgttgaccgtgctggcaacagggtattcagcatccagggccggatgagagaagaaaccgagatggccgagccggtagttgagcgtcaccaccaccgcgccgcgtgaagccatcggcttgccgttgtaaggtgccagcccgccagcaccaatggtgtagccaccaccgtgcagccataccatcaccggcaggggtttcacgggcgcgacatcgggcgtccagacattaaggtagaggcagtcttcgctgaactcacccggatcgccaccgcccacggcctggcaataagtgcgattttgccagccggaagccccaaacgcggtggcgtcgcgcacctgctgccagggcgtaaccggctgtggcggacgccagcgcagcgcgccaagcggtgccgccgcataaggtatgcctttgaatacgaaaaggtcatcgtccatgcatccacgcaactccccctcagcagtcatgatcctcagacctgtttcgtttttcattcctgtttccctgttcaaacgtccctccattatttgcaggcccgccagcattgtccaggtacggaagggatttgcagaatatgccgaagcgtgaggggcaggcgtgaacatgctcatcaacaggttcagagagtcagttacggttatgattcaacgttgtttatcttttcgcaattggtcaatgacgctgccagcgccggagtggcgcgtcgttgctctgttatcacgtgcggttgtgcggctgttaatcagtcagcctgctaatagattaagatactcacgcgggtaaacctgcgctgagcggtaaagcgttgtttttccccagtcctgtcagcatattacccgcgttgccccacttcaggtccactggccttagcagggcgggtgcggagaaagcgttgcgggcaacgcgcctgttgcccgcagaggcgtcagtctggccgtaagccgcactgcgccagcgagcgctgctgccgctctccgtatagcgccatctcatccagcacgacagcgcccagcgcggcttcaaatgcctggcggctcgcctgtcccgccgaacgaacctgcgtccgatcgccgaggttggactgaaaaatgcccgccgcgctgacgggcagaaaatcttcgtagatgatagggtctgccagcacacgaccttcttcgatgagggtctccagcgattcaccctgagccggcggcgtcgcgatgcccttttcactcaggcgaaaatggaaccaggccagctcctgctggcgcagcgtggtttcgtcgtcggggaagtcacggaaaattgccgccagatgttgctgatgctgctgattatcctgaccgctgcccgcctcgctgagtagccgatcgtagagcgcacggccttgaggcgtcagcgccacgccgcgctgctcaatttcaccgaagcgtgcagtatgggttccctgatgcccatccttaaagatgatcggctcttccagcgctttaaagctggtctgacgtaacaggatcggtacctgacgacgcggtggtccctcgatcagggttttcggatcgataccgcgcgacggcatcagttgctgtacgcggtcaatatcgagcgtgcgcggcgtgagatggttgatgtggcagccgggaaagcagactacgtcagcgatcagccgatgctgctggttcagcgcctgataggtctgactgtccacgctgctatgggcatgccagcggaaggtttccagtgcttcggtaacaaactcagtggcctgctcgtcggttaatccgccctgctgctgatgcagttccagaagcgcccggcaacggggggtgaaaatgtcgcgcgcggcaagaatctccgccgctttttcacgcagcgcgtggtcgtcgattagttcagggcgtaacagcgaggtaaagacccgaaagggattgcggcgcaacgccgcatcggtgatcggccggaaacgccgtggagtgaaccggcacaccagcctgagagagatcgtaatagccaaccgggtgcattcccatcaccgcaaacagctgccgcagtgtggctaattcgtctgccgtgcccacacggatcgcaccgtgacgttccaggttgagtcggtcgatctcatcggctgcggtgagacgatctttcagcgcgatatccgcttccagcgcgcggtcgttgacggtcgccaccagttgcatcagcgtgccatattgtggcacttcctgctgatacatagctgacatcgcctgagagaaacgggtgcggatgagatccgcactgagaaagttgtccatcttatccacctgacaccgttagcgttgctgctaatgtaatgcaacacgctggcctcagcggaaaaaatcacgaatctgtgatcggcttaaagccgtagcggttttttaacagcagcatcagggtggtgatcacagccggtattgccagcagcagaaagattacgctgaaagaccatccaagagacatcatctctgcgccaacaaaggcgcttaaaatcgcgccgatgcggcccactccatgcatccagctggaaccggtagcgcgggcgtgggtaggataatagctggcggataaggcattcataccggtattggccccgttgaaacagaagccactgcaaaaggcgatcgcactcatcatacccacttccgcgggtgaaaagcccagtgccacaataaacagcccgccgcagccgtagatcgccgccagggccaggttagcgttgaagcgatccatcatccagcccgcaaacagggagcccagcgtcccgccggcctgatacatcgcggtgataatcgccgcttcggtcactgacatgcccagggtgttgaccagcgacggcagccagctgccaatcaggtaaaccatgaacagccccataaagtagctgccccacagcatggtgctgccaaacagatagcggcgtgaaagtacggtgcctatcgcgccgctcaccggcatggtggcctcaggcgcgtgaaacgcacagtcgggcgcggttttgcccggcatcatccggtcgaggatggcgtgaatgcgggcagccggtgcgccacggctgataagaaatcgcaccgactccggcaggccgcggatcagtaatggcaacaccagcagcggcagaataccgcccagcagcagcacggagtgccagtcatagcgcggtaacagccaggaggcagcaaatcccccgctggcggcaccaaaggtaaagccgcagaacaccaccgtgatgataaaagcccgccgccgctcaggtgcatattccgccaccagcgtgccgacgttgggcatcgccgcacccagtcccagcccggtcaggaaacggaacagcatcatctgctcaatgttttgtgacagcgccgttgccagcgtccagagaccgaaaaagaagacgctgaggataatcatcatgcgacggccatagcggtcagccagcggtcctgcaaccatggcacccagcgccagcccgattaacgctgcgctgatgacgaccccgagctgatgattactcaccccccacgcggctttcagtgtcggcgcaataaatcccatgatcgcaatgtccatgccatcgagtgccaccacgataaaacagagcgcaatgagccgcttttgccagtggctcagcccctgctggttgataagctggcggacatctaccgcctcgacgctggtcaatgaacactcctctggagtaacgaaatctgacatcagtttaagtaaaaaaaacggcgctaatgatagccgatcgttaaccttaagcggtcagatttttatatgatattgagaattattcaactttaagctgttaagttattgatataccgtagtcagaggatggcgtatttcagcggcatacccggctgagcgctttttaatcagagagttaaagggtaacgcggtcatttcgactcgtttgttaaaataaatttgcagcaaagttaacagaattcattttaaacagttgcctgaagccggtcattctcattaagtttaggatatggaaaaaaatatccttttcaatcagcgcattcgcttgcgccatctacatacctttgttgcggttgcgcagcaaggcacactgggccgggcggcagagacgcttagcctcagccagcctgccctttccaagaccctgaatgagctggaggagctgactggtgttcgtctgtttgaacgtggccggctgggcgcgcagctgaccaccatgggagagcagtttctgacccatgcggtacgggtactcgacgcgctaaaccatgccggacagagttttaatgagcagccgggcgatgcgccggtgattatccggctgggggcattgaccactgctgcgatggggatgctgccacgcatcctggatcgttttcatcaactgcagcccaacaccaccattcaggtggcgacacttcacaataatgtgctgctggcgggcttgcgcggcggtgagtttcgacatcggcattggccggatggcggacagcgccatgatgaccgggctgacctatgaattgctgtttctggaatcgctcaagctggtggtcaggccggaacacccgcttttaagtgacaacgtcacgctttcgcgtgctatgcagtggccggtggtgatatcgcccgagggcacggctccgcgccggattgcacagcagatgctggatgaacagggctgcacccttccgcctcactgcattgagacctcttcgacttcactggcacgccagctggctcttcgctacgactacatctggttcgtcccttccggggcgattaaagaggatctgagccacaacgctgtttgtgcgctgccgatcgcctcttccgggccgggcgaaccggtgggcatcattacccgcaccggcgcagaaactgagcctgagtgctgaagtgctgatgtccaccatccgtaagtttcacagttagcggctgcgtttcgcatgccgctcgcggttttcaagccgggctttatcggttttgcgcaatccgacataaagcgccccggccccgccatgacgggtctgggccacgcaaaaggtctgtacgtcatcaaactgctttagccagcgcgccagatagctgcgaacaatgttggcatgcgattcatcatcacgacctttaccgtggatgatcagcagattgcgcaatccctgtttgtgcgcctgcatcataaagttaaagagcgcctgacgacaggtttcgaccggttgccgcaacaggttgaggctggcatccagctgatactctcctctgcgcagtttatccagaatcccctgctgaatgccgtcggctttatattccagcggggtattgagtggaacgatctccagatcgccccgggtcaggaaattctccagctccgattcacctggcggttttcgtggcgccttcgttgagggtgctttaagccacaaggttgtggtggtgtcttttaacggcgtgacatcgcccatggcatcccgaaagagatcattatcatcaaggttcatggttttctcacacctggttaaaattgatggaatgtgcaaatcacgctttacccgttagcgtagcaaaagctggaatcaccggcccaccccactttttcgaaagtcactgccagtgcagaagcgtgtgacagatcacataagcggaaagttttcttgacagtcggccctgtcgggattctgagaagcccgtcacatcagcgtttgtcgttgtgtgcttagtccataatatttgtaagtgtaaaactgctcggatgagttcccttcagcacaaaaaatgttaaaattgaccccagtcaataatcgtcgagcaaaccattatgatccctgaaaaacgcagcattcgtcgtattcagtcgggcggttgtgccattcactgccaggattgcagcatcagtcagctctgcatcccctttacgctaaatgaacatgagctggatcagctcgacaatatcattgagcgtaaaaaacccattcagaaagggcaaacgcttttcaaagcaggcgatgaactcaagtctctgtatgcgattcgctccggcaccattaaaagctacaccatcactgaacagggtgatgagcagatcaccggtttccatctggcgggcgatttagtcggctttgacgcgattatgggctccagccatcccagctttgcgcaggcgctggaaacggcaatggtgtgtgagatcccttttgaaacgctggatgatttgtcgggcaaaatgccggccctgcgtcagcagatgatgcgtctgatgagcggtgaaatcaaaggcgatcaggacatgatcctgttgctgtcgaagaaaaatgctgaagagcgcctggcggcgtttatctggaacctttcccgtcgttttggccagcgcggcttttcacagcgcgaattccgcctcactatgacgcgtggcgatatcggtaattacctgggcctgacggttgaaaccatcagccgcttgctggggcgttttcagaagtccggtatgctggcggtgaaaggcaagtacatcacgattgaaaaccatgccctgctggaagagctcgccggtcagagccaccaggccgcctgatcctcagccggatcaataaatcttattttgttgatccggcagtaactttttcacttcttccgctgtgcaacataggctatctttattccagtcgctctggtttaaggagaacgcctcatgtcccagtaccaaaatgttctggtcgccattgatgcccagcaagacgatcagcccgcgctgcgacgtgcggtctatctgaatcaacgtcttggcggaagaattaaagccttcctgcctatctatgacttctcatatgagatgaccaccctgctttcgccggatgagcgcgcgtcgatgcgccagggcgtgatcagccagcgtaccgaatggatccgcgagcaggcccgcgcttatcttgatgccggtgtcgaaattgatatcaaagtgatctggcacaaccgtccctatgaagccattattcaggaagtgctcgcccatcagcatgacctggtgctgaagatggcgcatcagcacgatcgccttgagtcagtgattttcactccaaccgactggcacctgctgcgtaaatgcccgtgtccggtgtggatggttaaagatcagccgtggccggaaggcggtaaagcgattgtcgcggtcaatctagccagcgaagagccgcatcacgatggcctgaatcagaagctgattcgtgaaacggtgatcctggcggaaaaggtgaatcagaccgaagtgcatctggtaggtgcttatccgattacccctatcaatattgctatcgaactgcccgattttgatcccagcgtctataacgacgcgatccgtggtcagcatctggtggcaatgaaagcgctacggcagaagttctcgattggtgaagagttcacccatgtggctaagggcctgccggaagaggtcatccccgatctggcggcacatctgggagctggtgtggtggtgctgggcacgattggacgcaccggactgtcggcggcattcctcggcaatacggcggaacaggtgattgatcatctgcgttgcgatctgctggcgcttaagccggacgatttcaaatcgccgattgacctggatgatgaagaggatgaggaagattaatcctcctcagaaacagagagggcggctgattagccgccctttttttattacagcgctttgagaatcgcttccacgctggctttggcatcgccaaacagcatctggctattctctttgaagaacagcggattctgcaccccggcatagccggtgttcatcgagcgtttgaacactatcacgttgtgcgccttccacacttccagcaccggcatgcccgcaatcggactgcggggatcatcctgtgccgccgggttgaccgtgtcgttagcgccgatgaccagcaccgtgtcggtgtcactgaaatcgtcgttgatctcatccatctccagcaccacgtcataaggcactttcgcctctgccagcagcacgttcatgtgacccggcagacgccccgccaccggatggataccgaagcgcactttgatgccaagcgcacgcagtcgggcagtcatttccgcgaccggatactgcgcctgcgctaccgccatgccgtagcctggtgtgataatcaccgagctggaagccttgagcatctcggcggtctcttcagccgtaatctcacgatgctcgcccgcttcctgactttcatcgccactgctggcttcagtaccaaagccgcccgcgatcacgctgataaacgaacggttcatcgctttacacataatgtaggagaggatcgcaccggatgaccccaccagcgcaccggtcacaatcagcagatcgttgctcaacatgaaaccggcagcggcggcggcccagcctgaataggagttaagcatcgacaccacgaccggcatatccgcgccgccgatcgacgcgaccagatgccagccaaacgccagcgcaatcaccgtcatcagcaagagtgcaaacacctgcacagccgtgctgctggtgttaacaaaccacaacagcagcaggaacgaaaccaccagcgccagcagattcagcttgtgacgatgcggtaacgctaacggccgtgaagagattttgccgcacagtttgccaaacgccaccagcgagccggtgaaggtgacggcaccgataaagataccgataaacacttcgctgagatggatattctccatcaccgctggcaggccaggcgcatggtcgatatagctgttgatgcccaccagcactgcggccaggccaacaaagctgtgcagaatcgccaccagctctggcatttccgtcatttcgactttcttcgccagacgaatgccgatagcgccgccgatgaccatcgccagcaggatccagaccacattaccgctgtccgggccaaatatggtggcgatcagcgcaatcgccataccgctgataccgaaaatattaccccgcttagaggtctcatgacgcgaaagaccagcaaggctacagatgaacagaatcgcagccacaatataggctgcagtgactaatccgccagacatgtgttaccccttacgaaacattttcagcatgcgctgggtgacggtgaagccaccaaagatattgatgctggcaatcagcacggcaataaaggagataaaggtgacccagccaccgtggcccatctgcaagaccgcaccgataacaatgatgccggaaatggcattggttacggacatcagcggtgtatgcagcgcatgactgacgttccagaccacgtaataccccaccacgcaggcgagcgcgaacacggtaaaatgggagaggaagtcggccggtgccacgtttgccaggcagccaaacagcacaatagccagggcgatcagcagatatttacgccacggtgaaacgggcttcgcctcaatcttttctgacggcttggcggcggcagcggcagcctgtggcgcggcggagacctgaatcggcggggctggccaggtcacttcgccatcgcgtaccacggtgacgccacgcaccaccacatcttcgaaatcgacctggatttcgccattcttctctttacacagcagcttgatcagattgaccagattggtgccgtagagctgggaggattgtgtcgccagacggctgggcagatcggtgtaaccgatgattttcacgccattcggcgtgacggtaacctggtcagcgacggtcagcgcgcagttgccgccggtctgcgccgccagatcaacaatgacgctgcccggcttcatgctggcgaccatctcttcggtgatcagtttcggagccggtttgcctgggatcagcgccgtggtgacaatgatatccacgtctctggcctgactggcaaacagcgccatctcagctttgatgaaagcctcggacatgactttggcatagccgtcgccgctacccgcttcctcttcaaagtcgagctcaaggaattcggcgcccatactctgcacctgctctttgacttcgggacgggtatcaaacgcccggacaatcgcacccaggctgcccgctgcgccaatcgcggccagcccggcaacaccggccccaatcaccatcacttttgccggtggcactttaccggctgccgtgatctgaccggtaaagaagcggccaaattcatgggcggcttcgacaatggcgcgataaccggcaatgttcgccatagaaaactcagggcatccagtgactgcgcccgtgagatacgcggcactgaatccattgccattaccgtgacctgacgtgcggccagctttgacagcagttcgggattctgtgcgggccagataaaactgaccagcgtgctgcccgcacgcgtcagcgcaatctcttcgtcatccggcgcattcaccttcagcacgatatcggactgccagacctgctctctgtcgctgagtgtggcaccggttgcgatatagctttcatcatcgaagctggcacgtttaccggcgtcatgctcaagggtgacgctgaaacccagcttgatgagttgttccacggtcttaggcgtggcggccacgcgcgactcgtttggcaacctttccttgggtattccaattaacatagtgtttcctttcatcggttaaaggatgatggcccgaacctgcaccacgagagcgcgactgaaacgcgatttcagccgcttttggacgaaacgcaggtatttcaaagtgtttataacctactgaaaatgtgacgagcgatctacagcgactacgcagagtgatgacattcacccaattatgcagtgttctgttaagaaacctgcgttatcccactgcaaaatagtctcacaggcagataatctgccagagataattgtatccggacgaattaataaacaacaaaaacctttatttaacaacgcattaactattttagcgctaacagttaccgcttttagtggtaactgtcactaaaactggccataactgcgtttgatgacaaacaaatgaaaaaatcatggttgaataacgcgatctgacacaaaaaatcgctgcgacagtctgtttataacatgcaataatcagcggctattctgttatacatcaagagtccagcacgttttcgtactcatttttgcgtaaggcgaaggattatttttatgaagctgaagaacactattctggcgaccactctgttgtccctgctggcagccaacgcattcgctgcgcaggaacttacgccagaaaaagcggccgcgttgaagccattcgaacgtattaatatcaccggccgtttcaacgcaattggcgacgctgccgatgcggtatcaaaacgtgcagatcagatgggcgcggcctcttattacatccaggcgatcaacgacagcaacggtaacagcggtaactggcgcgttacggctgacctctataaagccgatgccccggcagccacagagtcaacgacttaccgtcgtttcaacggcgtaaacgaactgccaaaagcagaagcgtataaactcgaacccttcgataccgtttcggtcagcggcttctttgccagccagccggatgtaaacgacgcaatttcgaaagccgcaaaacagaaaggcgcagcctccttctttatcgttcgccagatcgatgccaacagcggcggcaatcagtatgtcaccgcctatgtctataaagcggatgctaaagagcgcgcggtgcagacaccaaatgcgattcctgccgattcagaagcgggtaaagccgcactggcaaccggtggcgctgcggcggctaacgtagagattccaggcgtggcctcgtctgaaacgccaagcaacaaagtgggccgtttcttcgaaacccaaagctctaccggcaagcgctataccgttaatctgccaaacggcaaatcggtgcaggaagtgaatgccattactgctgcgcagatgcagccgttcgataccgtaaccttcaccggtcacttcggtacgccaactgagatttcagaagaagtggcgaagcgtgcggcggacaaaggtgctaagttctaccacgtcacccgccagtggcagaaccagagtggcggtaacctgaccgtcacggctgacctgtttaagtaatccttctcagggcggcgcctgccgccctgctgtttgcataattcctgcgctgttttgcatagtcacgcattgccatcccctgccacactccgtaaaatccctcgcctgttttaccggatattttccctgtattgtgcctttggtgtgacataacccagcgacagaatccgatttacccagccatatatgctagcgggaaggttgttttggagaaaaaattaggtctcggtgcgctgacggcgctggtgctcagctcaatgctgggcgcaggcgtgtttagtctgccgcaaaatatggctgcagtggccggtccggcggcgctgctgctgggctggctgattaccggcgtcggcatcatctttctgtcgctggcgatgctgctgctgacccgccttaaacccgaactggatggcggcatctttacctatgcccgtgccggtttcggcgagctgatgggcttctgctccgcgtggggctactggctgtgcgccgtgatcgccaacgtctcctatctggtgattgtcttctctgccctgagcttcttcaccgatacgccggaccggattatctttggcgatggcaacacctggcaggcgatgctgggtgcctccgtgctgttgtggctggttcactggctggtgctgcgcggcgtttcagaccgctgccagcattaatctgatggcgacgctcggcaagctggtgccgctgctgctgtttattgtgctggcggtgatggcgttcaactatgatcgcttccgctttgacttttccggcatcacgctggggcaaccgctatgggagcaggtcaagcagaccatgctgattaccctgtgggtctttatcggcgtcgagggggcggtggtggtctctgcacgcgcgcgccagaaaaaggatgtgggccgggctacactattcgccgtgctggcagcgttgctggtctatctgctggtgacactgctgtcgcttggcgtggttccacgtgctgaactggctcagatgcgtaacccctccatggcgggattgatgacccgactgatgggcaactggggcgatgcggtgattgcggtgggtctggttatctcggtgtgcggtgcctatctgagctggacgattatggccgctgaagtgcccctgattgctgcgcaacagggtgcatttccacgcagtatcgcccgacaaaaccgccataacgcgccagccgcctcactgtggctgaccaacggcagtattcagctctgcctgaccctgattgccctgaccggtgcgaactacaacaacctgctgaccatcgcctctgagatgattctggtgccctatctgctggtggggttatatctgatcaaagtggtacgcggacagcataaaccgctggcgatggcgaccggtatcggtgccagcctgtatggcatctggctgctttacgcctcggggccattgcacctgatgatgtctgtggtgctctatacaccgggcctgctgctgtttctgtttgcacgacgcggtggccgcgcagagtttgcgctgacttcgctggagcggattgcaatgggattgctgattgccgcgacgctgcccgccgtgtggcagttgacgacttagcgcctggcccggcaggcgtaatggttgcaggcactccggacccggccagcgcgaagcaacccggcgtacagatagtacgtgaggatggtgagcactgcccaggttcagactgagaaatcagatagcctgatgggaaaggctctcagtgcgactgcgcaggtattgagacacacagcaggtcatcctgctgtgtcagattcagcggtctggaatattcatgatggatcgcgtccagctgctccgccgaaagcggataaggaagctgaatatcgaagcgactaatctgctgttgttccgcaagggtaatcaggcgcgcgatattaatttcgtcgctgacctgagtagaaatgatttgtaatgctaattcttttaacgggtcgtcactgccctgtaagcggtgtgccgatttacgtgtcaccatgccaaatatcggcatcacaccataaatagcatcgacgaagctccagcgctttttgcaggaagcggagagaaagtcactgtaattgaagcagatgcggtcggggtatatggctgatgccagctctttatcagacacactaacgctcctcatgataatcatcaatatcccaaacctggcgcaaaaaggccgcgctaatgattgcacattttgccggttatataccagcaagctacggatatttcgtgcggtaacgtagagctcaggaccaggaaaagatatgcttccgtccatccctgtctctgctttgtgaactatgaacaaaattgtttatgtagaagatgaacccgaagtgggctcactgattgcggcctatctgggtcgtcatgatattgaggtgattgtcgagatgcgcggcgaccgtgctgaagcggtcattgccgaacagcagcccgatctggtgatgctggatatcatgttgccaggcaaagatggcatgactatctgccgtgacctgcgggccaactggcaggggccgatcgtgctgctcacctcactggacagcgacatgaaccatattctggccctggagatgggggcgcaggattacattctgaaaaccacgccgccggcggtactgctggcccgcctgcgccttcatctgcgtcagtcgcagcagggacagccggacgatgcgcccagcgcacccgccgccaaccgtatgctgcgttttggctcgctgaccatcgatgcgctgaaccgccaggtcacgctgtttgacgagcagatcgccctttccaccgcggatttcgatctgctgtgggtactcgccagccatgcgggccagacgcttaaccgtgatgcgctgctgaaaacgttgcgcggggtcagttatgacggccttgaccgcagcatcgacgtggctatctcccggttgcgcaaaaagctgcacgacagcgccaccgagccgttccgcattaaaaccattcgtaacaaaggttatctgtttgcgccccaggcctgggatacccgcggactatgagaaagctttttattcagttttatctgctgctgtttgtctgctttctggtgatggcgctgctggtggggctggtctacaagttcaccgctgagcgtgcgggccgccagtcgatgaatgacctgatggccagttttcgctctacctgattcgcagcgaactgcgcgagatcccgccacgcgactggaataaaaccatcaagagtctcgatctcggcctgtcgttcgatctgcacatcgagccgatgaacaaatatcagcttgatgaaggcaacatgcgtcggttgcgcgccggagagatcgtggcgctcgacgatcaatacacctttttgcagcacattccgcgcagccactacgtattgtcagtcgggccgattccctatctcttctatctgcatcagatgcgactgctggatattgccctgctgatctttatagggatgtcactggcgctgccggtgtttatctggctgcgcccccactggcaggagatgcagcgactggaaaaagcggctcagcgctttggccgtggcgagctggacgtgcgcacccatttcgacagcacctccagccttttccggctcggcatcgcctttaaccagatggccgagaacatcaatacgctggttgccagtaagaagcagctaatagacggtattgcgcatgagctgcgcacaccgctggtgcgcctgcgttaccggctggagatgagcgacaacctcacggatggcgaacgggtggcgctgaatcgcgacatcggccagctcgaaagcctgattgaggagctgctgacctatgcgcgtcttgaccggccgcgcgtcgatctcaatctgaaaacactggatttggccaactggctgcgcgagcggcttgacgatttccgcactatcaatcccgacgtgcggctcgaccttgagctgccgcagcgtgaaaacatcggcatttctgatacgcgcctgatggagcgggtactggataacctggtcaacaatgcgctgcgttatgcgcaacagcggctgcgcgtcagtttgtggttcgacggtccgatagggtgtctgcaggtggaagatgacggtcccggcattccgcctgaagagcgtgagcgggttttcgaaccctttgtccggctggaccccagccgcgatcgcgccacaggcggctgcggactgggacttgcgattgtgcactctattgcccaggcgctgagcggcaatgtgaccattgagtccagtccactgggcggcgccagcgttcgcttttgctggccggttgatctaaccttgcgggaaattccgctgcgttaaaaaccacaaggagtcttacgtgacctcagcgtatcaacaacttaccaagacgttccagcgcctttcccgtttcagtcacgtcacggccatcgccggatgtgacatgcaaaccaccatgccgccgggcggcagtcaggcgcgtggtgaagcgctggccgaaatgagcgtgttgcagcaccagatcctcactgcccctcaggttggtgagtggctcagggctgcagagcagcagtcactcaacgatgttgagcgggccaatctcaacgagatgcagcgcgcttaccagcaggccaccctgctgcctgatgattttgttgaagccaaatcaatcgccggttcggtatgtgaacatgcatggcgcactcagcgtccggccaacgactggcagggcttcgccgccaatctcaaagaggtggtgcgtctgagccgcgaagaggcccagcgccgcgccgacgccactggctgctcgcgttacgatgcgctgctggatctttatgagccggggatgacccgcgcccggctggatgaaacctttggcgaactgaaaacctggctgcccgctctgttacagcaggttgtggaaaaacaggcgcagcagactgttgtcacgccgcaggggccgttcgccctgcctgctcagcgtcagctcggcctgagcatcatggaaacgctgggtttcgactttaaccatggccgtctggatatcagtgcgcatcccttctgcggtggcgtgccggaagatgtgcgcattaccacccgttacaacgagaatgagtttctcagcgccctgatgggcgtgatccacgaaaccggccacgcccgctatgagcaaaatctgccgcagcagtggcgcggccagccggtggcgctggcgcgctccaccgctatccacgaatcacaaagcctgtttatggagatgcagcttggtcgcagccgcgaattcctgcagcgcattctgccgcaggtgatcgccacctttggcgaccagcctgccctgcaggcggataattttgtgcgcctgacccagcaggttaagcctggcctgatccgggttgacgccgatgagctcagctatccggcgcatgtcattctgcgttatgaaatcgagcaggccctgattgaaggcgagattgaggttgaggatattccggcgctgtgggatgagaaaatgatgcagtcgctgggtctggatacccggggtaactaccgcgatggctgtatgcaggatatccactggaccgacggcgcctttggctacttcccgacctatacgctgggcgcgatgtacgccgcacagctgttccgctcggtacatcttgcgattcctcagctcagcgagctgattcagcacggtgagctgcagccggtattcgactggctgcaacagaacatctggcagcacggcagccgtttctccaccgaccagctgctgatcaacgccaccggcgaagcgctgaatccggctttcttccgccagcaccttgaacaacgttacctgaatagctaagctctcgggcggtcagctgaccgccctttcccgcctttgtacaatcggttacacgccgataccaaacacccacggacaccgttcattgatatccctatagtctcttcaccggccccgcagtgggctacacatgaaaaaatagtcttcgagggatttgcaatgaaaaaattatttgcactggttgtcgccgctgctatgggtatgtcttctgttgctttcgctgctgacaccacagctgctccagctgctgcgccagccgcaacaaccactactaccgctgcagcaccggctaaaaccgttcacaaaactgcgcacaagaaacaccataaagcggctcagaaagcgcaggctgctaagaaacaccacaaaaaagctgtgaaaaaagatgccgcgcagaaagcgcaggctgctaaaaaagttcaccacaaaaaagtagctaaacctgctgcacagaaagctcaggccgctaaaaaagttcaccacaaaaaagtcactaaaccagctgctcagaaagcccaggccgctaaaaaagttcaccacaaaaaagccactcagccagccgctcagaaagcccaggctgctaaaaaagttcaccacaaaaaagtagctaaaccagctgcacagaaagctcaggctgctaaaaaagttcaccacaaaaaagttgtgaaaccagcagctaaaaactaaggtcgccttcagcgcacggccacgagatgatgattaaaaacacccggttctgccgggtgtttctttactggagtggatgatatggtgcgtcgctatcgcttcgaaattattctgctggtgatgatcctgtgtggcattgttgcagcaagcttttttgtttagccgctgtagcgtactgattaaccaataaaactccctttttcaacgctcaccgactatagttaccgtacttacgtaataacaataacgttaattttttctcgccattgagatttctatgcgcctggctaccctgttaatggttggactcttcagctttgccaccacggttcatgccgatgatgacgatgactcgcctactcctgctgaaattaagatgctgttcttcggcaaggatcatcgccaggcaatcaccgatattaccgctgccccctgggatgccattggtcagctggaaaccgaaagcggcaacctctgtactgccacgctcatctctccgcatctggcgctgaccgccggacactgcctgcttgccccgccgggtaatttcgataagccggttgcgctgcgatttatggcgagcgataaaggctggcgctacgagcttcatgatattgatgcgcgggttgaaccctcgctggcgtcaaagttaaaagcggacggtgaaggctggatcgtgccgagcagtgcagccccctatgattacggcatcgtgattttacgcaatccgccctccgcgattacgcctattccgctgttcgatggctcacgcagcgaactcactgcggcgctgaagctgaccggccgcaaagtaacgcaggcgggctatccggctgatcatctggacacgctttactctcacagcgattgcctgatcaccggctgggcgcagcgcgccgtgctgtcgcatcagtgtgacaccctgccaggtgacagcggtttcgccactgctgctcaacagcgataaaggctggcagttaatcgcggtacaaagctcagcaccggcagcgaaagatcgctatctggctgataaccgcgcgatttcggtcacttcgtttaaagataagctggaatccctggcgcagtagtccgcactctcactcgccatcatcggatgcgcgcctgttacggcgcgcatcccggcgtttaacccgctatctgctccatcatctgcagaatacgcttatctgagatgggataaggcgtacccagctgctgagcaaagtaactgattcgcagctcttcgatcatccagcggatgctctgcacctcttcatcatcctgacgctgcggcggcaacttgttgcgccacgcctgataagcctgttccactgcctgtacttttaacatccgcgcacgatcgctgtgcggatcggcaggcagtttttccagtcggcgctcaatcccatgcagataacgcagcgtatcggccagtcgctgccagccgttgccggtgacaaagccgcgataaaccaggccacttaactgcgctttgatgtcagataacgccagcgccatggtcatatcgacccggcccttcagacgcttattaatgttgaagactgccgtcaggatctgctcgacctgcttcgcgatggtcaccacggtttcattgagttcgcctcgcactttgtcacgcaactgctcaaacgaggtttgatcccaggccggaccgcccgcttcccccatcagcttgtcgatgccacaggcgatgcagtcgtcaatcagctccagcactttgccataagggttaaagtagagtccgagcttggctttgttcggcagcttctcgtgcagatatttaaccggtgacggcacattcagcagcagcaggcgacgctgaccgcgccacatcattttttgctgctcctgctcgctgtcaaacagacgaatggcgacgctctctttctcgtcgaccagcgcaggccaggctttaacctggtagctgccgcgcttctgttcataactgcgtggcagatcgccaaaactccagatatgcagcccactctgctccagcccgtcatccgccactttcgacagcgtttcctgcactttgtctttcagctgtgccttaagcgcagtgagatctttgccttccagtagcttacgattgtgctcgtcgactacccggaacgtcattttcagatgatcgggcacctgttcccactgccagttttcccgctccagcgtgacgccggtcatgcggcggaattcccgcgccagcgcatcaggcagcggcatctccatcgctttcacccttcctaaaaacgcctcggcgtagttgggcgccggcaccaggttacggcgcagcggcttgggcagagacttaatcagtgcgatgatcagttcacggcgcacaccggggatctgccactcaaaaccgctatcctctacctggttcagcagcggcagcggaatatgtaccgtcacgccatccgcatctgcgccaggctcaaactgataactcagcttcagtttgaggttgccctgatgccagaagttggggtagtcgagctgactgactttatccgcgccctctttgatcagcatctgcttgtcgaaattcagcagtttctgcgttttcgcgactggcctgtttccaccagctgtcgaaatgcttcgctgagaccacctctttgccaatgcgctggtcataaaaagcaaacagcgtttcgtcatcgaccagaatgtcgcgacgacgggatttgtgttccagatcttccacttcgctgcgcagcttctggtttgcgcggaagaaggcgtgtcgggtctgccagtcgccctccaccagcgcgtgacgaataaacagttcacggctcagggtgggatcgatgctgccatagttaactttacgggcggcgacaatcggcaggccatagagcgtgactttttcggtggccatcaccgcgccctgcgatttctcccagtgcggttcactgtagctgcgcttgatcagatgctgtgccagcggctcaatccactctggttcaatacggcccgccgtgcggccccacaggcggctggtctcgaccagttccgccaccatggtccacttcggcggctttttaaacagcccggagccagggaagatcgcgaagcgggtattgcgcgcgccggtatactcctgcttatcggtgtctttctgcccgatatgcgacagcagaccgcttaacagcgcgcagtggacgggctgcagctcagccggttcactgttaaccggaatgcccagttcacgcaccacctgccgcaactgggtgtagatatcctgccattcccgcacgcgcagatagttaaggaaatcgcttttgcactggcggcggaaaacattcccggacagcgctttctgctgctccgccaggtagttccagagattcacataggcgaggaagtcggagtctttgtcggcaaagcgccggtgcttctcatcggacgcctgctttttatctgccggacgctcacgcgggtcctgaatcgacaggcctgcggtgataatcatcacttcgcgcacgcagccaaatttctgcgcttccagcaccatccgcgccaggcggggatccaccggcagctgcgccagctgacgcccggaaccggtaagcttgtagtgaccggtctcttcgttcagggtcagcgcgcccagctcttccagcaggcggacgccatcctggatattgcgcttatcgggcgcttccacaaacgggaaggcggcgatatcgccgaggcccagcgaggtcatctgcaggatgactgacgccaggttggtgcgcaggatttcaggatcggtaaaggccggacgactcaggaagtcatcttctgcgtagagacggatacagataccgtctgaaacacggccgcaacgccctttacgctggttggcagacgcctgtgatatcggttcaatcggcaggcgctgcactttggtacggaaactgtaacgactgatacgcgccgtaccgggatcgatcacatatttaatcccaggcaccgtcagcgaggtttccgcgacgttggtcgccagcacgatacgacggccactgtgcgactgaaacacccggttctgttcagcgtttcgacagccgtgcatagagcggcagcacttcggtgtgtggcagatcgcgtttgttcagcgcgtcggcggtatcacgtatttcacgctcaccactcatgaagatcaggatatcgccccgactttcccggcccagctcatctacggcatcaaaaatcgcctgcagctggtcacgatcgccatcatccgcctcttcgatcaccggccgatagcgcacttcaaccggataggtccggcctgagacttcaatcaccggcgcattattgaaatgacgcgagaaacgctgtggatcgatggtggcggaagtgataatcactttcagatcggggcgacgcggcagcagctcacgcagataaccgagcaggaaatcgatattcaggctgcgttcgtgcgcttcatcaataatgatggtgtcatattgcatcagcagacgatcctgctggatctccgccagcagaatcccgtcggtcatcagtttaatctgcgtcaggtcactgacctggtcgttaaaccgtactttatagccgacgcagccgcccagcgaagtgctgagctcatcggcaatgcgattcgccacggtacgtgcggccagacggcgcggctgcgtatgaccaatcagacccgtcacaccacgccccagcgccagacagattttcggcagctgcgtggttttacccgagccggtttcaccggcgacaatcactacctggtgatcgcgaatcgcctcagcaatatcctgctgcttctgactgacaggcagattgtccgggaaggtaatggctggcgtggccgcacggcgctgggccacgcgctgctcggcagcgataaagtcctgctcaagctcgctggcaatgccctgctgtgcctcggggtttttagcttttctggcaccctgtaaacggcgctgtaaccgctggcgatcgcgcagcattacaccgtcgaggcgtgaccagagcgctgccagtggggaagtatcgggagatgacataatagtgacgtaccttactcagacggtgtcgctgcctgaagcagcgccctgcaagccgggataaccagctgattcaataaaaaataattgcgcgcatcatagcacattctgaactgttccggcggctggccccggttacgcttattcaataaattcgaacatgggtctcgaaatattgcgctttcaccgcgccatcgataaccgtagagtgtaaaccattgagcggaaagtcttccgcgtaacagacaggaaaccaccatgagcaaagttttagttctgaaatcaagcattcttgcaggctattcacaatcaagccagctcgctgacttctacatcgaacaggcaaaggcccagggtaaagaggttaccgtacgtgacctggcggctaacccgatcccggtactggatggcgagttagtgggtgcaatgcgtccctctgataccccgctgtcacctcgtcagcaggaggctctggacctgtctgatgaactgattgcagaactgcaggctcatgatgaagtggtgattgccgcgccaatgtacaacttcaacatcccgacgcagctgaaaaactatttcgacctgattgcccgtgctggcgtgacgttccgctacaccgaagcaggcccggaaggtctggttaaaggcaaaacggcagtcgttatctcgagccgtggcggcattcataaagataccccaactgacctgctgaccccttacgtcaagctgttcctgggcttcatcggcatcactgacgttgagtttcgtgtttgctgaaggcatcgcttacggtccggaagtggccagcaaagcgaccgctgaagcgaaagacgctatcaagcagatcgtgacggcataagtctcactcatctcaggatgacgctgtaaaagaccgggccatgcgcccggtttttttcgccggttactgactgctctctgccgtttttctcagccactgaccgttaatgccgcgcacatattcccccgctgccgcacggctcaccagcttctgtccggcaatactggcgacatcggccgtggagagattattctgttctgccagtcgctgatactcctgctgacgtccggcattaatacgctgcaccagtgccagcgtttcactatcctgcgcacgtgccgccagatagccggagagcgtttcacctgctcgccccgattgccgcgcctgatccagcgtcagtgcccaggcaggctgcgccatcgtcagggcgaggaacagcaccgcgcttatgcgtttcatcgttgctctcctcagaacagaccgctctggtttttcaatagcgcttccacgtctttatcgactttgatgtggatctcatgttcgattttcacgttcatgttgatggtgatgggatctttaggtgccgtgacttcaatgcgcggcacgcagccgatgctcagcagtccggccgccagaaccagtagtgccctcaggctcatggtgaagtgtccttgttggatggcaaattcgcatgttgctctaaccaggattgcaaattatcgccaaagcgcaggctgcgccagagctgaaacaggttttcctgatgatgatagttgagattgactgtctgacgacggttactgaactggctgacgccctgcacctgcgcctccatagtgaggtcgccaagattatccagattgatcgtggcccagctgcgggagacttccatatagcgtaaccagtccagcgcggcgcccgtcgccacgttattgcgggtaatcgcatccgccatatctttatccagccggaaggtcagcggaccgctgttggcaatccaccctttctccaccagccagtgtggattattgagccacagcggcagctcaccgttgaccttgcccgacatggcaaactgtttaggtttcagcgccgtcaccagctcgctgaggctgatattgcgcagcgacacccgggctggctcatgctgtggcatgcgcaaagcgggcagcgtaatttgtccgcccagcagatcaaggctgacatcctgcaacgtcagcggcgcctgttcagaccacggccagttaccctgcaggtcagcgcgaatattctgcatcgcaaactggttcttaacctcggcaatgcgcagtgataccgggccatgctgaccaaactgccattgctgctcatggaatctgaacggcagcgagaagtcgataccgttaacctggctgtcgggcgtccagatgctgccctgttttaccgtccagtggcctcccgcctggaaaccctgttcacttgcggcggaaaaagcgacctgtgcctgcaaacggccgccctggatctgcattttcatgtcggggctgagcaacggctgaaacaccgtcagcgactgtgccggccaccaggcctggccgcgcagccgtttcgccatcccagcggccgttaacccgcagcgggccaaccttgcccgcctgtaaactgcctcgccagataaaataaccgggatcacgacctttagcctcaaagtcgagcgtggaatctgccagatgtccgccatagctgaagcgggtctctcctgcctgcaggcggaaatgcccattgaacgccggatgcgccgcatcacgctgccagtttaccggtttagtcagtgtcagacgcggttttgcaacgttgacactgccatacgccagctgattaaaaccggtggacaaggtatccagatggatcagggtgtcgtgccagccgcccgtgcctttaacatcccagcgcgcctgcagcggcagcatctcgccacctccccagtagcgccagttccattcgcccttatcgggccagaaatcattggcgcggccatcgagatgcaaccggaagcggccaaaactggcatcgtgcgcattcagaatggcctgcaggcggccatcaataccctgcgaggagagtcgtacgcccgccagcggccagcgcgcttcgtccacttccagcgttgacagcaaccggccccgcaggcgcagcagcgatttaggttgcagcaccagttgaggatcgagcagcgagccgctgagcacgcccggaatggagccgtaaagttgcaggtcggccagcttgctttcgccggttagctgaaacggcaggttgctgttggtcaggctgagattgccgggcccgacgccgagcaccacgttgcccttgccgccgcgcccctgggtcagcaggttaacgcgaccgctaatctggctactttcaaggccagactgccagttatccagcgtcaggttaacaaaccctgatagcggctgagcctccagcggccagaagtattcgcccttttcaatccgaatctgatcgcggctgatctgccacggcagtctgagaagcggcctggtcacttcggccattgccacgcgtagctcgccctgctgctgctgccagttaagcgtcagcttcaggggatgcggcagcgcgtccagcgccagctgtccggtcacctcgccgttcaccggcagatcggtggcaaaggtgggtaacgccagatgaccactcagcgtgacaggttcaggaagtgcaggatgggtgagcgtcaggcgactgatagcgagctgctgaccggtcagcgttgccgccagctgcagattatcgccctgataactgagttgctgacgatctttttccagcgtcagatccagcgcgcccgcatacgtctgccacggcgtaacgattaatttgcccagatgaacgtcggcgccaggcagcattgcctgccattcggccagcgttttgggggctgccgtgctgccatcactggccggtaatttttgcaggcaggtgctatccagcgtcagctctgacgcattcagtttccagcgcgactgatgccagcccagcgataccccctttaccgttgccagggagcaatcccctgcgagataacgaagttgtggcaaccacaggccaccctcccgccagcgcggtgcgcccgacagctcaatgcgggtatcttcaggtagccagatgccgaccagccgcggcagccattgcgtgacagtcaagatcaggccgagcagcagcagaatcagcgccagaatggcggccagccgtcgccggaacatccgtggcataaaagccataatccttttccttacagtatcctgacaacgatgatggcatgtaatctgccagaggtgaaggtctgcgccggacacaagtcagctgtttcagcaaagtcagtcagaaaacgttatccttgctctatcacctctgcaggagcacaacgatgaaaatcgcggtttacagcaccaaacattacgatcagaaataccttgagcaggtcaatcagcagttcggctttgaactggtgttttttgactttttactctctgaaagcaccgccaaaaccgctgtgggttgcgatgccgtctgtatctttgtaaacgatgacggcagtcgcccggtgctggaagagctggccgggctgggtgtgaaatatatcgcgctgcgctgtgccggtttcaataatgttgatctggctgctgcaaaagagctgggtctggaagtggtgcgcgtgccggcctactcaccggaagcggtcgctgaacatactatcggcctgatgatgaccctgaatcgccgtattcatcgcgcttatcagcgtacccgtgacgcaaacttttcgctcgacggcctgaccggttttaacatgcataacaaaaccgcgggtgttatcggtaccggtaaaatcgggatcgcgacgatgcggattctgaaaggttttggtatgcggctgctggcgtatgatccctacccgagtgagcaggcgctggaaactgggcgcggaatatgtcgatctgaagacgctgtttgctgaatcccacgtcattaccctgcactgtccgctgacgccggagaatcatcatctgctcaacgccgatgcgtttaaacagatgcgtgatggggtgatggttatcaacaccagtcgtggtggtctgattgattcacaggcggcgattgacgcgctgaaacagcagaaaatcggcgcgctcggcatggatgtttatgagaatgaacgcgatctgttctttgaagataagtcgaatgatgtgattcaggacgatgtgttccgccgtctgtcggcgtgccataacgtgttgttcaccggccatcaggcgtttttaaccgccgaagcgctgaccgccatttctgaaacgacactgaataatctcagccagctcgaccggggtgaaaactgcccgaaccggctctctgcctgactgtgcgggccggagcaatccggcctgatcatcagcgcgcgcaattcccgccaattaacgcctgctcatcacagcgacggccattcactaactgacacatccccactcttgagccatccagctgatgcgaaaatgccagcgttccgcccgcattcgaacaggtgctttctgccagggaagacatcaccacccgtggctggatgtgggcggcggtggcttgttgcggtggctcgttatcatcactgttgctgctgcaggcagagagtaataacgcggcaccggccagcaaaaaggtggctgctttcatcagtcggactccgggaagtaggggaaaaggctggctcagcatatgtcaggcagcacaacgggtcgagaggtgaaacagctttttacaaaattctccggcgtcatttgcaagcagaattatcttgtttacctgttatcgctgaactgtcaccctttttcggcccttattaattcggagtaaagccatgttaatggatatgttaattcgcatagcgctggccggtattctcggcggcctgatcggcatggagcgccagatgcgggccaaagaagcgggactgcgtacccatattctggtcggtatcggcagtgcgatgtttatgctggtatcgaaatatggcttcgccgatatgctcaatagtgaccatgtggcactggatcccagccgtattgctgcccaggtagtcagcggcatgggtttccttggcgcaggcaccattatgattcagaagcaggtggtgaaaggcttaaccacggcggcgggattatgggtgactgcggcgattggtctggtgattggcagcggcatgtatgagatcggcatttatggcacggtgctggcgctggtggtgctggaagtcttccgccgcctgagccattttctcatcggtaaacatcatacgctgctggtttttcttaagcccaaaagtgtgccgctggtgctgctggtcatgcagcgggaaggcattcgctatggcaatgtgacggtgattaatcgggatgaggagagtggtctgtgtgagctcagcgtttcaggtaacgctgtcccgcaaatcaaacgatgctcacctctatgataaggtcatggagatcaaaggagttcagtcgctggagatgatgtaaattcctttccataaagatcattcctgctgaacacaggccggtcagcgccaggacgttgcagaagggggttatccgtactcactgccttctgccctctccatcagattcatctattatcataatcatgcagcctgacctgagatatagagcccgccgggaattaatgtcataatccgtgattgtttattaaggtaacaatttatacggtgaaaaatgcgccagaactctgaccatcgtgacgaaaccctgtccgcttctgtacgtaaaagtagctggccagtactaagcatgcttatctttacgctgattgcgggcgctatggccatcatgatgatcctggatcatcgtaattccgtaaataatgcgcttgagaccggacagtgtctggtgggggaaggcgctgaaagtttgctggaagtgctcagacattttttacatcatgcttatcgctggatttttaaagcctgtggctagcaataataaattcagtgcagcaggaaatgcagtaatccgtgtcggtttaccagcaacaaaacgccgcaatacatgactgcaacatagcagagtaaaaagagtatcagcgtcaatataaatcggacaccataattttttatatcgtgagtgtttaccggatgtctcatcgaatttaaagtttgctccgtccttattcacatatatagccagcaatttaacgatttgtttcgctgcccgcattaccatgatgtgcggaacgatgaagtcacagctggtctctcaggaaaaacagttatgagtgtaaaaattaaagccgccctttttaattttcacattcactttaatggctttaatttcacccgtctgttttgaaaagcaacagctttggacgtggcgatatgtgccagtaaaatcgattcagacttaatgggatacaaaaaaacactgatacctgtgcatcttacgtattcccaattataacccggcagtgtcaacgcatattcaacagcagcgtttttcagattcaggcgttaatgaaattaacagtgcatcaggatatttaactccctgcgaatttatagcaacaattcgaaggaaattctcaaatcagataagcataaaaagaacgccgtttatgcatgattgattaatagtggtgcatgctcttttttttgttaactggtcgctctgatgaaatatctgttaattatctcaatcatttttatgactgcgggttgtgcggcaaaaaaagagaatgcgcgggctgatgcttaccaggcatcactgccatcctgtttctgcgcacaatgatgaaatcgattgccagtggaaagatgtgccagccagctgacatcgtatagttgaacgctatccgtgacacatcagcccgcaattattgagtaatgacctggtaaggcctgccctcttttttcactgagtaccgccgcatcgatttacgtcgctgctcccttaacgggtagtctctgccggattccccgggcggctatccgctgattacttcactccagtactggcattcgcggcaacaatccgtaccatacgctgcatattcgtgacaccgcagtgaagtgtctggctgaacgcgcacggcaatttgccctttagctacgctttctggattttgagataggtaaaaatgcaagataatcaaacggttgacaagaaagaacagtacaacctcaataaactgcaaaaacgtctgcgtcgtaacgtcggcgaagccattgcagattttaatatgattgaagaaggcgaccgcatcatggtctgcctgtcgggcggcaaagacagctacaccatgctggaaattttgcgcagtctgcaaaaaagtgcgccggtcaacttcagcctgattgccgttaacctcgaccagaaacagccgggcttccctgagcatatcctgccggaatatcttgagtcgcagggcgttgagtatcggattatcgaagaagatacctactccatcgtcaaagataagatcccggaaggcaaaaccacctgctcactctgctcgcgcctgcgccgtggcattctctatcgcgtcgcaactgagctgggctgtactaaaattgcgctgggccaccatcgcgatgacattctgcagacgctgttcctgaacatgttttacggcggaaaaatgaaaggcatgccgccaaagctgatgagcgacgatggcaagcagattgtgatccgtccgctggcttactgccgcgagaaagatatcatccgcttctcagaagcgcgtcagttcccgattattccgtgtaacctctgcggtttctcagccgaacctgcagcgtcaggtggtggccgatatgctgcgtgactgggataagcgctatcctggccgtatcgaaaccatgttcagcgcgatgcagaatgtggtgccgtcacatatggcggatatcaacctgttcgattttaaaggcattaagcatggcgatgcggtggttgacggcggggatctcgcctttgaccgggaatctctgccgctgcagcctgttggctggcggggtgatgaagaggatgccccggataccagtgcgcgtctggatgtgattcagattaaataagtgctggaaaggttaagggcgtgctgctggcagcacgccctttttttatatgttgcggtgcggtggtggatccattatcggcggaaattccggatctgtcggcggatcaggctggggttgtggctgaggaataggctcaggaatcgggatcggatccgtggggatcggctcgctgttaagaatcgcgctcatgccgtactccttttgttgcgaatggactttaagcttaggtaaggaacggcgttacagccaggcgggcaaaaaaaaagccggcacacgggccggcatgtttcgaattaaatgtgctatgcattaattctaaattaggaagtaagacaatatggagcgcaacgcccatcgcttgacgttgcattcacctgcgggagagagtttgcgtcagcagcgacaatgggttcttgatgtcgatcagcttttgcgtcctttacgggattttcagcgcagataaccgatacgctacggataacgctagagccagcgccgtttgcgcaggtaccccgctaccccgacggccagtgccaccagcagcagacagaagatagagaaaccgtatcgccattcgccgccaggaataccgcccaggttgacgccaaacaggccggtcaggaaggtggctggcagaaaaatcatcgccatcagtgacatggtataggtacggcggttcatcgactccgccatcgcagaagcaacctcatcagccagaatcgcggtacgcgccacccctgcatccagatcatccagcccgcgtcccagtcgatcggcgatttcctgcatccggcgccgttcgctgtcatccatccaggccagtttttcactggccagccgcgcatagacatcacgctgcggcgccatataccgccgcatcacaatcagctgtttgcgcagcaggccgagttcgcctcgtgccggcatccgctggtcaagcagcgcatcttccagctcaatgattttgtcatgtaaatcttcgataaactcgctggtgtgatcggtcagggcatcacagatatcgaccagccagctgccgcagtcaatcgggccgttaccattctgcaaatccgtgaggacttcatcgacggcagaaactttacgccgccgggtcgagacgatgagcttatcgttgataaatacccgcatcaccaccagctggtcgcgacgcgcatcgctgttgtggttgacgctgcgcagcacgatcataaagccgtcgcccagccggctgacgcgtggacgcatactgtcgcccgctaaggcgtcacgcacggcatcagggatctgtgtcgtcgactgcagccattccgcgctcttacggtgggtatagttcagatggagccagcagggctgctcacactggatgacttcatcttcagcaatcgggatcatcccgcccttgccatccagctggcaggaaattatggcatctgaaacctgtaacgcttttccttcaattacgtccacaccgtcgcctcactactaaaatcaatacgatacagtctagcgtgacggtgttgagttgcaatctccgggctgtgtagaaagatgtcagagggtggccggttgaccggccacctgcactcagtgcttttcaatccacagtttcgcgactgtaggcgacatcttcagggttagtgatgggatagcctttgacccagggtttaatcaggcggccattggtgtactgatagatgggggcgatcggggcctgctcagccaggatctgctcggcacggttgtaatcgctgttacgtacctgatcgctggtctcccggctggctttggcgataaccgcatcataatccgcgttgttaaagcgcgcgatgttgctgctgttgcccgacgtcagcagattaaggaaagtggagggttcattgtagtcaccgacccacgaggcgcggatcacatcgaagtttccgctgttacggctgtcgatataagttttccactcctggttctctagcgtgacatccacacccaggttctttttccacatcgaggccacagcaatcgcaatcttctggtggctctcagaggtgttatagagcagcttgagtttcagcggcttgccgggaccgtaaccggcagcagcgagcagcgatttggcctgtgcattcaggttgttctgatcgtgctgttgcatgaacgtgggcaatggcttaaagcctgctgtcacatctggcgtaaagtgccacgccggtttctcaccggtgcccagcactttttcagcaatcactttccgatcgatagaccaggagagcgctttgcggacccgcacatcggccgtcggccctttctgcgtgttaaacgcgtagtaataggtgcctaactggtcaggtgtgtagacctctccgggcagagttttcttcagtagcgcatacatgtttttcgggaaggattcggtgatatcaatatcgttggatcgataacgtttagtggcgctcgactcttcattaatcggcacgaaagtcactttcgtcagcaccgaatgggcatcatcccagtagtgaggattacgtgtcagtacgattttttcgttcactacgcgttcgctgagctgataggccccgttgcccaccagtttgccgggtgacgtccagctgtcaccctgttgcgcaataattttctgcggcacggggaaaagtgccacgttagccaccagcgccgggaaccacggcaccggacgatccagcgtcaccttcagctggtttttactctgggcgaccacacccagcttgtcgggcgtcatttcgcctttggttatcgctgccgcattttgaataccgcttaagcccgcgaaccaggcaaaggctgaactgtttttcggatcgaccaggcgctgccagctgtagacaaaatcctgagccgtgaccggatcaccgttcgaccagcgcgcgttattacgcagcgtaaagacccaggttttgttatcgctgctgctccagctctgcgccacgcccggcacgattttgccctgcgcatcctgattggtcagtccttcaaacagatcgcgtatcacctgaatttcaggcagtcctaccgctttaagcggatcgagcgaagcgggttcatctttaatatggcgaacgatctgctgctgttcagccagctgtgcgccagcgggtggattcgccgcgatggcgggtgtgatgatgctgctcatgctgattgctgccagcgtcatgcgaaaggtcttgaccattatcactcctttaccccaaagaagcgctgcatcagtctgttgccgatgcaacttgtgcagggcactttagcgcaaatggctgacagataaatagctattttccgcgcacggcttttccgctacttttagtaaaaccctttgaggaaataactatgtcgccactccatccacgtcccctgcgcggcaaactggacgtcccctatcagcagtatggccgctcagtgctgggtgcgccgctgctctggtttccggcgccgctgggcgatcccgagagcggtttgattctggcgggcactcacggtgatgagaatgcggccatcgccaccctctccgccgcattacggacgctgcctgatggaatgcgtcggcaccacgtggtgttagcagtcaatcctgatggctgtcagctcggactgcgcgcgaaacgcaaacggcgtcgatctcaaccgcaactttccggcggcgaactggcagtcaggcgagacggtgtatcgctggaacagcgctgccgatgatcgtgatgtggcgctctcgaccggcactcatccggcttctgaaccggaaacccaggcgctctgtgcgctgattcatcagctgaaaccacgctggatcgtttcatggcatgaaccgctgggctgtattgacgacccgcatcaggcagagattggtggctggctggccagccacaccggccttccgcgagtcagcagcgttggttatgacacgccaggctcattcggcagctggtgtaaagatctcagcctgccctgcgtgactgctgaaatgccggtgatttcagtggatgaagccactgaaacctacctggagatgatggttaatctgctgcgctggcagcaatgatcagctgaccgttgcgcactttaatcgccggttctgcatccaccgccagccaggtcggcccgtcgagatcggcaaagcgggtctgcggcaccagcggcagtgcggcgcgtatcgcccgcgaggtgcagagcatgcagccgagcattaccgcaaacccctgctgctgagccgcatcggccagcgccagcgcctcggtcagcccgcccgctttatccagcttgatgttgaccatctcataacgacctcgcagtaccgccagactttcgcgggtgtgacagctctcatcggcgcagatgggtaatggatggataaagttctccagcgccgcatcctcacccgctggcagaggctgttccagcatcgccacattgatgtccgccagcagctgacagcgcgccgccagaccttcggcgtgccaggattcattggcatccacaatcagggtcgcgtccggcacggcggcgcgaatcgccatcagccgttcggtaatgaaattattatccagcttaatcttcagtagtgttgccccatgctgccacagcgccagcgcgctgctggccatcgcctcgggagtatcaatgctgacggtctgcgcggtcaccacatcctcaggtgcggttacgccgctaagctgccagaggcttctctgctgctgatgtgcggcgagatcccacagagcgctgtcaatggcgttgcgcgccgccccggctggcagcgcctgttgtaacgcctcgcgcgtcatgccctgttgcagcgcgggcagcagcgcggcgatttgcgccagtaccgacgcctcgctttcaccatagcgcgcataaggcgtcgcttcgccaacgccttttactccgtcttcctcaatttcaaccaccaccactttgacttcagtccgggttccacgggcaatgacaaacggcgtgtgcaacggccaggcttcgggataactttttaccgttctcatttccactccacaatgtgcgacgcagtggcagaccgccacgttaaattccacaattgaactcgtaaacccttaacatttatgtcataaacaacggctatctttagccgttttgtgtcagatcttttttatcattaaaaggaatcactatgtctcagactgttcattttcagggtaacgccgtaccggttgctggtcagtttcctcaggctggcgataaagccaaagctttcacgctggtagcgaaaaacctggtcaacgtcgcgctctctgagtatgcaggaaaacgcaaaattctgaacattttcccgagcgtagataccggtgtctgtgcttcatcggtgcgcaagttcaatcaggctgcaagcgaactgaataacaccgtggtgttatgcatctctgccgatctgccgtttgcccagtcgcgattctgtggcgcagaaaacctgaacaacgtggtgacgttgtcgaccctgcgcggctcggagtttaaatatgattatggcgtggaaattgccgatggtgcgctggaaggtctgaccgcacgtgccgtgattgtgctggatgagaacgataaagtgatctacagccagctggttgatgaaatcaccactgagccagattatgacgctgcgctgaccgcgctgaagtaataaaaaaagcggataaccaggttatccgcttttcatcttctgtttgtcgtttattcgctttcggtgcgcttctgccccagaccatactcccgcaatttattcgcaatcgccgtatgcgacacaccaagccgttttgccagttttcgggtgctgggataggagagatagagccgcgtcagaattgaccgttcgaaacgactggtgatctgatccagcgtcccttccagcgcctcatcgcccagtgacacatccagtgcctgttcaggcaacacaatatcctgcggacgcagttcgtaaccttccagttgggttaacgcccgataaagcgcatttttcagctgacgcacgttgccaggccaggcgtagcgggtcagaaaagcgttaagctgcggcgagagtcgcggacgcgccatcccctgctcatccgcaaagcgggcaacaaacatctcggtcagcggcagaatatcctgcggacgatcgcgcagaggcggcagttgcagcgtcagcacattgagccggtaaaagagatcctcgcggaattctccgcgctgcaccagctcaatcaggtttttctgcgtagcgcagattacccggacattgacatggacttcatgctcttcaccgacgcggcggaaggtaccatcattgagaaaacgcagcagcttggtctgcattctcggcgacatctcaccaatctcatccagcagcactgagccgccgttagcctgctcaaaaaagcccttcttaccttccagcgcattcgggtaggctccggcggcatgaccaaacagctcgctttcggcgacgtcatcgggcagagaggcacagttcaacgccaggaagggattcttgccgcgggcactgcgcagatggcaggcgcgtgccagcatatctttcccggtgcctgtgtcgccaacgatcagtaagggcgcatcgagcatcgccagtttacgcgcctgatccaccacctgacgcatcttcggcgtgacagcaatgatatggtcaaactccgattcatcggtgaccaccagattctgcaactgacgacccatgcgggctgtcgacttcagcattaccatcgcccccactggcctgtcgatctggccctcttcgcccggcagataaataggacgcgcttccatcagaaaatcgcggccctcaatgaccacatgctgcgcctgcgcttcaacccgatcgctctccagccagcgcatgaagttgaagccgttaatcagattaccggcgctgaagttgcgcatcttctcttcatcgagattaaacaggttctgtgcggccggattagccagttcaaccttgcttttcagatcgatggagaaaaccggatccggcatcgccaccagcagggcgctcagcgcacgatgctcgcgttcagagggcatgtacgctaccgtgcgcacatctgttacgcccggtgtacgccggatttcagccatcagattgctgaaggcgtcaaattccagtgcagaaaagttcaggtagatgcggcccagcgccgtgatttcgataccgcgtaaatcaatgttgcgtgccaccagcagatcgagcagttcacgcgtcagaccaagtcggtcctgacagaacacttccagacgcattgcgttcgccttaatcaggttcagataagacaataatacgctaagtcgcgcacctgcagaaagggatctgtcaggaaaagttgacagctccggcgcgtatggcggacttttgtactgccggagaaaatcctgatgagtggtcacaaatatttgccgggatggcgcattttatcagggagaaaaatggaatggcctacacgctgccagcggatccggtgatcactgatgagtcgggctgtcggggtgagtgtctggtcatcgactcccgacaggtgctgcgccagccacactaaagaataaaggcggcaatgccgcctttaatttgtcacgagagcgtcaggctgacttattaccgcccttctgcaacgcctctttcaactggcccagcagctcacgacggaaatcgccgagccgtggtttatcctgctccagccacggcagtggacggcacagctccatcgctttgatgcccagtcttgcagtcagcaaacccgcgccaatgccctgcgcggcgcgcgtggaaagacgggcggcaatatcctgcgacatccagtccatacccacttcccgcaccagttcggaagccccggcaaaggccatgttgagcagcaccagacggaacagccggatgcggctgaagtaacccagctcaatgccgtaaatagccgcgatgcgattgaccagccgcagattacgccaggcgataaacgccatatccaccagcgccagcgggctgaccgcaatcatcagcgtggcttcagcagcatgacggctgatttcgcgccgcgcctgccgatccagcaccggctgcaccagttgcgcatataagcggacaatttcactgtcattgtgggtttcgtgcagcgaggcatgccagcgctgcagggccggatgcgcctgatccagctctgcctgctgcgccagtttttcgcagaaggcccggcctttgccgatgccatgactgtgcagcaactcacggcccacatcccgctcctcggcgcgctgacgcagctgatagagacgacgccactcggtggtcagcgcacccacacccgccaggacgatcagaccacccgccacgccgctgcccagtgaaaaccagtcgcgggccagccaggcgtcatgtgtccactggacaccctgcgcaatcacgctgacgccaaacagcagcgcgccagcggtcaccagtttgcgccacaggctgcgcttaggtttcagcgcagcttccaccgcccgttcacctgcgccctcctcttcgacagcgacttcttcatcctgcaccgccagaaacgccgcctgcgcttccgcttcaaaagtctgtgccgggcgcagcggcgtggcgctgctctcatccagcggacgggcaaaatcgatacgcggcttcagcggatcactcatcgcaatttatctcccaataaaaattccagcgcggcatccatgcggatatgtggcagcgggcgatcgacgtcaagctgctgcggccggaactgttcaaactgaaacccctgctgctgccagaaggcattaccgggcagacgcggcgggacttcacccggatagacggtgagcggctcaccatcatccagccggtttccgcgcagggccgggatcttctcgccccggtgatcgaccagcccgctctgcgtcgcctgcaccgacgccagtccgatgcaatccatgctaatcccctcaaacgccgcgtttctgccaggcatcctgcaccagctgctgcaacagtgacaccatattgccgtgctgatcgctggtgatgtgatccgccttggtggcggcaaacagcaatttgtcgattaccggtgaaaagagccgacgaaacagggttcgctgaccgtaatgaaaactctgcatcagctgcgtcagtgccagccgcatatcgttaaacgcctggggtcctctgttaagcggttgcaggcagtcaaccagcacaatctggcggtcaaagcgcaggaaatggtttttatagaaacctttcaccacatgctgacagtagtagttaaaccgctgctgcagcatgctgaagttactgcccttgtccgcctgcgccagcttagtgagttgcgcttcatcagccgtcggccaggggaagaactgcagcgcgggagcgcctgccatatcgccaggcagcacgaagcgaccgggctgaataaagtgtaagccttcagatttgcagcgatgcagatagtcggtccaggcagcggcaatctctgccagctgggtttcatcggcgggtgcaagcgggtcgagtttttcgcagagggttcgccagggctttgcccactcagcacgatcgccctgcagcagaccgttcatctgccgggaccagtcgagataatcctgcgccagcatcggcagatccagcagccattcgccgggatagtcgacaatctccagatagagtgtcgcggtctctttcaggtgacgcagcagcgaatcattgggacgataacgcagcgccaggcgcatttcgctgacgccgcgtgtgggtgtgggccaggcaggcggcgtgctgtagagctgtgccagcccttcgtcataggtgaaacgggccgtgcccatgtcacgctggggtacccgctttacgcctagcaggcgctcatcccgcaccacggaaaacagcggcaaacgcgcgccgctgtgaacggttaaaagctgattaaccagtgaggtgatgaaggcggttttgccgctgcggcttaatccggttaccgccagccgcaggtggcgatcaacgccacggttcatcaacgccatcaattcagtttgcagtcttttcatctttctccctgatgaagcgcgatgccacccggttcatcacgcgtttcagcaatggctcaagcgccacagccaacagcagacgtaacgggcgtcgcgctaccgatttcactgcccagccagtgacaccggcgggaccgtaggtaacagcattaataatgatgaatttagcggccgacttcaatgcaggtgccgcgcggtgacgaaaagcagtggatcgcgaaaaagacatcaacacctccattgagtaagcgaacgggcctgaaacaggcccggcaataacagtagcagaatcaaatctggcggaagcggctgcgcacgctgaaggtttcagacgtcacatagcgttccaggtcgcgcacgctgcgctcatcccgttgcagggtgctctccagctgatccagcagttcactggcactgggctggcgctcagtctgggaggcagaggcgggtttcacatccagtacaaaacccagcacaaagtaggcgatcaccgtaaagagaaacaggccaaagaacagtgataacaccacgatgacacgcagcagacgaaccggaatatcgagatactctgccaggcctgcgcagacacccataaatttcccttcatctggcttgcgccacaacttgcgtcctttaatcatggctgcctccagtttggatgttcagcgtccagaatcgcttccagcgcgtcaatacgttcgcgcatccgctgcgcgtcctgggtcacgcgctgcaggcgctggatttcgctttgcgacagtttccgaaccgccgttgcgtttgttgttgtaatgcagccataaccagatcggtgcgacaaacaacacgaagatcgttaacggtatggcgaaaaaaagtgcgctcattgactctccttaatcacttatcgcaacgtcgatgattactcactgcggttcattttggctttcagcgcattaagctgctcgctgatttcatcgtccgctttcaggtcagtaaactcctggttcagcgtctttggtttaccaaaaccgtggctttctgcttccgcttccatatggtcgatgcgacgttcaaaagattcaaaccgggccattgcttcatcgatcttaccgctgtccagctgacgacgaacatcgcgtgatgaagaggccgcctgatgacgcagcgtcaacgcctgctggcgggcacgtgtctcactcagttttttctccagctcgctgatttcgcctttcatgcgctccagcgtctcttcaacatgacccacttcctgtttcagggaggcgataagatcggtgagtttctgtttttcaatcagcgcggaacgggccagatcatctttatctttgcgcagcgccagctccgctttttcctgccactcagcctgctgaatctccgcctgatcaatacggcgtgacagctgtttcttttcagccagtgcgcgtgcagaggtggagcgcacttcaactaaggtgtcttccatttcctgaatcatcagccggaccagtttctgcggatcttccgcacgctccagcagggaattaatgttggcattaacgatgtcggcgaaacgagaaaaaatacccataatgatgttcctcttttaatgttttaaaacgtgaagtcctgctgagttagtacaaaatgcgtgccaattttatagttaattgatttttatcatattttaaattttacagccctttccgcttgttttaagatagtcaaaatgattaaggggtggcgaaattcatcatgacaggcactagcgataatctcctgggggagtcgaacaattttcttgaggtgctggagcaggtttccaaactggctcctcttgagaaaccggtactggtgattggtgagcgtggaacgggcaaagagctgatcgccagccgactgcactatctctctgaccgctggcaggggccgtttatctcgctgaaactgtgccgcgctgaatgaaaacctgctcgattctgaactgtttggtcatgaggctggcgccttcaccggcgcgcagaagcgacatcttggccgttttgaacgtgctgacggcggcacgctgtttctcgatgagctggcaacggcaccgatgctggttcaggaaaagctgctcagggtaattgaatatggacagctggagcgagtcggcggcaatcactccctgcaggtaaatgtgcgactggtctgtgcgacaaacgaagacctgcccgcgctggcggcggcgggaaaattccgcgccgatttgctggatcgtctggcctttgatgtggtgcagttaccgccactgcgcgaacgacgcagcgatatactggtgatggccgatcatttcgctatccagatgtgtcgcgagctcggcctgttactttttcccggctttaccccacgggcacagcaggctctgcttgattaccactggcccggcaacgttcgcgaacttaaaaatgtggtggagcgctcggtctatcgtcataacagcagcgagcagccgctggataatgtgattatcaacccgtttgcttcacgccctgaaccgattgctgtcatccggaccagtcaggaggcggatagcagcgcgctgcctgccctgccgctggatctgcgtcaatggcagaatcagcaggagcgggatctggtggaagccagcctgcaacaggcacgttataaccaacgccgtgcggctggcttattaggcgtcacctatcatcagttgcgcgcaatgatgaagaagcacgatataaaagcagagagttaattaacgccgccccaacctatgatttttctctgctttgtgaattaacaacccggtataaaccgggctgtttttcacgttgagccacctatccattatgtgttgtgcgacttagtccccattttttcaggttgcctgatggcaggaaccagaccgacgccagcggtagccatcaccacggccagcgctgacatcagcaatacagcactcataccaaagtgtgttgccagcggacccgcgaccagttgtccaaagggaatggcgataaaggaacccatcgcatcataagcgtacacgcgagccagcttatccggtgggatatgagtctgtaatgagtgcgcccaggttacgccgaacaggcccaatgacatgccagcaatgaagaaccctactatcagcagtgctgctgacgcattctggctcagcataaatattgggagtgcgtaaagacctgccagcatcgcgccaatcaagagatcacgacgtggatgccatttcatagccagaaatgaacctgcaattaaacccgcgctatgggcggccacaataattccccatcgtgcccgtccgaaagaggcgtcggcaatcatcgggccaagtaccaccacaatgccattaaaagcgacgttgataatggcgaaactgaaggactatcgaccaaatccagcttcgtccggcgaactctgcccagccttctttgatatcgcgcaggatattgccttgcgaagccgcggctttattcgatttcacacggatcaggaaatagagcggcgcggaaacggcaaaacccatcgcatcaattgccagcccccagcccggcccgacagcgctggtgataattccccccagcgatgcccccattaccgtaccgccataaatcccgagctgaattaacgcgttagcctgacgcaaatccgttgcaggaactacctgcggaaccagcgcagatgatgcgggcagtgcgatgcctgccgccgcaccattcagggcacccagcaaagtcaggctaatgacggttgcagagccatcgagtacagaccaggcgacgatagcctgagaaacagcggcaaccactgccgatgaaactaatacccgactgcgtgagtagcgatcggcgacaacaccgcccaccagcaggaaaagcacgttacacagtgaacgggacgcaaccactatccctaaatcagaagcagacccgccaatatccagtaccgcaaaagccagcgcaatgggtgcaatcccattgcccagcacggtgaacaggcgtccaaaaaagagatagcgaaaggatgtatgctgaaaagcctgaacgtttttttggaatttattcattgccaggaggtgggtgaccagaagatgagcttatagtacctgcgtttttgtaatagttaagtgcggtttaattcaggacccgcttagctaaacgggaggccagcagagataacatcagcattacctcacttttctctcccttttttcatcgccacaccgcattcaaagcgccggctctttcagcagctttcccttccccgtccaggctggcatgccactctgcaaaagccaaaaaaaagcccgccaacaggcgggcaacgatactggaagcaatgtgagcaatgtcgtgctcttctacggcagagctaccgtcgaagcgcagatgaataataatcattcttattatcatctgtaaacaagttattgagaatttttctcattaccacaccttctgtacgctctttttaccgccgcgatgatgaaaatcagtctggcagcggttgcaggttttgggacaatgcccgctttgcgatacactctgtttaatgcctcaaaatcgttgagttctatgtcaaaactattatgttcgctgttgctaagtctcagcgtgttgagtgcccctgcgtggtcagcgcctgcgggtgatatccgccagaccggcttcgtctattgcgtcagcggcacgctgaacacctttaatccgcagatggccagcagcgggctgactgtcgatacgctggcggcacaactctatgaccgcctgctggatgtcgatccttacacctatcgtctcaagcccgatctggcgtccagctgggaagtgcgcgataacggcgcaacgtatcgctttcatctgcgcagcggcgtgcagttccagcagacgaatcagttccgccccacccgtgcactgaacgccgacgatgtcgtgttcagcttcgcccggatgtttgaccgcaatcacccctggcacaacgtcaatggcggcaactatccctactttgacagtctgcaattctccgactccgtgcagagcgtgaagaaaatcgataacaggacggttgagttcaggttaaacagcccggatgcgtcgttcctttggcacatggcgacccactatgcgccagtgctgtcgaaagagtatgccgaccagcttaccgcgcagggccggcaggaagagatggacagacaaccggttggcaccggtccttatcagctcagcgaataccgcaccggtcagtacatccgcctggcgcgcaatcctcactactggaaaggggtgccgcgtctgcaacaggcggtgattgatctcggctcgggcggcaccgggcggctttccaagcttctgaccggtgaatgtgacgtgcttgcctatcccgcggccagccaactcaccatcctgcgcgatgacccgcgcctgcggatgacgctgcgtcccggcatgaacatcgcctatctggcctttaatacccgcaagccgccgctcgaccgccctgaggtacggcacgcgctggcgctggcgatcaacaatgagcggttgatggagtccatctattacggcaccgccgaaaccgccgcctcgatattacctcgcgcctcatgggcatatgataatgatgcccgcattaccagctatgatccggcgaagtcccgtgccgcgctggcggctctgggcatcagcgatctgcatctgcggctggtggtgcctgccgcatcgcagtcgtggaatcccagcccgctgaaaaccgccgaactgttgcaggcggatctggcgcaggtcggcgtccggctgaccatagtgccggtagagggccgttttcaggaggcgcagctgatggcgatgaatcatgatctgacactgtcaggctgggccaccgacagtaacgatcccgacagtttcttgcggccgctgctcagttgtgcagcgattcgctcgcagaccaattacgcgcactggtgctcgccggcctttgacgaaacgctgcagaatgcgctgttatcacaacaactctctggccgcatcgacagttatgacaaagcgcagcagattctggcgcaggagttgccggtgctgccactggcatcctctctgcgactgcaggcgtttcgtcatgatattaaagggctggtcctgagtccgtttggcaacgcctcgtttgccggggtttatcgtgaaagcgataaggaaaagtaagtgattatctatattttgcggcgcctgctgctactgatcattaccctgtttctgctgtcgctggtgagcttcagcctgagctactttacgcctgacgccccgctggaaggcgcggcgctctcggacgcctggtggttctggtttaaagggatgctgcagtttgatttcggcgtctccagcaccaacggtcaggagattggcctgcaactgcgtgaggttttcccggccaccatggagttgtgcatcctggcgtttctgttcgcgctgctggtcgggatcccgctggggatctgtgccggcgtgatgcgcaataaatggcaggacaaaaccatcagtgcactggcgctgatcggcttttctgcgccaattttctggctggcgctgctgctgacgctgtttcttctcgctgacgctgggctggctgccggtgtccggtcgtcacgacctgctctatccggtgcagagtgtcactggctttgcgctgattgatgcctggatgagtccttcgccctggcgacatgagatgataatcagcgtcctgaaccacctgattttaccggtgctggtgctggcgatggcaccgacgacggaagtgatccgcctgctgcgtaacagcaccagcgacgtgatggataaaaattatgtcaaagcggcggccacgcgaggtctttcgccgtttaccgtgatccgccgccacgtgctgcataatgcgctgccgccggtgatcccgcgtctgggtctgcaattttccaccatgctgacgctggcgatgatcaccgagatggtctttaactggccgggtctgggacgctggctgatcaacgcgattcgccagcaggattacgcggcgatctccgctggcgtgatggtgattggcgggctggtgattctggtcaatgtgatttctgacgtgattggtgcggccatgaacccgctgaaacataaggaatggtatgccctgcgctaacgctcagggcgcttaggcaaaacataaaataaacatatgaattttgtctttcagaagtcgtgctgaaagcaggcattgatgtacacgaatattgttcctgcagaaaccgatttaagttcgaagcgtaaaaattaatgaggagatgaacatttatggatgaagttgatctggcacaggagcgtgaagaagcgcatctcgctgcctctctggcagctcgtaaggccaaacttaaaagcccaaacggcttatgcatctggtgtaaagatgagcccgtagtggctgaaactgctttctgttcaagcgagtgtgatgaggattatcataagcatcgccgggagcagagccagcggattgtttgaaagagaatgaagtcacccggtcaggctattacgcgggtgactcagataaacttgatataaatgtcaggcagccctcacaaatataaagcaataaaacgacatcgcttgatagattcttgatatttccttgcctttacgttgataaaaaaaatacataatgccctgattaaaatgtcacagcagagaccatctgtccggagttagtgacaggaaaagatagcatagggtggctgacattcaggagccatctttttaactcgatttatcagaacaactatcaggtttaacattttatatgagccacttcaaaagaatgctttacggctgggaaaaatccgacgctggcatttatgagcactgttttaaccgttttggcgggagtgttaatatgcatcctgacgtgatcaggtttttctcatctcgcacaggtcatgaggcaacgtattttcataaagtaaagcaaggtggctatattgccgcatatgccctgctggatcactcacggataggtgtcgatcaatggaaaaaattcccgctatcttatgatgagattatggtgccagcggctaaaaatgcttctatgtgtttccctgaaagaaccaataaaatgtcacatttcaacaggcacaacttcataaattttaacttttcatttgcccgaaaaaataaagtatgctttgtaaaagagagctattcagttaaaacagaaaaaaatcgccgcaacgaatacaaccggttcatacgtgcgggtggccgctgctgtgatatgaatcaattcagccctgaagagctggcagactattatatcttcctttttaaatcccgtttttctgacagcataacctgttattccagggagaacctgatcacgcttatcaatgccatgaaaaggatgctcttcggctatattctttttgtagggaacgagccctgcgcgatggatctgctcttcatggctgagagtgaacacattatctattttgatgtgccaaacggcggcgttaacatgaaatattcggaccttagtccgggtagtttacttatgtggaaaaacattggtgcggcaagggacttctgtaaacagacgggcaaggagatgaggctttcaatcggttcacttgataaagaatggacgtataagcttcgctgggcggatgcgcactccacggggaaaacaattttttaatctttcttaggaatcaggcttattttctgcaacaaagcggctaaaaattagcacaaaaccgcgcgttcctgaattgccaggcaccaatgaagggtgtttaaagataaaacgtttaatctcagggccgattttaattttttatgcatcgcggtccttccccgccgtcctgtagataataatttgctgcggatacaatccggtaaacctacggcattacgtaagctattaacctctgcctgaaaatggtgtcatcgctgggaaagcagagagagtttttatctgattttttttgcagcatcagtgactcgccagatgccaggaggcataccaaaatgtcgcgagaaggcgcgcgtgaacgtttgctgtgagtcgtagttgaactgatcagctacctctgcaatagtggcttcagtaaaccttaaactcagcgaggccgcctgcattctggtgttattaatatatttcccgaggctgactccgcaatgttttgtgaacattctgttaaggtgccattttgaatatccactttttttagcaactttatccaggcttattttttcatccgcatgatcatcaaccattttattaatgcattaaagaagtttttatctgtcatgccatcccccttttgcgttttttgcggtctcttttaattcaaatccattatcacacaaaatttaattctatattgatcgtttgcaattcccttgtctaagctcctttcattttattctcgtcaccgatttatctcctttagtaaaaggctctatctcagcacgagactatcccctaaagtcatcaatgaacaatcaggaaatgatgaagaatctgtcaatgctgcacaaaaagtgatctctgttgaggcgaacgtcttaggtgttggatgatccgtcttccgtggaagatttacggtgtattactcatgcagcatcatgaacgatttcctgtgcgggttccggcagggtttcagtagtgagccattcgcgcatagcgtctgcacctgaaaccgccaggcgggcatgcttccacaacggtctgaacaccgggacacctgaagccagtcggtaatcgcgcataatatcggcatgaagtaatccactgagatgcctgatattttcaggataggctaaaattctttgagtaggcgtcagcaacaaacctcgcggtaacgacgcggtttatcagaaagaggacgaaaaatgaaattcgctgtaatttttgaagataccggcgttgaagaggaacatgagtttgacaccaaacctgttgccggagatttagtgacgttaacgcgcgatgggataggtaaagattatatcgtgatcattgagccggatcctgaccacactcatgacgatgggcctgacggacacccgacaaaggccagggtccggccagcgtagcctctgctaagatctactccgccgcccaacagggcggtttttattgcctgttatccggaggtgaatatgacttttttcaggctgttcaggatgatatgccgacgcggatcataaccctttgcaatccagagccgaaattgctgacgccgtttccttgcctgtaacagggatatcgacggataatcccctgtagtcagctgacgggctaagcctcccagcgataacggtagaaaaatgtcacgccgcctcgaatggatagcctgacattcagtccggacgagttgaagataacctctgctttgtcgcggcgcttacccagcgctttcctgagcttagtgtctgtctgcaatgtgtacatcttctttgcgtctacgcagaggtgtacacaaaacacataaattaccgctactcagagtcagccatgataaagaaacataaagcatgtcctcaggataatcctctgatatgagtgacttttataaagaaacgttgtccgaactcaagcacaataaagtgaaagcgtatgccctccgataatatctacgccgaaaaacgcctgcccagcgcgtttcgtcagagctggcaccatttctatggcaacccgatttcgatggtcgggctgtatggctttggcgcactgctgctgctctgtctgtttggcgggctgatagcgccatacgatatcgatcagcagttcctgggttatcagttgctgccgccgtcctggtcacactacggcgatgtctccttctttctcggcaccgacgatttgggtcgggatgtgctgagccgcctgctgagcggtgcgggcccgacggtgggttcggcgattctggtgacgctgtttcgccacgctcggcgcgctggtgctgggcgtactggcgggcatgacgcatggcatacgctcggcggtgatgaaccacgtgctggacaccctgctctctattccgtcgctgttactggcgattatcgtggtggcgtttctcggaccgcgactcgagcatgcattgctggcagtctggctggcgctgattccacgtctggtgcgcgagatttacagtgccgtgcatgatgagctggaaaaagagtatgtggtggcggcacgtcttgacggtgccagaggccgcaacatcctgcgctacgccattttgcctaacattttaccgttgctgatcaccgaaattacccgcgcgctgtcgatggcgattctggatattgccgcactcggatttctcgacctgggcgcgcagctaccttcgcccgaatggggagcgatgctgggtgattcgctggagctgatctacgtcgccccctggaccgttatgctgccgggtgtggcgctgatggtcagcgtattaattgttaacctgctcggtgacggcatccgtcgcgccgtcgaagcgggagtggaataaatgccgttactcgatatccgtaatctgaccattgaatttatgaccgctgacgggccggtcaaagcggtcgatcgcgtcaatctgacgctgggcgaaggtgaaatccgtggcttggtcggtgagtccggctccggtaagagtctggttgccaaggcgatctgcggcgtaactaacgataactggcgtgtcaccgccgatcgcatggtgtttgatgatgttgacctgctgcgcctgtcgtcgcgcgagcgccgccgcattatcgggcataatgtctcgatgatttttcaggagccgcaatcctgcctggatccctccgaaagcatcggtcgtcagctgatgcaggtgatcccgcgctggacttataaaggtccgtggctgaaacgcttctggttctggcgcaaaacccgcgccatcgaactgctgcatcgcgtcggcattaaagatcacaaagatataatgcgcagcttcccctatgagctgaccgaaggcgaatgccagaaagtgatgatcgcgattgcgctggctaatcagccgcgtctgctgattgccgatgagccgacgaatgccatggaacccactacgcaggcgcagattttccgcctgctgagccgtctgaaccagaacaacaacaccaccattctgctgatcagtcatgacctgcgcaccatgagccagtgggcagaccgtatcaacgtgatgtactgtggtcagacggtagaaaccgcccagagcgaagatttaatgagtacgccgcaccatccttatactcaggcgctgattcgggcgatgcccgattttggacgatccctgccgcacaaaagccgtctcaatactttgtcaggagcgatcccgtcgctggagagcctgccaattggctgtcgtctggggccacgttgcccttatgcgcagcgcaaatgtattgaaacgccacggctcaccggcagcaaaacgcatctttatgcctgtcatttcccgctgaatatggagggccagtagcatggagaccctgctggaagtgcgcaacctgagtaaaacctttcgctatcgcacgggcctgtttccgccgtcagcacgttgaggcggtgaagtcggtcagttttaccctacgcgagaggcagacgctggcgataatcggcgaaaacggctccggcaagtccacgctggcgaagatgctcagcggcatggtcgcccctaccgaaggtgagattctgatagacgatcatccgctgaccttcggcgattatggctatcgcagtcagcgcatccgcatgattttccaggacccctcaacctcactgaatccgcgtcagcgtatcagccagattctggagttcccgctgcggctcaataccgatctcagcgcggaggatcgagagaaacgcattatcgctaccctgcgtcaggtgggattactgcgcgatcacgccggctattatccgcacatgctggcacccggtcagaagcagcgtctggggctggcccgcgcgttgattttgcaacccaaagtgattgtggccgatgaagcgctggcctcgctggatatgaccatgcgttcccagctggtgaatctgatgctggaactgcaggagaagcatggtatcgcatacatttatgttacccagcatctggggatgatgaagcacatcagcgataaggtgctggtgatgcatcagggcgaagtggtcgagcgcggcggcaccgctgatgtactggcctccccgctgcacgatctgacccgacgactgatcagcagccactttggcgaagcattgagtgccgaagcctggcggcgagagcgttgatttttgctgcatatcgcggaaattgcgggccgatttacctgatttatgagagacgtgctagaatccgcacgtcgattaacgtcggtcgcttactttttaaccatgcggccgccaactacaatgaccataaggattacagctatgggttttctttccggtaagcgcattctgattactggcgttgccagtaaactttccatcgcctacggtattgcacaggcgatgcacaaacagggcgcagaactggctttcacctaccagaacgacaaattaaaaggtcgtgtggaagagtttgccaaagatttgggttcagacatcgtgctgccatgtgacgtagccgaagatgagagcatcaaatctctgttcactgaactggcaaaaacctggccgaaatttgacggtttcgttcactctatcggtttcgcccctggcgagcagctggttggcgactacgtgaacgccgttacccgcgaaggctttaaaatcgcgcatgacatcagtgcttacagcttcgtcgcgatggccaaagagtgccgcgagatgctgaatccacactctgcgctgctgaccctctcttacctgggtgctgagcgcgcgatcccgaactacaacgtgatgggtctggcgaaagcgtcgctggaagccaacgtgcgctacatggcaaacgccatgggcccggaaggcgtgcgtgttaacgccgtttctgccggtccaatccgcaccctggcagcatcaggcatcaaagatttccgtaagatgctggcacactgcgaagcggtcaccccgattcgccgtaccgttaccatcgaagatgtcggcaactcagcagcattcctctgctctgacctggctggcggcatcaccggtgaagtggtacatgttgatggcggcttcagcatcgccgcaatgaacgaactggaactgaaataagttctgcaagggcgagcctggctcgcccttctctttgctcccgcctcgcccttcctgcctgatttcgctgccgttataccgtaacgctattaattatcaccgatcaatcttttgccctggactggccatcagcgacgataagcctgcccttcggtttatgcacattttcagattctgccgcctgcataccgaatccgaatttgcaaaaggattgatcatggaacaacgccgctatacgggccataaccactggttttacgagagccagaccagtccacgtacctcacaggccgcaccgctggtgcccgaggccgcccatatcgatgaccgttttttgctgggatgttacacagataacatcgtggtgcagtcactgctgcgcaccaatcagcccgccctgctggcggcgcgcgatctggcacagctgctgttccccgaccgcgtcgtcaccacgctcacgcataccttaacgctttacgatcgcctcagcacggcgctgacggtggcgcaggtggcgggtgtacagcggctgtgtaatcactactctgcccgcctcaatccgttgcccgggcccgactcctcacgtgaaagtaataatcgcctcacccagattacgcagtatgcacgccagctggcgatgcagcctgagctgatcagcgccagcgcaatcactgccctggatgcagtcggcctgacagagcccgatattgtgacgctgaatcaggtgatcggctttgtcagttatcaggcgcgggtggtcgccggtttacaggcgctgcaggcccagccggtacgctggctgcccggcagcactgcaccaccggatgctgaggccgcaggttttgatcagcctgcccgctggcagcccgtgctgaaaccgctggagttgcggtatgccagtgctgagcagctcgctgccattacccgctgtcaatcgctgccgggaatgcaggacgcggtatggctgctggcacacgatccctcagtgctctatggctgggcgcaactgcgtcagcatctcactcaggacaatactctggcagaagcgacggccgcccgtattctgggcagtcgctgggcgttccggctgctgtccggaaatgagatcttaattgagggcgtggatgacgcggcggcaaaagaggaagagcagcagattattgcgctggcggcgcagctgacccgttcgccagagcgtttcagcgcggcccatctgcagccgctaatggaggcgggctgggaagctgatgcgctgttcgcgctgatacagagcgtggcgataggcaactggaacagccgcctgttttatgcgctgggcgaggcgcagtaactggaattacaccggcagcaggccccgtgcttcatcgaaaaagtgctgcgccagcggtgtggctcggcccggtttcggcaattaccagcgccgcctggcgcgccatcggcggcagcgtaatagcgcgctgctgcagcccctgtaatgaagcggataggagatgaccgaccggcgacaccagcagcccgagaccgacctgcgcgcattgcatcagttgcatgacagaggcgctctcgacgatcacccggggtaccagcgccgcctcgcgaaaagccatatcaagataacgccggaaataacgcgtcggctccgccaggcagagcggctgttgtgccacttcatcaagcgtcagcgcggtttcccccaccagctcagggaaatggtcgggatggaatatggcttcaacgccccgatctgccagcatctcggtctgaaaatggagttcacgcagggttgccatctcgaaaaaaccgatcccgacatccacggtgtggctgttgagcgcttccagcaactggtcagcactgagtaccgcaatgcgatagtcgagctgaggataacgcgcctgcaccgctttcagcagcagcggcagtgccatgctgcactgcggcaccacgccaacccgcagcgtaccgtttaccccatgcttcagcgattccacttccagcttcagcccctgatagaccgaaacgatttcccgcgcccatgccagcacacggtcgccctctggggtaaatccggcaaagttattgctgcggttaatcagcggcaggcccagctcgcgctcaagatttttcaggcgcatagagagggttggctgtgtaacaaaactggcttccgcggcccgcccgaaatggcgttcacgctccaggttacacaagtaaataagttgtttaatgtctattatctttacctatcatatagttacaaagcatcattccatacatctatttttttctgtactaatggatgtactaaataaaatttcgcctcctttttttatcttcttctcacattatattatgccggataggagtgagcttcaaatcgttggcctgtcggctcatgcacggacacaacctccgccgtcaccttccccagaacgataatcccctccagcccctctccgtcgatcgtctcaccgtccaaagtaatgatgcccgtcctgaacagccttcccagctgcgggaactcaccgagctggaatgcaacattatcgccatttactggcttcacggatttgtcggccagtacgaaaacccgtccggcgtctcaataagtatcatgttgttccggtgtggcatcagtatgtcgttcaggtcgatgcgcttttcgatgtagtcgttcgcaggtgatggaaatcccatatctacctcacgtatcccatgttgcgaagagcgtacgttttgttctcactctgctacgtgaacaactcgaagaagaagttctgatagtaacggatccacctgttgcactcctgcagtgtccacacgtgattggcgtcgtccaggtttttctgaaacgccgctgtagtgactatctgccgccccatgccgtcttttttaatcgcagccatgaatgcgccgcgtatgtcactttctctcgccatgtcaaatccccctctgataaatactgtatggataaacagtaatatcgatcggtggatttgatcaaggcgaaacgggtagcaaatttgtaaagctgctgagggtgctggatttttagtttctggtggacttaatttgagttaagactggctgaatacacagatgtgaaaaaatacagcagttaagctgatctttttattgaggtttttgtgctgcctggatattatcccgatgttgtgcggttaaatagtgatctgcacataagggaaggccctaaactgcgtcaacagttaagggccggaaaaacagtcagtgcttgaatgttttcttgagatctcgccaaagagactatctcaagcgagatcccgtgtaaagcgttcggcaccttatttttaaaggtgctttatgaaaaagatttgcaaacaaagtcatcgccgcaaccagatgtttgaggttcttccggagaaccagggccagacaggacgtcacaaatgcgctggatgtgcatatgatttaggcaaatggcacgcaatgattggtgttcctaaatcaagtgacgatgccgtacttagcgaattggcagaaagccaggcaagttatgttcgccacaaggatgccttcacagcatacctgatgggctatgatgacggcctaaagctacaaagcgttgcataagattccaacccggccactgcgccgggttttttgtgcctgaaatatcgttcaatgcaaattgttgaatgattatttccttaattatcacagaccacgtatcctcgctgtcgtcagctgctgctgacagatggtttgccccacttgaacaaattcatgcccgtgtaacgcggttttttttgtgcctgctgcacccagcgactacccttacctgacccaccccgtatcctgctcagagagcagcagtttcgtgcctagacatggttaaaaaatctatttattaggtttaaaccctactaaaaagatgttgcaacgcagctaaagtaatttcttcctattcttgtaggttattgttatgttaacgtcacttactaattcactcattgaatggactccttatggcttttaatcgcgttaaagtatggctgctatttgttattgtaatatcatatttttatgttgttggtttttcgctaatcgggcttctttcaagtacggatttaatgtatgcaaatgataaagctttttggagctttttgcttctcttaataaatattgcatattgtacagttgctttcattcatctatttcgatttgacagaagaaagctccttacttcagaggctacgctttctaaatatgcaagtttaatgctcactatttgcccgttattagccgctcttttcgatccattcaaattaatcttattaaaatggaatatcaccaatgaaaaaacttacttcgctactggagtgatatccttatttattatatttggccttgcacttacttcaagtttatttttgatatcaaaatctactgatagaaagaaagcttaacttagcaaatatatctcaatcgcattttagggtttaagtctagaaaggcgccccgctgctggggcgttatccttcgagtccgtcaagggcttcaagtctgacacccatagatttgataagctcggactgtttatcaattaatttctgctgcgaatggcataccgtcaggagaaggccaagctgttccagcgggtcaagggatttcttgccatcagagtttgtaattaccccttccggcaggagctcttcgaactcctgagcaatcactccgtatttatgggtagagccaacctgcctgccttctgcgaggaacatctctcctgtaatggggtctggcgactgataggtgaaagttttatctttgaatttgtatgcaaccgggcgtattttgcgaataatatttaatgccagattctcatcagcttcttcgatcccttctttcaaagttttatccgagtcgaaaaaattaatacctttggcggccccatcaaccttcacctcaagataggtactgttaactgctgaaaatgctcttacacgaccgccgactgaaaatgatccattgggtgcatataaaagtccatcaaccgtgaactgaaaattcgcgttctcaacagtattagatgagttcactatgcggatattaaacccaccggttccactccctcggttcactacgatagagcctttacctgtagagttatcctcattccaaacaagatgtgccccttgttgtgccatatttgcgccattagacgttgccgagacaccgtttctggcaacgatagttgtgccaatcagaccaccagtcagcgttcctcctgatagcggaaatccaccaagattgctcaatgcagttgatttatttgagacatcgttgagattctggcttttatccatctttcctgaaacagagctcacgacgctgctccatgatggaccgctgtactggctgccatcaggcagtgaaactgtaatatttccgctagcgctatatacctgctgccagttagccttatcgaggttgagtccgcggatggcattggctacatctgcagctacctgcgccgtaattccaaccagtgcagcgttaggtacagccgtccaagcaacacctgatgcagtcgggccattatatgctgttgtcagtgctacgcctgtagctgagttaactgactgcacaccgagcgtataggtaacaccacctacaatagcaacgatgaaatcgtttgctttcagctctgttgtgaagctggtacctgagccagttacagccgtcgagttgttggttaatgcaatagtgcctgctggcatagcgttctccgggcaataaaaaacccggctcggcggccgggttcattgggttatgatttttttcagaagtaatagctggcgtcgatacacgggagctggcaggacgcctgaatggcctttggatattggtataccgcaatctcccggcctgtcgatttagctctggcagtcgtaacagcattgccgttcatcttcagtccggactcaaggcatatacggaacgtgtagttattattgttccgactgtaatcgcctctctgagtgccaaggctgcataaaggcaccatgggctgtgaaactgaaccggttggatttacccaggattgaaactcgccggtggacccgtcaaagttctcataccctccgatatcgtaataagcatcagtccacataacggtgcctgaccagatgccaggctgaccacgatgtcggtcatctgagctggaaccatcctcatgcttgcggccaactgcttggatgacattcccgcctttccggcatcagaagaataagcatttaatccattgcgcgtctgctcaatcttcttcgagtattcattgaatgtctcggtgtctagaaagcctttggcctgaaacttggcaagctgccgttgctggtcgtcaagtcggtttaaggcggcattaacagggtcaatcctgtcgagcaggtcggagagtgatttggcttcctgctcagttgccttagctgtcttaccagctgtgtcagccgctttttgcccggcctgcgtcatctttgtcagtgcgccagctaggccttctgcattgcgttgtgcacctgtactgtcgatgactattgcaagtcgtgattgttgttcggacatgttttctccgggcataaaaaaaccccgccggagcgaggtttataggtttgcattgcttttatagttgggatgaatagtaattacgaaaatcttgccgaaccgcactgggaagacggttcaccaactcatctacactcccctcgtacttttctttgacattgcttgggtgcatattggggcttgcttttttcatgcgagaaatcatttcatcaactgagggcctgttaagcgaaaagtcatcattcccacggatgaaaaaggcatcaaagggcatatctgtaggcttaaaacttgccgactgctggtcgttgagcgcagatttaacatcgctcccgcagtgcttgcactttacagcttccggtttgattgcctctgcgcaataagggcacttaaccagtccctcgttgagctgagattgctcaatggctttgtagtctttcccaatgcataaggaatgaatgagggcgacaatgaaaagaagcgccccgtaaatccaccattcaaagaaattacgaccttttccttttgcgatcgatgcaggtatacacccaagaatcgcacaaatcaccaacagttccatttaattgccctatgaggtttcataggagtaatcctaaagggaaagtgatgcaaaaggaagcaagaagcccgccgaggcagggttatggttttttgcagctttcgctctatttggccactagtaaatcattcacatttatcagcgaacatttttaatttatccaacctgctttgcagtccatcaccatcatcgaccttaaaaaagtcagatgttgaatatgaaagacctaacagcgggattacccatcgaggctctgcctcgacatggacataaattctctcaaagccaacatacgcgccaaatgagtttttaccatttagctcaccgcatacatagccactagtgtttgaaccggtatcgtctttactagcaacaaaatgcatatttctgaattgggcgcttgaagggtctttaagagactgcgctacatcttcttgtgcgattttgatgaattgttcatctgacggcttgcatccagaaagtaaaagaacaccaaaagcgataaataaaagctttttcacatccctatccccataagtaagtatggcgattatcctaaagcggatctgatgcaacgggaagcaaaaaacccgccgaagcgggttttaaggaggctttaggttagcggagtcgacccgcaggcagcattgactacaaagcacatcatggcggcagttgcagcgtcaaaaaatgataatacccatacgtaagtgtttttattcataagcttctccttttcctcaggactaacagtggctagatagtttttgataacaaaaaaaacaaacataaccatgaggacgagtagccaaaaaagctgcgcattaagattaccgactaaccctagcatcgctagcctaaagcagagtaaatattaccttgctagcgtgtttttaacaagtttaaaggccttaaaacataagcactgatcatctatcaggattacgccgatttactttagaggatatgttgagcactcagcccgtccatgttaggggcatggtcgcacacagcatttcataccaatcgattacctctgaggaatatatgcctaatattcaaactaatgcagatgatgaagacaggattgtggctcttcagattggctttgccgcactggttgatttgtgggggagagacaatcctgaaatgaaatccaagctcatagcttatttagagtctacagggatggatcccgaaaacaaaaagtcctcttccgcattccatgagctgattgaagttattcgaggactggaagatatgcgcggatagttccatcggggttatacaaaataaccccatctttacttacatcgttcatatttctctccggttcaatgagccttttcctgctttctctcccactcatcacgagccgcgtcatcaagtgcgaagatagccgcatcgaactcattgcgatctataagcagcggttcgtgactgaggtaagagtttatgtcttcgagcgagagaggtagtggtgcggcggccataccagcgtagcgtcttctgcgactgattactgcataagcgttcagtatctcagagcaaacaccgtcgatttctggttcaggaatcggcggcaggcccagccgtttcccgcgtccatctggctttttcacccttttcgccgccgtaagtactgagccagctctgcgctgctaggactttcccacggtttcattcttctgctcttccttgcctgcagcgatgtcagacgccgttccgaggacagcccagtaaagctcaggatgctggagcaacagcgctttgcccttctccgctgaatactcgacggccttttcattgccgccatcattagcctcgcctacaccctcccaatcaatcagcagatgcttggcgactgaatcaatcaggaggtcatcggagatttcagtgacgtcaatttctgccggattgaagtctggcgtgccaactttgaaacgggcgtccagcttgtcgatgtgacgtcgcacgattgcgttgtgcgatcggaatgccgggttactgatagacccgacctttagcttcaggccttccataggcgtaatccagcgctctgaattgacatccagcttaggtgttttgaggataagcatgattttctctgtgagcagcccgccgcaatggacgggcgggtgagttaggaggccgtgacggtgatcgcagtggtagccgtgtagctacgggctttagcggtgatggtggctgagccttccttaactcgcgttacctgcgccgttttctgtccggttgatgcaacggttgctacggatgggtctgacgactcccacacaacagtatcagtagagcctgcaggcgtcagagtagcggtcagtgtggtattagaacctaccgctccggtagaagtggcaggagctacggtcagcgcagttgctgccactaccgccgagcgcgtaatggttggcggagtatcggctgctgtgatgttcagctgaacctgcacgatgtctgtgttaccaccgtccggccagtcgccatcaacctgtacagcagggaagtcaaagacatacttaccttcgtcgttctccagcgtgaagccgaactgcatcgtctcgcctgacagtgttttcttccaggcattgtatgcctcttttgaccaggacagcgtgacgctgccggatggcgtaaacgtggtcgggatgttggcaccggcgaacgggttaccactgccgatacagcgctgcgtctgcaggttgttatcgaactggatattgaaggtatcgacacagaacccttcgccaccggtatcgccgttcagcgagatggcagtgacctgcttgaacgtgtagcggagcgagccagcgttatcagccgggctggtgaagtagctcgtgtcatccgctttggtttcaaagccgagaccggcaaaagtcaccgttgcggtaatgtcgccatcgttggggatcgccagctggaaggtgccgacctgacagccgcgggcgattgaggcaacgccaatgtcttccgcatacgaagccaccgagaatgcgatgcggtcattacccatagtcagcacattgctcacccattccgcgccaaagcacgaagcaaggaagtcatcatgctgcgcccagcggaatttagtaccgacatcaccgcctacatcaaccgtgccggtcgaacgtccctgcgccatgcgtgagccgccaatctcgtcgttgtcgatcatgttttgtgatggcccgagaccgaagctactgcgcttgagcaggctccattgtccggtaccgggagtcgtgccgggcgtagtttcgcgaatgtacgcgacgacgaccttagcgcctgagctcatagtgtttctccagatttatgcgccctatacggcgcgataaggtatttgaatgttcatttgcgcccagctatcggtttcaccggcatcgacggctgatacagcgaagtaatccagtcggccatctgtctggaactcgaaaagctcgcgcagcttgtctgcggtctgcgtgatgagaagcgagcctgaaccagcaggaacaaagatttgaatgactgctatgccggtacgctgcaccaccggaccggcgccgatttcgtttgccgcagccataccgggaatatttgtcagccgcgcccagatgggttttccggaagggtcgtaatttggcccattcggatagctgacatcttcagaggcaatagccgtctgcgccgtcatccgggagatgatggcgttcctgatttcagtgagcgtcatttgtaagcccgagttacaccgtggaatgcgttcgcgtaaacacctgttggtgcctgttgagagtgcccgttttcaaggcgttcgctataaggaaggtttgactggatataaatcaccgagtacggcttaccctgagcgatgactgctgaaccctgctggattgttttcgtgccaaccttatccggctcagcaggctcagaatagtccggggagccgatactcacgatgtgagaggccctaaatgaaccgcctgtatatcctttcggtgccgggctcatccagatgtcgggattgcctaccggtgagcctgcatgctggcagaggttactgacagcggaacggccacgtcggtgtaaacgtcgttcgagtagttggactcaacggacgcatccagatcaacccaccacggaatggtgaaggtgtttgaaggagacgcaagcaatgtgctcatgtcgcggttgttggtcaggatgcctgactgaaagaaggcggtcttttctgcggtattaacccgcatgtagtcgcgcagtttcgtcacgaaaaactacgtcagaaagaatagttggcattgcttaaatccttattgggtcgcctcatgagccttcttgagtcgctcatattcggctgggttatttttgcggagctcaacgcgctccataccacgaagttcttcccattttttggcaacccggtcaccactcttaggcgcggccccgccgccacctgcctgacttccacgcactagggatgcgtaacgcggagaggtttcgaactctttttgcaggtcagcgagagtgctgaccgtgagattgcctgactcgtcagtaatgcgtacctgcccttctgccaccttcaggcggcgggcaataaactcggtgaggatttcagcgttagagccatctgcaatggccgtagctacacgagtggcggcaaggttgatgtctcgttgctcaatggagcggcgaagttcgacgaggctgctacgttcgcgatcaagctcagcctgagagctttcaaacaactgctgatagttgccttctgcgcgggcacgttcgtcggcctctcgctgcgcctgttcttctgccgcacggcgacgctcctgctctgccttcttctctgccagaagctcgtcgcgctggcgcttgaggccgctgacgtcttcctgggggatgccatcaacctgaagctgatacacctcgccctgctgcacatacagcgcctgtttggcttcttcgagctgagcgaattcctcagcggtaagctgatacttcagagtcatacattctcctgaatggatgtgtgctggccctgccagcattgatttaaagccagtgaaacattaaattaatttaattaataattactggccgggtttaatgtgaaatgagtgaaacaagtgaaacaagtggatttttaagtagagttgcaacccaccctggatttgcagtgttctgcacattagctggagtcgcattaaccagtttttttgggtggctgggtgctcatcagacagcagctattagtgaaaagaatgcatgcattttgcgaattgatactaacgagaaaatactaagggatcagtcagcgcagtttatgtcttcgattggcgacctagttaattacactgttttccctccatccgataaaccagaggatttagccaaggttgcagggcctgtaatgaagcaaggctttgcgataagcgcttacgccccactcccgctatcacttatagctttaaagatagtcgctaatgttcagcaagcatccttggcatcaatgggttatgcagacaaagaaaatgctatgaagcttatcgatgaatcatttggtaaatggccttctactttctcagatacagtgagtgaccttgataaacaaagacaaaaatgtgggggttaatctaattcggccatctcaaaagcatgcggctctaaatctttgagttgatcgagggtgtactgcctgccgttatcatcgacgaatcggtcaatgctcaggtcacctttactgaacagcttgtagcgcgccgggccgagcacttctttctgaaatgctgcaggctgtcttgccagccattccccataggtcgtcttactactgacctgctcaacgccgtcaggcccgactgctggtcgcgttgatccggaaatgtcccgacgatactcagctttcagcaccggaacctccgacgtacggcagccccagtgaaacggtggcgatatcgcatccagtggcaccaccttgccgtccagcgaccggcagagcggtgttgttcgcccgtccagcgtggctatcgacggatattcgcgcttcatgtcatcgccgagggttttctctttggcgtaataccatgccctctgacgctcatctgtcaccaccccattctttgcctcaatatcagcgaaataatcgctcaggcgctgcggtattggctctactgggtcgattgcataaaggggattcttccaccatgagaagaagaaaaacttccagtctaactgtgagagctgcttgccctgaatgagcgccttttctgccgactggcagtaatcgaagaagtagccagccctgccttccgcagtgctttcaatcgtcgtgaaacaatcgcctgatactgcttcaaatgcaccggtaacaatctcacgtgccttgtcagggaacttagcgcatatcttgccgaactcggaaacatgcagataacgaagcgtgccaccacggaaagacgtgctgatatagagcgagccacctttgctgaataccagtttcgccagctgcatcattgctcgcagggttagcggccttaatctcatcaggaaggcggtcataggcatatttaatcttctcgcggaataggcgttttgcatcgttcagggtgtgggcaatcagggcgcacttggctgcttcgaacaaagcggcgtcgagctggataatgcagacttcagttgtaaatcctaactggcgcgccttcaggatgatgtttcgggtatgcatgccatcgaagtattcgagctgctccggcgtcatccggaagcgtactggcttgccttctttgtcggttattaagtagaggtgattcaggcgccagagcttatcccgcaggagcttgaggtgttctggcttcatgctcaccccttagcgagatcgtccatcaggtcagaaagagtgcctaccacatcgtgctcagttttaacctgctcgcggaatgcctgcacggctacatgcttaccgagcagctcaaggtttttcaccttatccggccacttaatctttttgaggatgttctccatcgtcgtttcgtcaaagttggtgactgtagtgaggatgtccaaaccactcagcgtggtgcgccataccttcggccattcatgaaccatcttcagtccgccgtcatccttcaagatgtcgagcacgtccatttcgtcaatctcgaccaggcggcgcagtacataatctgcgtttacctctaccctttcgttgcgctctgatttaaggtcaatgatgcgttgcgcaatgtcaggttttgacaggttttcggatccggtacggtttgcagttttatcgctgtaccccgcccgaatagccgcttgcgtggcgttcaaatcgatgaggtactcgcgacagaacatttcttgtttgtcggtgagtgccattgatatacctgagaaaattatgaaattagaagatttcgcagcttataatcgccctcaatcgaagatgtccggagagaggaaatttcttgattacattcacagcaggaacagatggactgaacttgttaaaagcttgagtaacgcagagccggcatcaattgccatgaaatattcattccatagtcagtgggttgagtctggggcttttatacgcgaaagtatcaacaacgacttaattctcatcaagctattaacgctcttattgccaccttatgatggcgacagccttgtactttatcgtggagagaataaagcaaggttcgatgaagggcgtattggcttttgctggacacgggatctttcaatcgccgagatgtttggcagtggattgaattcatacaaatcacctggcttgcttttaagggctgaagctccagcctgttctatattagctggcccgaatgaacatagtcgttaccttggtgaaaatgagttcacggttaacccttcacttctttcaaacatcacagttcttgagatctacccagacaactctttgttcagttgatgactacatagatgatccatgccacgcctgacaccggtaagccgattcgatggcctcccaatctagtggtgcaacaacttttccttttaaaacctcaccaccttgattttttcgaaaaaaaaccaaatatataaatatcaaaattcagcaaaaaggaatctcgatatgtctacaaacgcgcatttcaaatccggtgatcaagttgtgttgaaatcgggcggacccgagatgaccgtaaaagcggtttattctgaagaaatagtttgccaatggttcgctggtaagaaactagagcaaggacgttttgttcccgactccttgacttatccggccccaaagtcgtaagcccaaacacagttaaactatctgttgccgatgtgtcattatggatgatgaccaacctgcatgtggataagtgcctttattagcaggatgtcgttgattacttagtgaaagcaggtaatgagcagtaccttaaagaaaatgcagatgggaacttagtcctgtcagtatccactattaatcaattccgcaaagttagtggtaatgatgttgtttgggttaagcctgaaaagtactggcgtttccgcgtctctgaagatgaggaaggtcgtgaggccagaggatgagtcaatggcggctaatatgtccattagtcgccattaacatcactgcaccagctctttattgatcctatcccaaagagtctcaaatttaattttttgagcttcccctagtggtttctcaaccttaacccggctagcgccataatacaaatagctattagacgcactgtataattcatcccagacctttcgctcctcatctgaaatctgatgaactgaatacccagcccaagcctctgaacactttgtaaaagaattgattgcatcattgcgatgcctatcactagagctatagtgctgcgcgctatttaaagggctaaaatcttttggaagcattgtcaatgctattcgatacacttcgagtgacattttgtatgtttggaaggctttatgcttctcttgtacacgccaacttctcatcgccacaatagcaacaactgcggcaaaggcagttgcaatagcagctccacatgttgcaatagcactaaccattgaccaagtattttccacagaatcatacctacaggttataagatagtaattatatcgtcttattctgcgaattatttaatttaatctgacttgaccgtcatgcatctaaagtaaaactcattcagctgctctataccacgcctgccatcggtaggtattgagacgcaaagttctcacgcaatctgcattttcaacgtccgattgcaagtccatatcactgttttttcccgcctggctgagcttgcacggcgggctcatcaaatcctgagatatggttggcagcgtcgactgcctgttgccgcaaccggatagcatcatcatcaaagttacaaagagtgcgattcggattttgaacataggtcaccacgttacgggtaatggttcggtagatgacttttccatctgcgctggcggctgccgctttctgctcagtgggaaccagcttggcttcggccttctgctttttcagctcatagtcggcgttcacttttgcgctatgcgtaaaccagccattcatgtagcggatttctccgtacccgatggcaatagctatcatcaccgcgatggtgatcaggtagatgcgcaggctaaatgtcatcagggccatccgccaggcacattgagcgttccatgtcgcggcggttcatcaatccgcgccatttctgcccgcctgcataaatccagcggcgcagctcttcacacgcaccatcgacatcgccagagttgagcttcttaagcagtgatgatttggagaaacgcaccagaaccaacgttataagtgaagctgtagagtgctgcgcgctgatattcacccagcggcactttaaccatgccatccaccgacttcttaaccggctgcaggtcattccacagcaggcgatcgcattcgcggtcggtatactttttccccttgatgatgtcggtgccggtatgaccatcacagacagtccagacaccagccacatccttgtagggctcgtacactctgccctctaccccatcctttccgccgaggaataccgtagcgatagccatagctccgccacccgcgacagcaataagcttattgcgcaggctgtttgacatagccatgagttaatcctcgttgatgtctggtgcagtaggccagcgctgaagggctttgatttgtgccagggtggccttgcgcttgtaataccagttgatgccgagcgtgaaaagcgcgaccagaataccggccaggacgcctacagcactccattcatcgggactcagccgggtcaacagaccattagcgattgtcccggcagatgcgccatatgctgcgcctgaagccagtttgctcatatcgatactcatatcgccgataacctgccagagagcgagctggaatgcattgctgctgaagtcgatgcgcggatgaaccagcacaagacaaacccgctgatgccagctctgtgcgtcttcctgacgaagcattacgactacccggctattgagatgttcgatgaagacgacgagcagcacgaagccgccgaggcgtttttgcgtgaggcgatggttcgggttgggcgccgtgaagtggcaatcgaaatttaccgtaacaagcatggaaatcaggaggcggcgtaatgcagcctggcatctactacgacatcagcaacgaggactatcacggcggcgctggcattagtaagtcgcagctggatgacatcgctattaacccagccatattccagtggcgcaaggaagcaccagaagacgatgagaagaaagccgctctggatatgggtaccgcgctgcactgtctgctgctggagcctgaagagttcgacaggcgtttcattgttgctcctgagttcaaccgccgcacgacagccggcaaggaggatgaaaagcaattcctgaaggattgtacaaatagcggcatgacagtaatggatgctgagcaaggacgaaagctgaagctgatgcgggcgagcgccctcgcccatccagcgtcccggtggctgcttgaagctgaaggtcatcaggaagcgtcaatctactggaacgacgaacagaccggcgaactttgccgtatccgcccggacaagttcctgtcaggtcagcccgtcatcgtcgacgtgaagaaagtggcggatatgtcccgcttcgcccgccacgttgaagagtttcgctatcacgttcaggacgcctattaccgcgaaggcttcagcaagcatttcggcgaatatccgcttttcgttttcattgctgtcagcgagtcgatcgactgcggccgctatccggtgcgggtgtttcagcttggtgaggatgacgtggcggtaggttatgacctgttccggcgcgaccttattgcctatcacgaatgcatgctgtccggtaactggggcggcatcgaagaaataacacgcccggactgggcaaaaagaaaggattacgcatgagcaacgacatcatcaccgcgccggtcaatgaggctgataccaaggcggcaatcttcagcccgagcggcctgcagaagctacaggcttttgcggaagttatggcgcagggtaaagcaacggtacctgctcacctgtccggaaagcccgctgactgtctggccatcgcattgcaggccgctcagtggggaatgaacccttacgctgtggcgcagaaaacgcatctggtaaacggaacgctgggttatgaggctcagctggtcaacgcggtaattaccagctctacagccgtacagggtcgcttcaagtacgaatacggcggcgactgggagaagctcaagccgggcgcagccaatgcatcgaatgagcgcggcctgtctgtgcgcgtcggtgcattgctgaagggtgaaacgggaatcacctggggtgagccgatttatatggaatacgtcaccacgcacaactcccctctctggaaaacggcaccaaagcagcaactggcatacctggctgttaaatactgggcgcgcctctactgccctgacgtgattctgggcgtctacacgccggatgagtttgagccggcgcagcgagcggaacgtgatgtgactccagcacgcagccgtgctgacctgaacaacctgattaacagcaagcctgaaacgcagcagccagagcgcgaaattaacccggcgacgaataccagtgcggcagcgcgaaccccggatgaactgcttgccgatttcaccgctgcagctgctgaagctgagagtgttgcaggccttgaccgttgctataagtacgcggcacgcatgctggcaagcgaggctgaaacgctggaaaaagccactgacgtttatctgcttcgtaaagcggagatcgaagaggcgcttagctagtcacaggagaagatatgcaatcacctgaataccggcgtcgcggcaatcagttaacccttggccgccgctggtcacccaatgagataggccttcttaaagaactagcagcaaccatcccacccaaacttatagcccgacagcttaaccgctcttatgagtccgttcgccagcgcgccagccgcagccggatacgttttctggaagagcgaagcaaagttattgctggaactaagccaaatttatgacacaaatttactgtatatataaacagtatttggcttttaattttctttgttaaagcgtaatgtggctatgtaaggcaagaacataacctactgacggtaaatgattttaattgctgtaagccagtagaaatcaatttagtaatttcaccgaaaaggaatcaaatatggctgacacaactcaattagcacaacaggctatcgatagcgtaaaccagcttaaggaaatggctgatcaggcgggacaaagccaagcagcgtatgaagagctgtatgaggaaaatacacgcctgaattccgaggtagactcactgaaagaaaatctttcggacctgagtgaggttttccatcagaaagtcatcgaagaagacgattacctcagttacgcggaggacatgctgaaagatatcagcaacatgatcgacaatggtgagcttagccctctttcgattgaaaaagcagaaacgctacgcatgactctgtgggtggtggcatccatccgaaaccagcaatcaaaataacgatccccgccgtccgggcgattcgcctaagcggacgctgcgtcaggttgccggttacgatgactgatctgatgaaaacctttaagccgcctacgggcggtttttttatttcctactatctgactattttcgccgcggcatttagcatgacggcggcataaggggtaagagaacgaatcaatacaaaatattattagagctttgtttgatgaagatggattgcgaaggcaataactatcgcagacaaatatcagcaaaggcgtcaaagcactgtcacttcaaatctgagatcgccgtaaatggcggctggcgtgatattcaaatcgctgcctcaaagcaaagtgtgacatgctaacgtgagctttcacggtagcgactagttatatctttttgatagttgttgcaatgagttcttagccgtatcgaggctgtccttgcaatcgcttaactcaataataagtgctctattttggctattaacagaagctatttgctgtttaccttcttcaatttcttttctatatctgtcaacttcatcaagcatgtcttgataaccactttcaaattctttaatctctgatatttttttatctttttcggttaattggttctcaagcgcttcagataaaagaacaaggttatttacctcctcaaccttagatatatattccttttcaatgtcttcaagcttttttatatttttacgtgccaacgctgcttctaaattcaactgctcagttcttttctcggcttcagcaatttcttgcttttgcaaagcgagcgttttctccctttctgtaattattttcgcagaaaccctttcttttcttaatgagaatacagaagtcatgtaagagtcatatagatctgagaaattatgtagacctttaattgccacgttaaataacgcataaatagcattcagtgcaggtataattaataccagtacaaatgtcatttttgaggggttgtagaggagactgtttatgtttgtaactgtttcgatgtcatcaatttttaagtaaatgctcctttctgagaaaaggaatattgcaatagctttccagttaaatgagagccaagaaaatataaaagccccatacaaagggttgcttattctctgttcagagctatctctaagagaaatcattaacctgccccaaaagctactcataaaacacctgattgataaagaatcttgatgaatcatacctataaaaattgattaggaaaagtcttggtgctgctgttttgatacaaaaggccgcatggtgccggggtgtgtagtttgtgacttaatttgcgaaattgaggctttaggtaggtttcaagtaggccgtcgccgccctagatatgagcatcatatttaacgacacagtggtattggtcagtgagccagtcggtgcgcagttgagaatcattcctttacgacgcaaaccacatctcatcacgaatgacgacattgcgccgggcaatcactctactcgctgccaattcaatgtagtttatctaatccccacccaccctattcactatcgcgctctgcgtgaggagttgttatgtctgaagttagcatattggatatgtgctgtggctcgcgcatgttctggatggataagcaggatgaccgcgcggtgtttactgaccgacgcgccgagcagcatgttttatgtgatggccgcacactgcagattagcccggatatcatcgccaatttccgcgcgctaccttttgctgacaacacctttgcccaagttgtattcgatccacctcatttacagcacgccggcgaaaacagctggatgcgaaagaagtacggagccctcgataaagcgacgtggcaatacgatatccgcgccggctttgcggaggcgtttcagggtgttgcggccacacggcacgctgatatttaaatggaacgagacacagattcccgtcagcaaagtgattgcactgaccgaccagaaaccaaccatctggcagcgctctggcaaaggcgacaagacgcactgggttctcttcctgaagcctgcagcatgaacaccctcagcgacatatcccccgacgagttcaccctgtggctcttcgtttttatttgcatcgtgctggtctggaactggccgtataaggagtagatatggaatccccatacatgacatttgaagaaacggctgcattcttccgccgctcagttaaaactatccgcagctggaacagccgtgatcggcgtacgggggaaaaacgcatgtgcggatttcccgacccggctcatcacggactgttcctaaaaagcgacattgagaagttcggtaagctaacttgtcacgattgatcgaactttcgcctcaccattcactatcttcattaccagtgcccaccaggcggtataggcctttctctgctcatccagataatcgttatggtcgtataccgcccagatgcccggtaaggcatgccccatcatcacttcgcaaacatgcggtggcgcaatggatgcccaccgcgtcctcgccgttcttctcaaatcatgaatcgaccaatgcggcattatctcacccctggtgcgctggtaatatgatatcactgtcttgggcaggcccattgcagatgcgctattaagcgccctttccctgtccttcttcagcgcgctctggaatatgaactccttatgcgagctcagcgccattgcttcctcaatcatcgcctgcgcagccggtatgatcggcctttttagtgatttgcccgtgttgccgcccttgtggttttcaggcggaacagtccatataccggtatcaaaatcgaagtgctcccttttgctctgaatcatctcaccagaacggcagccaaaaagtaaaatcagctgcatgagaagcgcgtttttcctgcgcattccggtattctcaaaggtctcataaagcacgcggatctcatcatcattcagaactcgtcgggtaatgtttaccttcatgccgaaatcatgcggcttaagcccctcaatgggagttgtttcaaccagctttctgcgtagcgcccatgagtgtgcctgtttagcgtttgtcagcagccttctggcgatgccgggcttgttgctctgcacactctcaattatttcaatccaggcgtgtgtgttaacagagtcgtgcggcaggtggccaatgcgtggatttcaaaagaccggataatgtcggcggcgtttctttatattaacgcctgcatagaccctgtcccattcccgcatcaccttttcaactgtcattgcgctgacgttcttctcgtatctggcagccatataaagctgagggtctacaccctcctcaagcgatcggcgtatcttcagaatttcatctctcgcctctttgagcccaagcgacggatagctgccgatatctacacgacgctgcttgccggaaaacatgtagcgcatctgaaaaaccaccttccctttttttgacacacgcacagaaaggccgtccctgtccgtcttttcaaataccctttcatgctcacgcccgtgaatagagcgcaggtagctatcggtgagcgccatgtcatcctcgttagtacataaaaaagtgaggatcgcagactaaccgattttctgtactacggcatgtacataaatcacagggatgcatcgggatgcctagtgaatggaaatgaatatgaaggactgaaatgagttgatgggtcttgttgttcagggaggatttgtgatgcgcggggatgatgaaggataaggcgttatttatcagttaattccacaagtaaatgagttgtttaatgtcgatgttaattatccatcagcaggttgaaggctgttcgcattactgtctcgttcgcaggatcaaccagagtataaggctgaatgttaccccgcgcaggctcggatgttttaaccgcacggttcatttgcgcaggcggatcgatgaaaacagggctagacatagccctgatctcagcagcagagtatatggtgcacttaaatcatcgcgccctgttgttttgctggcttagtaaagatggcattcagcgccagacagattaacccgaaccctactggcagcaggaaatcgtagctaagcagccggtaaagcccgattccggctatccctcctgcaaggaaagaaagcagggtcagacagtgcagtcgcaaccggctcagatagagcggcgcctctttcggtgacgctttacgtcgcagcacctcaaacagcattgccagctcaataccgatatcggtcgccgtgccggagatatgggtagtgcgaacgcgggcattggagatccgcgtcaccaccgcattttgcagccccattaaaaagctcaggctcattatcaacacgacaccgggcgactgcggcggaaagtgattttcaatcacccccagtccaatcagcgctgcgccctcaatcaggataacaaaggcatagatggtgcggatatttctgcggtgtccggcattaatgatcagcgttgaaaacatggaacccgcaataaacagaagcacgatcgacagaaaaaacaggccaggccccagattcgcttttgccagatgatcggacagcagcgagacattcccggtcatgttggctgaaaaaaaaccgacgatctcaaaggctgcggtattcagtgcgcctgcggcagcggcaagcgtacaggccagtcgggtatccgcgctgttgctacgggcactttccgtgctgattagcatgaccaccccatatttactggaaagccttataatccgccgattagccctgcgccacaaggcactgaatcaaactatcccctctctgtggggcattactcagcatcagggctccggactccgcgctgcataaactcagcgcggagccccctgattaacggtttgccagacggaaggtggagaccgactgcgtcagatactgcacctgctcttccagcgaggcagatgccgcggcagactcctgcaccagcgccgagttctgctgtgtgacgctgtccatctcggtaaccgcctgctcaatctgaccgataccgcgactctgttcatcagaagcggttgagatgtgctccatcagcagattcacgcggctgacagaggagataatggcgctcatcgcctcaccggtccggctgacctgatcggaaccggcgtggatgatcgaaacagattccgcaatcagcccctcaatctctttggctgcggtagcgctgcgctgggccagattacggacttcccctgccaccaccgcaaaaccgcgaccctgttcacccgccctggcggcttcgactgccgcgttcagtgccagaatattggtctggaaggcgatgctgtcgatcacggtggtgatctcctcgatcttcttcgagctggcattaatcagcgccatcgatgtcactacttcctgcgagactttttcgccactttccgcatttttcaccgcttcactggtcaggcggcaggcttcaaagacgttttcggtgttctgtttcaccgttgcgcccagctgctccatgctggcagcggtttccgtcagtgcggcggcctgctgttcggtacgtgaggcgagatcgatgttgcccgccgcaatctcctgagaggcggtggagactgagcgggttgaatcgcgcacctggagaataatggcggtcagcgcgctgcgcatctgctccagcgagcccatcagcaactgaatctcactgcgcgaaccggctttgaccggcaccgtggtatccaggacgcccgccgcaatcagcttgcagtgttcctgcgcatcattgatcggcgaaaggacatagcgcttcatgaagatgtaaatggcgacgatgatggcgaaaaacagcaccccaaacagccccagcagggtaatgccggaggtgaagtgactctgtgcatcgctgttaagctttttggcataggtttcatgctgagccagcacccggtccagaatgatttcatactgacgatcaaggcgaactacggtggcaatctgatttttaaagcgcacctgatcgtgcgcctctgccgcctcaatcaacggctgtaaaccctgctgacgataggcctgataagcctggctataggcgtcggcttcagcctcttcgcccggcagacgcggcgcgttcatataggcctgaaatgcagcatccgctttgctggccacggtccgaacgctgtccagcgtggcgggattatttgcgtcactgccctcaatctctttcatgtactccatcagacgcacacgcagcgtgcggctgtggttgatcgggtcaatcaccgagagcaccacgcggatctctttgttaaccgcattcagcgagtgattgctctggatcagcagccaggtactgattgccacgctggtgagaaacagcgccagcaggaaggagaagataatcagggaggatttttttaacgacatcgcggtgttccgaaaagtaagaggattagtcgctatatcggcagaaaggtgcgccccattagggctgggctttttttagttacaataagcgggacggcagcgggatgagcgcccagggaacaggcgctaaccgcccacgggcgtcggacggttagcgttgtgacgaagagtgaaacaggctgccgttaagcgacgcccagcgccatttttacctcgttggcgatcttctcgacctgcgggccgtagatcacctgaatgtcatgctcgctgacgcgattgaccccgttggcaccggtgctcatcagcgtctgatcgaccacctgattcatctctttgacccgcacccgcagccgggtaaagcagcaatcgacatcctcgatattggcctgcccgcccagcccgctgataattacctgagtccgttcatccgcggcgacctgttgcggtttctcatcctccgattcacggccaggcgtttcaacactcatccgggtaatcaccagccggaaagcgtagtagtagatcggcgcatagatcacacccagcgccagcgtccaccaccagtgggtttttgccccacccagcatgccgaacaccaccaggtcgataacaccgccctgcacgttgccaatcatcagatgcagcatcgacatcagcataaacgacaggccggtcaggaaagcgtgcagcagatagagcaccggcgagacaaagataaagcagaactccagcggttcggtgatgccggtggtgaaggaggtcagcgcccccgccatgaccagtgctttcacccgctgtttatgctcgggtcgggcggtgtgatagatcgccagcgccgcggcgggcaggccgaacatcatcaccggaatcttgccctgcgccaggaattgcgtggcggtgcgcagcgtctcatcggggatcgatcccggatgagtcagcgacgcgttgaagatgttcagtgcaccaacaacagtctgaccatcgaccaccgccatgccgccaataggcgtgaaacgcacggtttcgttaaggatgtgatgcaggccggtggggatcaggatgcgctcaaaggcccccagcagaaaagcgccatactgcccgcttttgccaatcatctgtccaatccaggcgataccgtcaccaatggtcggccagatcagcgccagcaagaccccaatcagtggcagacagaccacggtcacaatcggcacaaaacgccgtccgccaaagaagctgatcgcggtaggtaattgctgggtataaaagcgattgtgcagcgccaccgttaccagtccggcaatgaccccacccagtacgctcatgttgtaggtaaagacgcccagcatgttgatatattccgccgaggtcatcatggcggaggtctgatccatccccgcctgctgcagggctgcaggtgtggtggtggcggcggtgatccccttggccgccagcgtcgcgctgataccaacgttcatcacgatatagccaatcaccgcggcaaatgcggcggtaggtttttccgctttcgccagtccgatggcactcgctaccgcaaagaagaccggcagattagcgaatagcgctccggcaaccttgcgaataaagccgattattaactgcggcacctgcatctgcgcaaaggcatcgccggtgaccgcagggttctgcatggccgccgccagcccaaggaagatacctgcggcagcgatgacggagattggcatcatcaacgctttgccaaatgcatgaatctggctggtcagctgtttcatggagtcgtgccctctctgattgtgaacagcaagtattagcctgttgtcgggagaaactcccgttatcagcaggttaaaggcgggtaaaatctgaccatcatcacatttctggcttatgcacgataaacgccagctatcgcaccattaagtcaatcaattagacaaggtatgaggatagctgcagacttcctttcaccatcaggatataacctgataacaaacaccaaacaataattcctactataaaaagcctgcactcaatatgaaatttaaacgccaaatcaaaccctatcgcgcggcagcgggcggctggggttcactggaagccaccacgcgtttcgttcttgacagcaaagcggccctgaaaaatatgcgcaacctgatgcgcatgaacaaagcgcgcggttttgactgtccgggctgcgcctggggtgatgacaataaaagtaccttcagcttctgcgagaacggcgccaaagcggtgacctgggaagcgacacgccggatggtcgacaccgactttttcgctaaacacagcgtaaccacgctctatacccagagtgactacttcctggagtatcagggacgtctgacccatccgctgcgctacaacgcggaaaccgatcactacgagcccatcagctgggatgatgcgtttgcgctgatcgcgcagcacatcaaggcgatggatcatccggatcagatggagctttacacctccggtcgcgccagcaatgaagcctcctggctctatcagctgtttggtcgcctgatggggaccaataacttccctgactgctccaatatgtgccacgaagccagcggcaccggcctgaagcgcagcattggcgtcggtaaaggcaccattcgtctggatgatttcgaccacgcagatgccatttttgtcttcggtcagaatcccggcactaaccatccgcgtatgctgcacagcctgcgtcacgctgccgatcacggtgcgaaaatcgtcacctttaatactctgcgtgaacgcggtctggaacgttttgccgatccgcagaaaccgctggaagtggtgacttcgaaagcgggcaacatcagctcctcctattaccagccgaacctgggcggtgatatggcggcggtgcgcggcatggtgaaatccctgctggaaacccaccgcgcgcgtctggcggctggcgaaagcggcctgttcgatcagacctttatcaatgctaaaaccaacggcattgaggcgtatctcgacgccgtggataacaccagctggatgcagattgtggcgcagtcgggcctgacgcaggcgcagatccgtgaagccgcggcgatctaccagagcgctgaccgggtgatctgtacctgggcgatgggtatcacccagcacaaacactctgtcgacacggtgcgcgagatcaccaacctgcagttactgtttggccagctgggtaaaaaaggcgcaggcctctgcccggttcgtggtcacagtaatgtgcagggcaaccgcaccatgggaatcgatgagaaaccggcgaaagccttcctggatgcgctggggaatcatttcaatttcgagcccccgcgtgcggcaggccacaacaccgtggaagcgctgaacgccatgctgcgtgatgaagtgaaagtgctgatcgcgctgggtggcaacctggcggcggccgcacccgactcaccgcgcaccgaagaggcgatgtcacgctgtggtctgaccgtgcatatcagcaccaaactgaaccgcagccatctggtgccgggtcacgatgggctgattctgccgacgctgggccgcaccgagcgcgatctgcaggccaccggcaatcagtttattaccgtggaagactccttcagcatggtgcacgcctctgaagggatcggtattccgctggcggaaacacagcgttctgagacctggattgttgccggtatcgccgaggcggtgctgggtgatgaaaaagtgaaatggcgcgagctggcgggtgattacaacctgatccgtgagcacatcgccgcgacgattccgggctttgccgactttaacgccaaatgtgacatcccgggcggtttctatctgggcaacgcagcagccgagttgcgcttcaataccccgagccagaaagcggaatttaacgcctcagcgctgccgacctcactgttcccgaatcttgatcaggacgtgccttttaccctgcagacgctgcgttcgcacgaccagtacaacaccaccatttacggcctcgatgaccgttaccgtggcgtgtttggtcagcgtgaagtggtgttcatcaacccggacgatatggcagacctgggctttaccgaaggccagaatgtcgatatcgaaacgctgtggaatgatggcattacccgtcgcgtcagcggattcaaactggttccctacaatattccgcgcggtaacctggcggcctattatccggaaaccaacccactggtgccgctgaacagctttggtgatgacagtggtacaccgacctctaaatcggtgccggtgaagctggaactctctggggcactggccgatcagcgcatcgcctgacagccctttcactcccccctaaaaagccggctcgtccggctttttgccttgccgcgcgacgtcgattcgcgtaaaactgtcagccgcaatcagccaacgaaacgtaaaaattatgttccaggataacccgctgctcgcgcagctgaaagagaagctccattcgcaaacgcctcgtgctgaaggcgtcgtaaaaggcactgaaaaaggcttcggctttctggaagtcgatgcgcaaaaaagttacttcattccgccaccgcagatgaagaaagtgatgcacggcgatcgcatcaccgccgtgatccacagcgataaagatcgcgaaagcgctgagccggaaaccctggttgagccgttcctgagccgctttgttggccgggtacagaagaaagacgatcgcctgtcaattgtgccggatcatcccctgctgaaggatgcgatccagtgtcgccctgcgcgcgatgtcagccatgagtttgaaaatggtgactgggccgtggcggagatgcgtcgccatccgctaaaaggcgatcgcggcttttatgccgaactcaccgattttattgtcaaagctgatgatcatctggcgccgtggtgggtgacgctgtcgcgtcataaccttgagcgtgaagcgcccgatgtcagttttggcgagatgctggatgaaaatctgacgcgtgaagatctgaccgcgctggatttcgttaccatcgacagcgccagcacccaggatatggatgatgcgctctttgtggagtccctggacgatggcgccctgcgtctgactatcgctatcgccgaccctaccgcctatgtgccggaaggcagtcagctcgataagctggcggcgcagcgtgcgtttaccaactacctgccgggctttaacattccgatgctgccgcgcgaaactctctgatgatgtctgctcgctgcgccccaatgtgcgccgtccggccctggcctgccgcgtgaccgtggcagccgatggcagtttaggtgatgacgttgagttctttgccgcgtggatcgaatccaaagccaagctggcgtatgacgacgtctctgactggctggaaaacagcggcgcatggcagccggaaagtgaggcgattgctgaacagattcgcctgctgcatcgcctctgcctggcgcgcagcgagtggcgtcagactcacgcgctggtgtttaaagatcgcccggattaccgcttcctgctgggtgaaaaaggtgaagtgctggagattgtggctgaaccgcgccgcatcgctaaccgcattgtcgaagagtctatgattctggccaacgtctgcgcggcgaaagtgctgcgtgaccgtctcggttttggtatctacaacgtccatgccggtttcgatgccaccaatgctgaacaggccgcggccgtgctggccaaccatggtattaccgtggatgcgcaggcaatcaccacgctggaaggtttccgcgtgctgcgtcgtgagcttgatgcccagccaacccagttcctcgacagccggatccgtcgcttccagaccttcgctgagatcagcaccgagcctggcccgcactttggcctgggacttgaggcttacgccacatggacctcaccgattcgtaagttcggcgacatggtcaaccatcgtctgctgaaagcgattattcgcggtgagcagatcgctcgtccggatgatgcgctgacggtgacgatgagtgagcgccgccgcctgaaccgcatggcggaacgtgatgttggcgactggctctacgcccgttatctggcgccgtttgcagcaaccgaccgtcgcttcagcgccgagattatcgatgtgtcacgtggtggcatgcgtgttcgcctgctggagtttggcgcggtcgcctttatcccggctccgttcattcactcggtgcgtgatgagctggtctgcagccaggaaaatggcagcgttcagattaaaggcgaagtggtttaccgtgtgaccgatgtgattgatgtcaccatcgccgaagtccgcatggaaacccgcagcgtcgtggcgcgtcccgccgtctgagtagtgatgtactgagcagtcaatcgggcgggataactccggttatcccgcctgtttccgccccgcccgcattgcaaaaaagttaaatttgtaccccgcttcacacttctccactgattaactttcacttacattccattacattaagtttgactcgttgttttcgatcgctttcctctcggtcctcacaaggagttagtcatgaaaaacgtcaaaaccagtgcgatctggttagtggtggcgttaatcggcgcgggcgctttcgccatgctggccctcagccgcggcgaacacgtcaacgcagtctggctggtgatagccgctgtcgcctgttacagcatcgcttatcgcttctacagcctgtttatcgcccgcaatattttcgaactggacgaccgccggatgacgcctgccgagcggctgagcgacgggctcgattatgtcccgaccaataaatgggtgctgtttggccaccacttcgcggctatagccggtgccggcccgctggtgggtccgattctggcggcgcagatgggctttctgccgggcaccatctggatcctggtcggggtgatgctggcgggtgcggtacaggatttcctgatcctgtttatctcaacccgtcgtgatggccgttcactgggcgagatggcacgacaggagctgggtgcgtttgccggtgtggtaaccatgctcggcgcgctgggcgtcatgatcattatcctgtcggcgctggcgctggtggtggtcaaggcgctggcgaacagtccgtggggactgtttaccatcgcggccaccattccgattgcgctgtttatgggcgtctacatgcgctttatccggcccggtaaaatcgccgaagtttcactgattggctttgtgctgatgatggcggcgattatctatggtggtgacgtagcccagcatccttactgggggcccttctttaccctgaaaggcacctcactgacctgggtgctggtgatctacggctttattgcctccgtgctgccggtctggctgctgctggctccgcgtgactatctttcgacctttcttaaaatcggcgtgattgtcgggctggcggtggggattgtctttgccatgccagagatgaaaatgccggcggtcaccaaatttatcgacggtaccggcccggtcttctccggcgcgatgttcccgttcctgtttattactattgcctgcggcgccatctccggcttccatgcgctggtctccagcggcaccacgccaaaactggtggagcgggaaagtcatatccgctttattggctatggcgcgatgctgatggaatcctttgtggcgatcatggcgctgatttgtgcctcagtgctcgatccgggcgtctactttgccatgaactccccggctgcgctgattggtaccaccgttgaaagcgcctctcaggtgatcaacggctggggctttgtcgtcacgccggaaatgctgagcggcatcgcccgtgacgtgggtgaaggctcgatcctgtcccgcgcaggcggcgcgccaaccttcgcggtgggaatggcccacatcattaccgagatctttaacagccgggcgatgatggcgttctggtatcacttcgccattctgtttgaagcgctgttcattctgacggcggtcgatgccggtacccgcgcctgccgctttatggtgcaggatctggcaggcaccgtggtgccttctatggcgaataaccgctcctggctgggcaatatggccggcacgaccgtggcggtcgcgggctggggcttctttgtctatcagggcgtggtcgatccgctcggcggcattaacactctgtggccgctgtttggtatcggcaatcagatgctggcgtccatggcgctgatcctcggcaccgtggtgctgttcaaaatgaaaaagcagcgttacgcctgggtgactatcctgccaactgtctggctgtttatcacctcgatgactgccggctggcagaaaatcttccatgaaaaaccgtcgattggcttcctggcgcaggcgaataagttccgcaaagggctggatgaaggggtgatcatcgccccggcaaaaagcgtggcggatatgcagaccatcgtcttcagtaatcagattaacgcggccctgtgcgccttctttatgctggtggcggtcacgatgctgatctctgcgtttctttgtcattcgccgggcgctgcgcagcgatcttcctactacgcatgagtccgttgtgacgctgcgcaacaaggaggtgcgtcatgtctgatgctattcatcagtcccggcgtccgcagggagagtggcagattatccgctgccagcctgccgccgccccgcagccacagacattcagctggcggagattctggcgcggcctgcaacagtgttttcgcttaatggtcggggtgcaggattatcaaaaatatctgcagcatatgcgactccatcatcccgatcagccgccgatgaatgagcgcgatttccaccgttactgtctggatgcccgcttccccagccaggcaggcaaactgggtaaatgtccctgctgaccgcactaaacagccccgcaccgtcggggcttttttgtgccattcttatctggatgggaaaatatattcggtttgcatcttgtgctggcgtcagatgatgaatactgttgctaaaataatgagataacgcctgcagagcacttcccggaggaagtttccatgaccgatgaacaagggcaaacgttgttgtacacccttttcggtacaaccagccctcattggcgtctgaccgcggacagcgatgcgttgcattttgccgaagatgagtcgtcacaaactaatatcgccctgccgttaacccccggccaggcagccatgatacgcgcgatgccggtcatcacttcaagcatcaatctgactatgacgctgcagggcattgatgttccgatgcattttgtcggacgcaaagtgaaccaggcgacctgggcaggaaccgcttctgcctggggcgatacctcagcggtcgcccgcgacttaaccctgggtctttcattcgccgaacaggtggtttctgaagccaactcggtgattgtgatcctcgatcagcgcggcaatattcagcgttttaaccgtcttagtgaagaatacaccggtctgaatgagcatgaggttatcggccgtaacgtctttcagctctttatgaccaaacaggaggcctctcagtcacgacgcaacattgcgggcttcttccgtgacggtaactcctatgaggtggagcgctgggttaaaaccaaaaaaggtcagcgactgtttctgtttcgtaataagtttgttcacagcggcagtggcaaaaatgaaattttcctcatctgttctggcaccgacataaccgaggagcgacgcgcccaggaacgcctccgggtgctggcaaacaccgatacggtgaccggtttgcctaatcgcaacgcaattcatcaacagattagcctggcgctggagcgatctgagcgcgatgagaccggcgtggtctacctcgatctcgataatttcaaaaaagtgaacgacgcctacggtcatatgttcggcgatcagttactgcaggcggtctcactggcgattcttagctgtctgggtaaagaccagactctgggccggctgggtggcgatgagtttgtggtgctggctgagcacaccagccaggctgcgctggaggcgatgtcctcccgcattcttgagcgcctgcgtcagcctttccgtatcggactgatcgaagtgtacagcggctgctctatcgggatcgctttcgcgccgctgcatggtgaagatcgcgagagccttattcgcaatgctgacaccgcgatgtatcacgccaaagagaacggtcgtggcaagttctgtgtcttcgcggcagagatgaaccagcgggtctttgagtacctgtggctggacaccaatctgcgtaaagcgctggagctggatcacctgctggtgcattaccagccgaaaatcgacagtgatggtgaagtccgcagcgccgaagcgctggtacgctggaaactcacccgagcgcggcctggtctcccctgctgatttcattccctatgccgaagagtcgggactgattgtgccgctgggacgctgggtcatgctcaatgtgctgaaacagattatcgtctggcgccagcagggcatttttctgcgcgtcgccgtcaacgtgtcggcacgtcagctgattgatcaaagcatctatactgacctgaaacaggcactgcatgaggcgaatatcaccgactgtcctatcgatattgagctcacagaaagctgcctgatagagaatgaagctgaagccctgcggctgatgaagcagtttcaggagctgggcgcacaggttcatctggatgacttcggcacgggttactcatcgctttctcagctcgcacgtgtgccgatcaatgccatcaagctcgaccaaagctttatccgcgatattaataaacagcccgtctcacaatcgctggtacgagctattgtcgccgtcgccaaggcgctcgatttgcaggtgattgcagagggtattgagaccccggatgaagagaagtttgtccttaacagtggtgtcgatgggcgtcagggctactactacgcaaaaccaatgcccgcggaacagtttgggcattggctggctaagcatcctgcccgcgtttaacgctaattcagattaacccgctttacgcagtgatgcgctgtggcggttttgtaactgaaccaggcgttccatgtaagcaatgtctttaggttcgatggtaaaggcgtaatcgacccaatcttcggtaatatccatcagctcagcgcgtgacaattgcagcacgcgctgacgcgctttcagcatagcccgcacgccattgagtttaggacgtaacgtatcgataaaggtgcgggtggcgcggtaactgtcgccaggctggaagactttatccaccagtccgcgcgtttcataccactctgcgctgtgggactccccttcacaaattaactcctctgccagtttcatgccggaacgacgcgcgaccagtgagtagccgcccatgccgggaaagaggttaaacgcaatttccggaaagcccatccgcgcgttgttctgcgccagaatgaagtgatgcgccagcgccgcttcgaatccgccgcctaaggcactgccctcaatcatcgccagcgtcaccgcgccggtatcaaacccccgtgctgccgaatggatgcagtcaacgcaggcacgggcataggcccgcagcgcctcacggcggttattgcgaatgcactcgacaaagaagcgcagatcgccaccggcgttgaacatctgtggcaccagagagccggtaacccagaagtcgatcggcagaccggaacgctgagcggcgtagctcagattcatgatctcctcaatcagttcatggttgaagctcggacggggctgtgcacgcaacatcatccacatagtacgacgcccttcttcgtaataggcgactaactgcgtggtgttgccgacttcggtaaataatctgcacgttgcttggttaataactgtcattgtctcatcctctgtttatatttgatgcgttaaatacgccacatcagcgtaatgcagagtgaggccagaccaaatgagagattgatttacaacacaaaatccagagagatccccgactcgcgcgtcggggattgattaggcgggttacttaatagcggcacgctgctccacggcaacatgaagacgcttaacacgttttgaatagatggccgtgatgatcggcaccagcacggaggtcacaatcacggacgtcgccaccagcgccgtggcagcaggggcaatcggtttaaactgcggcagcatctcggcaatcagcaccggtgtcgccaccgctgcgcctgccgtactggatgcagctatgccagccgtgccatccccgcccccaatcagccgatcggtcagaatgagtgggatgccggtaataatgatcaccgacacgcccagcatgatgcccagcagtccggtttccgcaatgacacccaggttaatggtgttacccagagcaaaggcgaagaacggaatcagcgtatggaccgcttttccgaagaagtcgcgcagctccggatcaagattccctaatgcaaaccccacaataaacggcaggaccgcccccacaaacacgtgcggctcgaatgaggcgatgccggcggtgcccaggataaccatggtcattaatggcccggactccagagacatcagcacaaacgcacccgcctcctctttggaaccatattgctgcatgatcgaggcataaaggccgccattggtcatatccatggcagccaccagcgccagcgtcgataagccggcaaacatccctacttctacgccattctccggcatcacccgagaggcgatggcagctacaacccaggcgacggcaatcttggtaagcaccagcgtgcccgatttacgcagtaccgtcccggtggcgctgagtttaatcgacgcgcccatacagaaaaaccagacggccagaatgggtaccgtgccggtcatcaggccgttggtgaaagaaccgaaatatttcccggcgcctggagaaaacgtatgacagagtgcgccgataaagagcggaatgagcatcataccgcccggaattttgtctattgcacgtttgatatgcatatggatgtcacctttgctatgccagagggtggagcaggaagtgcccgaaggcgatgcaagcaaagtagtgacttgaggtaatcaaaacagtgatcgcctcgataaaatgaaacgctgttttatttttaatgacctgttgttttgataactatgatggagatcgccataccagtctcagatgagactaaaaaaaacgggacgccgtggcgtcccgctcgctatttttgcccgtaccaggcgttctcgccatgctttcgcaggtagtgcaggtcaagcagcgtctggttaatcggcggcagattagcggtcagctgctggctgaacaggcccatatacgccacctcctccagcacaaccgcgctgtgcaccgcagcatgagcgtctttcccccaggcaaacgggccatgagagttgaccagtaccgccgggatcgccgaaggagacaacccacgttgcgcaaaagtctcgataatcacctcaccggtgttccactcgtagtcgtgctgaatctcttcattgcgcatcgaccgggtacaggggatctcaccatagaagtcatcggcgtgggtggttccccaggcaggaatcggtcgtcctgcctgggcccagatggtcgcatgccgcgaatgggtatggacaatgccacccacttccggccaggcgaggtaaagcgcgcggtgtgtcgccgtgtccgaggaggggcgtttatccccttccaccacgtcgccactcgccagatcgaccacgaccatgtcgtcgcgcttcatcacttcatagcgcacgccggaaggtttaatcaccagcaaaccctgttcgcgatcaacagcgctgacattgccccaggtgaaggtcaccaggttgtatttgggtagatccagattcgcttccagaacctgttgtttcaggtgttccagcatctattttctcctgctgacaatcgtccctgaattttgcggagtcggacgcgaaagagttatggagcaaatggctataaacgcagaaggaatggctgtgaatgcaaaaatgtgtcgtgatttcagaattttctatcttcggaatttaaccagaacgcttagaatcctctcaggcaatgcgtggccctgtcgggtttacattgcgactctcccgctacaaacggtttgtccatggtgatcacatttccatgccgacacggatgcggcaatgatgcgacacaagcgggctgaggaaatatcggagctatactaagagtgttgcctctgtgagcacatcaaaggagaagtgtatgacaacaacaatgaaacgaatcactgccgttgtactggcgactacgttagctgttgcactgagcggctgttctaactggtctaaacgtgaccgcaacaccgctattggcgcgggcgcgggtgcgattgggggttcagtattgactaatggtagcgcactcggcacagtcggtggcgccgctgtcggtggtattatcggtcatcaggtccactaaagaccttattaaaagaataatcggctacgctaagcatctacacaacaatcgggctacttcggtagcccgattttttttcagccacccgccagtttgaccttcatgcctttggcttccagcaggcttttcagtaaatcgcgcttatccccctgaatctcgataacgccctctttcactgaacccccacagccgcacttctttttgagttcggccgccagcagcgtcaatgccgcgtcgtccaggtcgataccggtgatcaggcagacgccttttcccttgcgaccactggtctgacgctggatgcgcacaatgccatccccttttggccgttccttcgccggctccggctgggtaatgcgcccgctgtcggttgagtaaaccagtggattatccttcgccattattgtgtctccagactgtgcaggatcgcctgcagagtggcggcgggatcggcggattgggtgatcggacgcccgataaccatatagtccacgcccgcctgcttcgcctgctcaggtgtcatgatgcgacgctgatcgcctgcatcactgcctgccgggcgaatccccggcgtaaccagcgcaaactcctgacctaaaacctgtttgaagcggacagcctcatgggcggaacagaccacaccatccagcccgcacgacagtgtcagcttcgccagtcgctctgcctgtttcggcaggcgaaagcgtaatgcccagccctttaagatcttctgcatccatactggtcagtacagtcaccgcaataagcagaggcgcatccttaccaaagggaagcagtgcctcacgcgccgcgttcatcatccgtgccccgccactggcatggacgttgaccatccagaccccgagatcggcagcggccgccacggcatgagcggtggtgttgggaatatcgtggaatttaagatcgaggaagatttcaaagccgcgctgctgcagagtgttaaccagcgaggggccaaatagcgtaaacatctctttgcctactttaaggcggcaactgcggggatcgatctggtcgacgaaacgcaatgcgctgtcgaggtcatgataatccagcgctaccagaatcggcgaagcggtcacgttgtggggtgaaggcatggcatttcctctgcaacaggcgcccgcaggcgcaatagacaaacggcaagcattctacctgcggtgtctgaccatcacaatcgccattgcccttctgcctggcaaattctgctctgttgctgagggttgtaagctaattcaacctatagtatgttgtaactataatgagctattaatggtgcggctgcagcggccggtttactggccgtcgaggccgcggataggcttaaccgaagaccaggtgcggcaggatgggcaatgccagtagagtgcgtgggcggtaaagccgcacttctggcagcgatagcgcggcttggtgcggatctgttcgccgaccatgtcacgcaacaccatcaggctctctttcgcccggccatcttccgcttcatgcagatttaaatccatcaggcggtggaacacccgcatggtaggatgacgctgcagctgacggctgatgtaattctgggccgcttcgggcccctgctgctgctcaaggatgtcagacagatagagctccgcagccgcgccggtgttctcttcaacacagcgatgaagaaactctgaccaggcgtcgggctgattgagctgctggaaacaggtttccagcatccccagcgtttcactcaccagctctttatcctggtccagcacccgctgcagatggcccaccgctttagcgtaatcgcctttttccatcaggatacggcccatcatgatcgagatacgtgcgctgttgcgatcggccgactcccctttcttcagcaggctcatggcacgatcgagatcgtcgctgctcatcgcctgcagagccagttcgcagtagaagtgggctatttcgcctttctgcttctctttgccaagcttaaccagccgctctgcgacttcaatcgcctgctgccagtcgctggttgcctggtggatcagcagcagttgctgcagcgcacccacgcgaaagtcagtttcatcggtgagctgcttaaacatatcttccgcgcggtcatataagcccgccgccatatagtcgcggcccagttgctgtacggcaagcagtcgctgctcatagctcagggaggcgctttccattaaagcctgatggattcggatggcgcggtcgacctccccgcgcgaaacggaacagattgcccagcgtcaggtgtgcttcaaccgtgccgctgtcctctttcagcatctcaaggaagaggtcgaccgctttgtcctgctgattggagagcaggaagtttacgccagcgacatattcacgtgacagtcggttggcttcctgttgcttatcctgatgcgcgctgcgacggcccatataccagccatacgctgccgccaccggcagtaacagaaacagcaattcatgcatcagggattattcccggccagccggagaagatggcgtggtcgccagggcagtactctgctcgatttgggtctgcatacgcttaattttccggttggcattcgccagggagacgcgggtccgtaaccagaacagaccgcagatgatccagccaagcacgaaacctgcgccaaacagggatgccagtaaggtcgagatgctgaactcaccctgcgccagcagatagttaaaagtaatgacctgatcgttatgcgcacccagggtgacggaaataatgaaaatgaccagtaccactaaaaaaatcagcaaatatttcacagtgcatcctgttgtgaggttgtcgggtagaattatgccaaaactccagcaaaaatgctgctcccagcagcatcgggcgggtcgcttttacgcaggcccgtctaataatatggggtcttacgggtgaattacaatcagggctcccgctgcgccacctctttttgctcttccggcggcagcgtcagcgggccacagaatcgctgcgccagccaggtggcaatggtgaccagtagccaggagagtatggttgccatcgccagatcccgtggccagtgcatgcccagcagcagacgactcgccattacgccggtggcccacagaaagatcaccaccacggttttatagtgccgacgcggccagagcagacccaatgccagcagcgcccagctggcggcaaacatagtatgtcccgaagggaaagcgaaaccggtttcaaacgcccagtgccgtttcagccagcctgggatctgtgtctcatcggcaatcagtgaggttaccatctcgccacgctgtttgcgcttcagctcgtagaaggtcttttcatccagcccgtgatgctgttccagccagatcacatagggacgcggctcctgaatctgctctttgatataggatttggtgtattgcccggccagaatggtggcgttcatgatcagcagcagtaagatagctggcttcagccgaaagcgcaggcaccagagcatccaggcactcagcacgacgctggtaacaatgccccaggggttggtgacggtctcggtcatccagaagagacctttcagcagcgcattgctttcgcctggttgccagcgccagccgctcagccagactgcaaccggcatgattagcagcagcagcattccaaaggtggtacgacgtgaaatcttaaacatcctcttcccttatcccggcgtcaaaagacagcaattgcataactttagcttaaaaaagaataacataaccgttgccgattggataattgtgctttatcactgcaattggtatcagagattaccagcccgcttgcgggttgtggcacaatattgcacgtttgtcgggccacactggcctgtgcactatcatgatgatagtgcatcctctgaaggtttctggagagtcacatgcagcttaaacgggtggcagaagccaaactgcccacgccatggggagatttcctgatggttggttttgaagaactggcaaccggacatgaccacgttgcactggtttttggcgatattaatgataacgagccggtactggcgcgcgttcactctgaatgcctgaccggcgatgcactcttcagcctgcgttgcgactgtggttttcagctggaagccgccctcaatgccatcgcagaagagggtcgcggcgcactgctctatcaccgtcaggaaggccgtaacatcggtctgctgaacaaaatccgtgcctatgcgttgcaggacaaagggtatgacacggtagaagcgaaccatcagcttggctttgccgccgatgagcgcgacttcacgctgtgcgccgatatgttcaaactgctgggcgttaatgaagtgcgactgctgaccaataacccgcgtaaagtggagatcctcagcgaagccgggatcaacattgttgaacgcgtgccgctggtcgtgggacgtaatccaaagaatgcgcactatctggatacgaaagcggaaaagatggggcatctgctgccgaagtcataaataagctgggactcactggcatctgacccttgaagaagccaaatctgagagaatcctgaagcaacggatcagctcaacgcgcagggggcacggtcagaagaagaaagcgtcccgtcgcccggataaaaacgccgggagcgtttttgaacaacgcaaagtgttggcccggtacgggcgcacctcagggatgaggtgcgtaattgcgcgggccgggcatgtcatggatgacggcttttgcgtctttccgatctgaccgtgttccctgtgcagccacggtctcacagcttcttattacagactttgtaagctacataaaaaagccgggtttccccggcttttttatcagtccagcatattgcggataacgtagtgcaggatgccgtcgttgcggtaataggtcagctcattaccggtatcaatgcgacagcgggtgtccagctcttccttactgccgtcagcacgggtcagcgtcactttaacgctgcaaccaggcgtcagtgcctgaagattttccacgtcaatgcgctcctcaccggtcagccccaggcttttgcgggtcacgccctgcggaaactccagtggcagaatgcccatcccaatcaggtttgagcggtgaatacgctcaaaagattccgcaattactaccctgaccccctgcagacgtggtcctttcgccgcccagtcgcggcttgaaccagagccatactcaagtccagcgatgaccgccagcggcacgccttccgcctgatatttcattgccgcatcatagatggccagctgttcgccacttgggtagtgtcgggtataaccgccctccacgccgggcaccatttcattacggatacggatgttggcgaacgtgccgcgcatcatcacttcatggttaccgcgacgcgaaccataggagttaaagtctgtacgctccacgccgtgtgacagcagataccggccggccggactttccgctttaatgctgcccgccggtgagatatggtcagtggtgaccgagtcgcccagcatggcgagcactcgcgcaccgcgaatatcctgcaccggcttaggctctttctccatatcgtcaaagaaaggcgacagacgaatataagtcgagccctcatcccagtcgtaagtcgcggcttcactcaccttaatctcctgccactctggcgtaccgtcgaagacttcagcgtactctttatggaacatgtcgctggtgacctgctgcacggccgtagcgatctcttccggcgaaggccagatatctttcaggtagaccggctggccctgacgatcgtggcccagcggctcggtctgcaggttgatcttcatgttacccgccagcgcataggccaccaccagcggcggcgacgccagccagttggttttaatcagcggatgaatacggccttcaaagttgcggttgccggacagcacagcacctactgtaaggtcgccggctttaatcgcagactcgatttcatctttcagcgggccggagttaccgatacaggtggtgcagccataaccaaccagattaaagcccagctcgtcgagataggaggtcagttgcgcgacggccaggtaatctgaaaccactttagaaccgggtgccagcgaggctttgacccacggctgacgtttcagaccccgctcgaccgctttcttcgccagtaaaccggccgccattaagacgctggggttggaggtgttagtacaggaggtaatcgcactgatcaccaccgccccatcggtcagcttatgcgtcagtccggtatcactgtcggtatactcaatgattttatggggtttctgcgcctgattcacttccagctcgttgctggcatcaaacgcggcgggcacatcgcccagcgacacccgatcctgcggacgttttggtcccgcgagactcgattccacctcgttcatatccagcgccagagtgctggtaaaacgcggctcatcgccaggattgcgccacagcccctgcgctttggcataggcttccactaatgctacctgttcggcatcgcgtccggtcagggtcatgtagctcagcgtgacgtcatcaaccgggaagaatccgcaggtcgcgccatattccggtgccatgttggcgatggtcgcgcggtccgccagcggcagatcggccaagccatcaccgtaaaattcaacgaatttaccgacaacgccgtgcttacgcagcatctgggtgacggttaacacgaggtcggttgccgtaatgcccgcccgcagtttgccggtaagtttgaaacccaccacatccgggataagcattgagacaggctgaccgagcatggcggcttcggcttcgattccccctactccccatcccagcacgccaagcgcgttgatcatggtggagtgagagtccgtaccgaccagcgtatcgggccaggcatgctcttcaccatcaacggtttcatgccagattgccttgccgagatattccaggttcacctgatggcaaataccggttcctggtggcaccacgcggaatttatcaaacgccttctggccccagcggagaaagacgtagcgctcatggtttcgctccatctccagccggacgtttctcttcaaaggcgtcatcattgccaaaatggtcgacagtcaccgagtggtcgataaccagatcaaccggtgacagcggattaactttcgccacatcgccgcctagccgattcactgcttctcgcatcgcagcaaggtcgactaccgcaggcaccccagtaaagtcctgcattaatacacgggctggccggtaggcaatttcacgatcggcgtgggcatctttttgccagtcaaccagcgcctggatgtcctccgtcgtaacagagtcaccatcctgatagcgcagtaaattttccagcaggaccttgagggattttggcaggcgatcgatattgccaaggtgttgagcagcatggggaagactgaagatgtgatattttttggtgtcgacctgcagtacttcctgactctgctcgcgtagggtagacgacatagctcctcctttcattcatggtctttaaacctcagagagacaaaggtttatgttaaagatagaccacaatttcgttaacgttttgattacaacacaaattgctacaatcgatcgcaaacgaaaatgccccgtgaagtcacgaggcatcatgaaaaggtgattttaattcaaattacagggttatccacaccgccgcagaccagaaacgcaaaggagaatgcatacgcgctgagccaggacattttaataatattcatttggttcactccttcgccggaatcgggcgtaaaagtttttgcggtcaccttatagaaagaggcgacaccctttggtcgtacaggatgtggtaggggcatttataggcccaccggaaattccggttttaaaagaacagtgacgaagaaatggtctgaaaacgttatttgtttttagggtccagaaacgactcaataaaaagtctctggttatcactcaaatcccatgaatcggggatagacactttttcgtcctttgcaaggggttcttttcctttacaggagaccgtcttgtgctgacccgaggtcagggaacgtttatggctgagtgtatttgcccacatggctttagccccagatacgccaaatcattaacgcgacaactacccaaaacagcgcagaggcagcgaatacggttaaccaggctttgcgacgagtgttgccggtacgctcaaccttggtgctttttgccgggaaacccggttgtacagtcagtcgtgtattcatagtttttgataatcactctcaacaaaatgattgataacatcgattaagatttaggaggaatcctaaacgcgttaaggccaaaaatccagttatttttattgagtacaacgattaacggtattaatcaatgagctcaggtaacgtaagaaatcattaataccggaactaatatttaattaaaaaacccgctaaaaaatttgagttaatttaaaaacagatccactcaaaactatagatgacacttaagaaccttatgtttactggcttcccacgttagctcttaactggagtatgggaatattcctggcaagccgcaaagtgacatagttaaaaatgtgttgtaattcgcatttaagaaagcccgatgaggaaacatgtgatcaatgtttcatttacaaaaaaatcataaaaacttttgagtctcatttggcgctaaagcctggagacaaaaaaggctgcaccaggcagccttatgtttacgcggggaggttaaattctatttaaacggcagtttgatatctttaaacatcgcttcaatgtcttcattggagcgcaacgcaaccgcagtatctaccacatcgcgcgtcaggtgcggcgcaaaacgttggataaaatcatacatatagctgcgcaggaaggtgctgcggcggaatccaatcttagtggtgctgttggtaaagatatcggcggcttcaatgcgaatcaggtcaggatcggccaccggatctactgccatgctggcgataacaccaacccccagacctaagcggacataagttttgattacgtcggcgtcggtcgcggtaaagacgatgcgtggcgttaaacctgcacgattgaaagccgtatccagttctgagcgcccggtaaagccaaaggtgtaggtcaccagcggatattcggccagctcctcaatggtgacctgcccttttccggccagcggatgatcggcagtcaccacaattgcgcgattccagtggtagcacggcagcatgattaaatcgtcatagagatgcagggcttcggtggcgatggcaaaatccgcattacctttggagacggcttcggcgatctgggttggagaaaccctgatgcatatgcaaagagacgcgaggatagcgctcaataaatcctttgatcacaccaggcagcgcgtagcgagcctgagtgtgcgtggttgcgacatagagcgagcctttatcaggccaggtgtgttcaccggctaccgatttaatcgcatccactttggagagaacttcacgcgctatacggatgatctcttcccctgcaggcgtgacctgggtgagatgtttaccgctgcgggcaaagatttgcacgcccagttcatcttccagcatacgcacctgtttactgatgccgggttgagaggtgtagagaccttccgccgtcgaagagacgttgagattgtgattaaccacttcaacgatatagcgcaactgctgtaatttcatatctattccatcccggtaagttacagagtcgcatccccggttgacgtatagtcgcgagggtaaagagatgctatgcatcaggaaaggtcggaaatgctataacaactatatcagtttaagtgagagagtagaacggattgatataaggctcagaaaaaggccagcgagcgctggccttcagggattactttttcgcttcctgccatttgccatctatatagaaggccgaccagccggttgccttgccctctttttctgaggagacatactgctgtttggtcttgcggctgaaccgcaccagcgttttgttgccttccggatcggctgctggcgcatcggccagatatttcagcttctcaggcagacgatctttgaagcgctgaagctcttccaccagcggcgcacgcgtctcgcgtgatttcgggaaggtgttggccgcgaggaaaacgcccgccgcaccgtcacgcaacacgaagtaggcatctgacttctcacacgccagctctggcagcggaaccggatcctctttcggcggagcaacttcaccactacgcaggatcttgcgggtgtttttgcactcttcattggtacacgccatgtacttaccaaagcgtcccatcttcaggtgcatctccgaaccacacttctcgcactccactaccgggccgtcatagcctttgatgcggaattcgcccttctcaatctcgtaaccatcacactccgggttattaccacagacatgcagtttacgttcgttatcgatcaggtagctgtccatggccgtgccacacttctggcagcgacgacgggcacgcagggcgttggtttcagcatcatccccttccagaatattgagaacttcattttccgggatcaggttgatggtctgtttgcagcgctctttaggtggcagcgcatagccggaacagcccaggaagacgccggtactggcagttcgaatccccatcggacggctacaggtcgggcagtcaatcgaggtcagcaccatctggtttcggctgcatcccgccctcttcaggatctttctcagccagttcaagctgctgggtaaaatcggtgaagaagtggtcgagtaccgctttccattgcgcctggttattggcaacctggtcaaggttgctctccatgcgggcggtgaaatcataattcatcagttcgcggaagttctcttccagacgatcggtgacgatttcacccattttttccgcataaaaacggcggttttcaacccgtacgtagccacgatcctgaatcgtcgaggtaatggcggcgtaggtggatgggcgaccaattccgcgcttctccagctcacgcaccagtgacgcttcgctgaagcgcgccggtggcttggtgaagtgctgaccgggcagcagttgctgcaggtccagaacatcacccacgcttaccgcaggcagcgtacgatcttcatcattcttacgcagcgcaggcatcactttggtccagccgtcgaaacgcagaatacggcctttcgctttgagccggaaatcaccggcggcggcagtaatggtgctggagtcatattttgctggtgtcatctgacaggcaacaaattgacgccagatcagctgatagagtttctgcgcatccgcttccatatctttcagcttttccgccaccacttccacatcagaaggacgaatcgcttcgtgcgcttcctgggagttctctttgctggcgtaagttatggcgttttcaggcagatactttttaccgaaattgctttcgatatagccacgcgccatggcgaccgcatcctgactcaggttggtcgaatcggtacgcatataagtaatgtggcccgcttcgtacagccgctgggccatcatcatggtcttcttgacgccaaagccgagacgggtgctggcagcctgctgcagtgtcgaggtgatataaggcgcgcccggcttgctgctggtcggcttatcttcacgatccacgatctcatagcgcgctttttccagcagcgcgacggcggcatacgtctcgtcgcggttgaccggacggaaggctttatcgcctttgtgcgtcacgtccatcgacagctcatcgcctttcggcgtggtcagcgcggcattaacttcccagtactcttcgggaacaaaagctttaatctcacgttcacgttccaccaccaggcgaacggcaacggattgcacacgtccggcagagagaccacgggcgatctttttccacagcagtggcgagaccatgtagcccaccacgcggtccataaagcgacgcgcctgctgagcattaacccgatcaatattcagttcgcccggcttttcaaacgcctgacgaatcgcattcttggttatttcgttaaacacgacgcggctgaagcgcgagtcatcaccaccaatcacttcccgcaggtgccaggcgatggcttccccttcgcggtcaaggtcggttgcgagatagatgtggtcagcattggcggctaacgccttcagttcggcaaccactttctctttgccgggcagaatctgatagtccgcttcccagccgtgataggggtcaacacccattcggctgacgagtgcggccttctcatcttttttaacttttttgacttttttgtcagtcgaagcgtctttgactttcttatctgtcgaggcgtcagcactttttttcgcggttgaaccactggtcggcagatcccggatatgacccacgctggatttaaccacgtaatcactacccaggtatttattgattgttttagcctttgccggggactcaacaataacgagtgctttacccatatttacctttacctaatgaaaacatcctgcttaacgggagaggattggatgcccaaaaacccaatgggttcaatattgctgcgcctgtttaacatttcaaggcggaggggtcaatctcagatcagatgatgtggcgttatgcaactgcatgataaagagtgctttttctatctgaactcatcgcacatcctggtgcaaaatccctgaaatcggaatcgcccacactctacctgataaaatctgttacgcaacttaattagcactcagcccggacttacgccaggttttcatcgattacaccgatttgtcacaccctgtgactcgccagtaatatagaaaggattggagtactgtcaaacaggagtgaataaatgcagagttcaactcaggctatttcccgccaggcgttgctggaaaaggccaatgcgctgatcaaagaacatgatgattattaagcgggaatgcaggcggatgaggtgattcagcagggtgaagtgctggtatttcgcggaccgttttttctcgatgccgatggagtgccgacggctaaaaccacggcggtgtttaacgtgttcaaacaccttgccgtggtgctgtcgccgctctaccacctggaatgaaaaaacccggcgcaggccgggtttagcatcatcagatcatcagagcagtggcttttcgccgcgctgccagagtttcagcagcaggcgctctgccaccgagccggcgctctgcgtaaagcgatccatcaccttacggcggcgggcataatgcacgccgagcacgctgaacttatccatctgacggatgatcagatcatcgctggtgccgatttcgtcaaccaggccgaggtccagcgcctggcggccataccagtgttcaccggttgccacctgatcgatgtcgagtgacgggcgcatctggtggacaaactgcttgaacagcaggtgcgtttcgtcgagatcttcctggaatttctcacgtccctcttcggtgttttcaccaaacagcgtcagcgtgcgcttgtactgtccggcggtatgcagctcaatatcaatatcgttccgtttcagcaggcggttgaaattggggatctgcgcgaccacgccgatggagccaataatcgagaaaggtgctgccacaatacgatcggctacgcaggccatcatgtaaccgccgctggccgccactttatccacggccgccgtgatacgcagaccctgatcgcgcagacgctgcagctgcgaggctgccaggccatagccatgaaccacgccgccagggctttcaagacgcagcagcacttcatcgccaggctgcttgacggccagcacggctgaaatctcttcgcgcagtgaagtcacctcatgggcgtccatgctgcctttgaaatcgagtacatagagcgtgggcttcgcactgtctgtctgcccctgcttcgccgcctgcttttccgctttggctttcagcttttcacttttcttatgatttttcagccagactttttgtgcctgaggcttcatttttgccagctgcaaatcctctttcatctgttgatagtcatcatccagatgtgtcagtcgaagctgaccgttttgtgcccgtttgcgtaacgcggcattcatcacaatcatgacaatcacagcgacggcaaccaccagtgtcaccactttcgctaaaaacagtccatacgttgaaataaaatccataggtcgccttagtgaactgagaatcaaaaacagttcgccagtttagccgttttgccccgcttcgtcgcctgaaatgccagcagctggcacagaatgcgtgggttggcgattgcgcccattcgtaaattcaggcataaagcggaatcatgctgttttcgctggaggaccccgctgtgcattatcaaccgaaaagcgacctgctcaatcatcgcattatcctggtcactggcgcttcagatggcattggccgggaagcggcgctgacttatgcccgctatggcgcagaagtgatcctgatgggccgtaaccctgagaagcttcagcaggtcgaacaggcgatcaatcaactcaatctctgcccggctcacactgtggtgttcgatctggccgaagcaacaccggaacgttgccagcaggtggcagaaacagctggcacagcagttcccgcgtctcgacggcgtgctgcataacgccggtatcctcggtgagattgtgccgctggctgaactcgacccacaggtctggcagcaggtgatgaacatcaacctggacgccaccttcttcctgacgcaggcgctgttgccgctgctgttaaaatcggatgccggttcactggtgtttaccacctccagcgtgggccgtaccggtcgcgcgggctggggggcttacgccgtctctaaatttgctaccgaaggcatgatgcaggtactggctgatgagtataagaaccagtcgctgcgggtgaactgtattaatccgggcgggacgcgaacaaaaatgcgtgccagcgcgttcccgcaggaagatgccaataagctgaaaacccctgccgatttgatgccgctctacctttatctgatgggtgatgatagccgtcgtaaaaccgggatcagctttgatgcccagccaggcagaaaaccgggagccgctgaataatggctgacgatcgtcatcaacagcgtcagcagcggttaaaagaacaggtagatgcgcgtattgctgcagccacggaggttcgtggcatcctgatggtctttaccggcaatggcaaaggcaaaacgactgcggcctttggcaccgcactccgcgccaccggtcatggcaaacgcgtggcggctatccagttcattaaaggtgactggccgaatggcgagcgaaatctgctggaacagcacggtgttgaatttcaggtgatggcaaccggctttacctgggatacgcagaaccgcgaaacggataccgccgcctgtctggcggtgtggcagcatgcaaaacggatgctggccgatgagcagctggatctggtggtgctcgacgaaatcacctatatggtcagcatggattatctgccactggaagagctgatagcggccctgcaacagcgcccggcgcatcagagcgtcatcattaccggacgtggctgtcatcgcagcctgactgagatggcggatacggtgactgagatgcggccggttaagcacgcttttgatgccgggatacaggctcagcagggaattgactggtaacagaaaaagaaaacgcagccctggggctgcgtttttagcgatcgggcaacgtgattaaccggagttacgtttgctgcccggattgcggcgtggtgcacgtggggtgctgctcactttactgtgacgtttcacggcacgacgaatctggttcgctttggtgcgacgacgatctttttcgaccaccagtttggtaaccgtttcatcatccatctccaccagattacgcaggtagttaaccgcaggcagatccagttcggtccagccaccgcgtggcaggccttttggtaaggtgatatcgccgtagcgaacacgcatcagacgactgacctgcacgccgaccgcttcccataaacgacgcacttcacggttgcgtccttcggtcagggtcacgttgtaccactggttgatcccttctccaccgccaaatttcagggttttaaaggcagccgggccatcttccagctgaacgcccttgctcagctgacgaattttatcatcgtcgacctgaccaaagacgcgcaccgcatattcacgttccacttcacggctcggatgcatcaggcggttcgccagttcaccgtcagtggtgaagagcatcagaccacaggtgttcacatccagacggccaacggcaatccagcgtgaaccgcgcagacgaggcagacggtcaaataccgttgggcgcccttcaggatcgctgcgggtacagagttcaccttctggtttgtagtaagccagcacgcggcaaacttcggttgctgattcagcaatcgagaccagatggccatcaatacggattttcagagatttgctgctttcaacgcggtcgcccagggtggcgatcttgccgtcgacgctgacacggccagcggcaatcattgattcgatttcacgacgcgagccatgaccggcacgcgctaagactttctgtaacttttcgctcattgagcttcctctttgtcgccttcccaggcgtcacggtagggtgataattctttctgaatcaacaggttaacctattaattcggccccattatacaggcatttacccctgaagtaacgcgctttatgagtgggtctgaagcgaattaagaagggtcagcctctgatagttttagatctgataatatctgacgctgatttaaataatccccgtgcatctgacaggaataagattaataaaatgcatgtattaaaaactttatagctgatgacaattaaattttctaaccactttagtttcatcaacgtaatgttctggtgataaaaaccttaacactatcttacactttcgctggttttcccttgcttttattcttcttaaaaaaacattaaagttagcacaaacaactgttttaatgacttaatccattataaccgctcggtaaatacaaaaaacccagattttttctaacgcagatttatttaaggccttattttcaaggacatttgattcttattagctttaataaattgtacgacactattaagctgatatactttattcctgtagcacaataaaaagcaggactcacgacagaggggtcttgcaacaatgaagtccggcttttgttattcgtttataaaaatagtctttttagattaatccaataaaccggcgcatccggagttgttgcgttaatacggttcagtgatgaaccttgcttgcatgtcaaaaatcttcaccagggatttcccgacatgcctgaataaagaaacccatcatgaaaaacctgttgctgtgcccggtgcttgctgcactggtgctgagcgggtgttctgtgggccatactgagtacagtcgtacggcgatgcagcacgtagatatgagcgtgactggcattccgacgatcctcggtctcggcacactgggcaccagcattcctctgacgcctgaatatagcctgacagctgcgcacgttgccaaaactgccgtgcagcgcgtcaagtcttatcacccttattgcgaccttgcgattatttatcacaagaatgacgccagcacgctgactaagttccgcagcagcgacatcggcgatccggttaaaatgtatggctacagttttatttcagcgatgccggttgaatcgaccggagttaatttagcccgtacggctattcggaataactggaataaaagtccctgtatagccatggcctccaatgcaggtgttgttcaggggatgtcgggcggcggcgtttataaccgtgatgatacgctgggcggcgtgattgttggctattctgactcgattaaaaatgggcgtaataacaaagtgatcctgaaagatgtgtcactttatattccttacggccagtttaaaagctggctagagtcgaatctggcccagacaccgacacgcggtgcctgagcctgagggcttacaggaacgggcgggtatcgcccaccccttcacgcacaatttccggcgcatcggtggtcagatcgaccaccgtggtcggctgctggcccagcgtgccgccgtcgataatcagatcgaccagcttgccgatgctgtgctggatctcttccggatcggactcggtgaaatcgttgcccggcagaattaatgaggtcgacatcatcggctgattcagtgcttccagcagcgccagcgccacgggattagagggcacgcgcagaccaatggtcttacgtttttcattcatcaggcggcgcggcacctctttggtcgccttgagaataaaggtgtagttgcctggcgtgttgtttttcagcaggcgaaacgctgagttgcccacctgcgaatagaccgacagctcagagagatcccggcacatcagggtaaagttgtggtgcccgtcgagctgacggatacgacagatacgctccatcgcgcccttctcctccagccgacagcccagcgcatagccggaatcggttggataaacaatgacgctgcctttgttcaggtagtcaaccgcctgattaatcaggcgaggctgcgggttgtccggatgaatatgaaacaattgactcatagaaacctcgtgtcacctttccgtgattgccaggctgggagccagatccgggaagcgctcccagaccggctcaaccgccgcgggcagccagagtttgcggcccagttcaatccacggacagggttgatgaaaatcagaaccttgtgatgcggccagttcattatctctggcgtattgcgccagcgtcgtgcgctcattaggtggctgctggcactgcgcgacttccatcgcatcaccgcccacttcgcggaaatgggcgaccagccgtttgagccactttgccgataaaccgtaacggccaggatgcgccagcacggcgcagccaccagaatgatgaatagcatcaatagcttgtttaattgtacaccattgtggcggcacgtaaccggttttgccacgcgccagataatttttgaatacctgcgccatattctctgctttaccctgctcaatcaggaagcgggcaaagtgaccgcgggtaatgatgccgccatcagccagtcgcgtggctcccgccagcgcatccgggatacgtgccttcgccagtcgctcaccaatctcttctgcacgtgcttgccgacaggcatgttgtccggccagaaacgccaccatcgccggatggcggatatcaatgttaagtcccacgatgtgaatctcatggttctcccacagggtggaaatttctgcgcctgccagcacttttatcggtaaatcgtgatcgattgccgtttgctgcgcttcatctacccctgcaacgctgtcgtgatcggtgatcgccagtacgccgacgcgcatctcaaccgctcgctgcaccagggcggctggcgtcagtaagccgtcagaggcacgcgtgtggctgtgtaaatcataaaccgggaaacgggcgatatcgctcaagagaaactcctgcaaaaactaaaccggccagcatgataacgattttcacggtcagtgaaaaagtgtattgacatttccgccctgaacccgttaactagtacacaagttcacacgtaacgggtattcaatcatggctgttgtaatcacgcatttaaacggttggcgcgatgttcccgaaaacgggcgacagggtcgtgcacactttgcgtaaacgctgtgctaatacctgagcccgccaccgagcgggcttttttttgagcgaaattcagagaaatcatcatgccaaatgcgaaacctacagtgaagttgattaccggcaccgcaccctaccgcgaagatccggccgcagtgtttcaccagctgtgcggcgcacgtccggcaaccctgctgcttgaatccgctgacatcgatagcaagcgcaacttaaaaagcctgctgattgtcgacagcgcgctgcgcgtcagcgcaatgggcaataatgtcaccgttcaggcgttgtcagaaaatggccgcgccctgctgccgctgctggatgaggccctgcctgcgtcggtcagcaatcaggttcgtcccgatggacgcgagctgacttttccgcagagcaccgaccatcagcaggatgaagattcccgcctcaaggccctgtcggtgtttgatgctttgcgtctgattccacaactggtcaactcccctgccgatgagcgcgaagccgtactgctgggtggcctgtttgcttatgatctggttgccggttttgaaaccctgccggagctggataaccagcaacgctgccccgactactgtttttacctggcagaaaccttactggtgatcgatcaccagacccgcagtgcgcgtcttcaggccagcctgttctgcccatccaccagcgagttccagcgcctgcagcgccgcatcgagcagttgcacggccagatgctgcagccggcaccggctctgccggtccagccggttgaacagatgacgctgaccaccagccagagtgatgaagagtattgcgacgtagtacgcacccttcagcaggcggttcgcatcggcgaaattttccaggtcgtgccgtcacgtcgcttctcgctgccgtgcccgtcgccgctggctgcttatgagacactgaaaaacagcaatcccagcccctacatgtttttcatgcaggatcaggatttctcattgtttggcgcgtcgccggagagttcgctgaagtatgacgccacctcccgtcagattgagatctacccgattgccggtacccgcccgcgtggccgccatgctgatggctcactggaccgcgatctcgacagccgcattgagctggagatgcgtaccgaccataaagagctggctgagcatctgatgctggtggatctggcgcgtaacgatctggcgcgtatctgcgtgcccggcagccgttacgtggctgacctgaccaaagtcgaccgctactcgtttgtgatgcatctggtttcccgcgtggtgggtacgctgcgcgcggacctcgatgtgctgcacgcttatcgcgcctgtatgaacatgggcacgctgagcggagcaccaaaagttcgcgccatgcagttgattgccggggctgaacgcacccgtcgcggcagctacggcggcgcggtgggctacttcaccgcccagggcgatctcgatacctgtatcgttatccgctccgcctatgtagaagatggcgtcgccaccgttcaggcgggcgccggtgtggtgctggattctaatccgcaggctgaagctgatgaaagccgcaacaaagcgcgcgccgtactgcgcgctatcgcgactgcccatcactgcaaggagatcttctgatggccgatattctgctgctcgataacatcgactcttttacctataacctggttgatcagctgcgaacctttggtcacaacgtggtgatttaccgcaacaacctgcccgccgaactgcttattgaacagctgcagcggatggagaaacccggtgctgatgctctctcccggtcccggcgcgccaaaagatgctggctgtatgccggagctgctgcgggtgctgcgtggtcgtctgccaattatcggtatctgtctgggtcaccaggcgattgtcgaagcctatggcggccatgtgggccaggcaggcgagatcctgcacggcaaagcctcttcaatcgaccatgacggcgaggcgatgtttgccggtctgagcaatccgctgccggtggcgcgctatcactcgctggtgggcagcaacacgccggaagagctgacggtgaacgccagttacaacgggatggtgatggccgttcgccatgaaaccgatcgcgtatgcgggtttcagttccatcctgaatcgattttgacttctcagggcgcgcgcctgcttgagcagacgctggcctgggcgctggcgaagtaacagggagaataaacatgcaacagacactggaaaaactttaccaggcgcagacgctgaatcaggctgagagtcatcagctgttcagcgccatcattaccggacagctggagccaacgcagctcgctgccgcgctgatcgccatgaaagtgcgcggtgaaacgccggaagagatcgccggagccgccaccgcactgctggaagatgccaaaccttttccccgccctgattatgcgtttgcggacattgtgggcaccggcggcgatggcagtaacagcattaatatttcgactgccagcgcctttgtcgccgcgacctgtggtctgaaagtggcgaagcacggcaaccgcagcgtctccagcaaatcgggctcctccgatctgctggccgcctttggcatcaatctcgatatgcccgctgaccgggcgcgccaggcgctggacgatctgaatgtctgcttcctgtttgcgccgcagtatcacaccggttttcgccacgcgatgccggtccgccagcagcttaagacccgtacgctgtttaacgtgctgggcccgctgatcaatccggcacgcccgccactggcggtgattggcgtctacagcccggaactggtgatgccgattgcccagacgctgaaagtgctgggttatcagcgcgcggcggtggttcacggtggcggaatggatgaggtggcgctgcacgacgtgactcatgtggccgaactgcgtgaaggtgaaattacgcgctatcagctctcgccagaggactttggttttggcttccatcccaaagaggcgctggcgggcggcacgccggaagaaaatcgtgacattctgacctctttactccagggtaatggccagcaggcccatgaggaggccgtcgccgtcaacgtggcgatgttgcttaaagtattcggtcaggaagatctgcgtgaaaacgcacagcaggcgcttaacgccatccgcagcggacaggcttatgagcgtgtcgtcgcactggcagcaagaggataatcatgaaaggcaccgtgttagaaaaaattgttcaggacaaagcgatttgggttgaagcccgtcagcagcagcagcctctctctacctttcagaacagcattgaacctgccagccgtcatttctacgacgcgctgcagggtgcaagaaccgcgtttatcctggagtgtaaaaaggcctctccctcgaaaggcattattcgtgaggatttcgatccagccgccattgccggggtctaccgccactacgcttccgcggtatctgtgctaaccgatgagaaatattttcagggcgacttcgcctttctgccgattgtcagcgcggccatcacccagccggtgctgtgcaaagattttatcatcgacccctatcagatctatctggcccgttactaccaggcggatgcgattctgctgatgctgtcagtgctggatgacgagcagtatcgtcagctggccgctgtggcgcacagcctgaagatgggcattctgactgaagtaagcaatgaagaggaaactggagcgggctatcgcgctgcaggccaaagtcgtgggtatcaacaaccgcgatctgcgtgacctctctatcgatcttaaccgcacccgtcagctggcaccgcgcctgtcacacggcgtcacggtaatcagcgaatcaggcattaacagctatgccgatattcgcgagctgagccattttgccaacggcttcctgattggttctgcactgatggaagaagccgacctgaccgcagcggtgcgtcgggtcacgctgggcagcaataaagtgtgcggcctgacccgtgccgaagatgcgcgtgccgcctatgaagccggggcaatctatggtgggctgatcttcgcggaaggttccccgcgccagattgacaccgctacggcgcagaccgttatcgctgcggccccgctgcgctacgtcggcgtgttccgcaatgccgctataagtgacattgtcacgcaagccggtgcgctttcactctctgcggtgcagctgcatggcaacgagacgccggcgtttgtggctgaactgcgtgcggctctgccagcagagattcaaatctggaaggcgctgcgcattgaaggcaccttaccggggcgcgactggcctcatgttgaccgttatgtgtttgataatggcgacggcgggaccggacagcgtttcgactggtcgctgttgcaggggcagacgctcaacaacgtgctgctggccggtggcctgagcgcggataactgtgttgaagccgcgcagctcggctgtgccggactggacttcaactctggcgtggaaagcgcgcctggcatcaaagatgcccgtaaaattgccgctgtgtttcagacactgcgagcctactgatttgcctggcctgctcaacggcgggcccgagaaaggaagataaaaaatgacgttacttaatccctactttggcgaatttggcggaatgtatgttccgcaaatcctgatgccagccctgcgccagctggaacaggcgtttgtcgacgcccagaaagatcctgagtttcaggccgagtttaccgacctgctgaagaactatgcgggtcgccctaccgccctgacgctgtgcaaaaacctgactaaaggcaccaaaacccgcctctatcttaagcgtgaagatctgctgcacggtggcgcgcacaagaccaatcaggtgctgggtcaggcgctgttagccaaacgcatgggcaaaaacgaaatcattgccgaaaccggtgcgggtcagcacggcgtagcttcagcgctggcctgtgcgctgctgggcatgaaatgccgcatctatatgggcgcaaaagatgtggagcgtcagtcacccaacgtcttccgtatgcgtctgatgggcgcagaagtgatcccggtgcacagcggctccgccacgctgaaagatgcctgtaatgaagcactgcgcgactggtctggcagctacgagacatcacactatatgctcggcaccgcggcgggtccgcatcccttcccgacgattgtgcgtgagtttccagcgcatgattggcgaagagactaaaaagcagattctggaaagagagggtcgcctgcccgatgcgatcctcgcctgtgtgggcggcggctccaacgccatcggcatgtttgccgactttatcgatgagaccagcgtgaagctgatcggcgtagagcctgcgggccacggcattgagaccggcgagcatggcgcgccgctcaagcacggtcgcgtcggcatctacttcggtatgaaatcgccgatgatgcagacccatgatggccagattgaggagtcttactcgatctctgccggcctcgacttcccgtctgtaggcccgcagcatgcgcacctgaacagcatcggtcgtgcggaatatgtctccatcaccgataacgaagcgctggccgcctttaaacagctctgtcgcgatgaaggtatcattccggcgctggagtcatcccacgccctggcgcacgcgatgaagatgattcaggctgagccggaaaaagagcagttgattgtggtcaacctctctggccgcggcgacaaagatattttcaccgttcatgacattttgacagcgcagggagaaatctgatggaacgttacaatcaactgtttacgcgtctgtcagcgaataacgaaggggctttcgttcctttcgttacgctgggcgatccgtcaccggagctttcactgcgcgtgattgacgccctggttgaaggaggcgcggatgcactggagctgggtattcccttttccgatccccttgcagatggcccgaccatccagaatgcgacgttacgcgcctttgcggcgggcaccaacaccagccaatgctttgaaatgctggccactatccgccgtaagtatccggatctgccgattggattgctgatgtacgccaatctggtcttcaccaacggtgtggatgagttctatgcccgttgtgcagaggcgggtgtggattcggtgctggtggcggatgtgcccgttgaagagtccgcgcccttccgtcaggcggcgctgcgtcatggcatagcacccatcttcatctgtccgcctaacgccagcgatgagctgctgcgcgagatcgcttcacacggacggggttacacctacctgctgtcgcgcgcgggcgtgaccggtgctgaaaaccgtgccagcctgccgttgcagcatctgatcgacaagctgcgtgaataccatgcagccccgccgctgcagggctttggtatctctgagcctgaacaggtgaaggaagcgatcgccgcgggcgctgcgggtgcgatctccggctctgcgattgtcagaatcatcgaaaaacatcattcagagcctgaggtgatgctgagcgagctgaagaactttgtcagccgccttaaagccgccagccgttaatcctgccagcatgccttatcgcgcgataaggcatgatttgtttccttttttttcattcccccatttgccctttttgcaaaatctgcaccacaatgacaatgcgccgttacggtaacgtcgcatccattttgtgacagggagagaaagcaatgaaattcgttaaactgctgacaggtgctgtactggcgggcgtggttgcgctgacactgagcgcctgtgcgccaaccgcaaccaaagagggaaccggtggctatattgatgacaccgtggtgaccacaaaagttaaaggtgaactgctgaaagatgactcgctgaaatcaactgaaatcaacgtagaaaccttcaaaggtaaagttcagctgagcggttttgtttcatcaccacagatggctaaccgtgccgttcaggttacgcgcagcgtggcgggcgtgaagtccgttgttaacaatatgcagatcaaataacgtcttaacagacaaaaaaaggccgctgattcagcggcctttttatcatctttatcatcagaaacggtaacccgctccgaagaagaagacccagggatcgatgcgcatattgatattctgctgctcgccaccctctttaaacttcacttccgtatcaatatccatgtaccacaccgacgcattcagcatccagtcacggttaatctgataatccagaccgacctgacccgccacaccccaggaatccttcacgctgagatcggtcaggcccgcatcgcggcccgtttgattgaaatcggcatcgtaaaaggtggtgtagttgatacccacgccaacataaggacgcgctttgctcttgctgtcaaagaagtagtactgcgccatcagcgtaggcggtaactggcgtaccgttgccagtgttccggtcgggcccaggcccaccttgtgacggaaacggtgtggcggccagtaattcgacaccaatgttgtccgttgccatgtaagtaaaggtcaggcccagctgcgtgtcgttggatgcgctgaactcgcccatccctaacacattatcggaaccttcggtgggccggacggtggcactaccggcacgcataaagaagtcgcctgcttcgtgggccatcgacagctgagggaaagccagagccagcagcatcgcgcattttgccagtttcatcatcactcctttgcttaatgttaatgtcgcgaacgtcatcgctttttgctggcaaatatttaacgtgatttacagaaaattgcactctgtacccttcagataaattacttaaaaaacaatgaattgatttagatcaatttcggctcgggctggcgcagcaaaattccccttgctgaataatttcgccaggcctattttgcttatcttctctggtgattttggttcgatgccctgggaggggcgggtgatcaaatgagtgaaataactaacccttgtgtcagctgtggcgcctgctgcgcccatttccgcgtctcattttactgggccgaagccgatgatgcaggcggcccggtgccgaccgcattaaccgaaccgctcagcctgttaatgcgcaatatgcgtggaacgaacgatcgcgcgccgcgctgcgttgcccttgaaggcgacattggcggctgtgtctcctgcggaatttacgaacaacgtccgacgccctgtcgggaattttcgatgtcgggcgaagcgggtatccacaatgaagcctgcgatcgcgcccgcgcccggtatggtcttcccgcccttttttctccatctttacctgtcatgacagaaagttatgccgcagcgggtgcccgcgagctgtcagaacatgtacaatcgccgggttaattaacccggttcctcaaaggagtgtacatgtctatcacggcaagctcgttataccgtgacacaggaaatttcgcgcgccatcaactggctacggtgctgttgatgtcgctgctggccgcttttatcaccgtcatgctggtgcatgtgctgacgccaggtgccgatcagatggccctcctgcaacagggtgacgatagcgccggttcgctgtttgagatggtgcagaatatgtcaccggaacagcagcaggtgctgctgcgcgcctcggcggccagcaccttcgctgcgctgatggggaacacgctgctgcttggcggaatgctctatctgatcccgatggtctcttccggccagcgtgtcagtgcgttgcgggcgattggtgcttcagcgccgctgctgccaaagctgctgctgctcaccttcctgatgacgctggtggcgcaactgggctttatggtgctggtggtgccaggcattctgctgacgattctgctgtcgctggctccggtgatggtggccagtgagaagatgggtgtctttgccgccatgcgggccagcatgcggatggcgtggaagaatgtgaagctgattgcccccgctattctgctctggctgctggccaaagtggtggtgatgctgttcttctcttcgctgacggttttaccgctgaatgtctcgtcggtgattttcaccgcggcaggcaatgtggtttcggcgatgttgattatctatctttatcggctctatatgctgttacgttgattgacgatgtgccttcgggcacatttgcagccaactctgaatggaaaaactatgaagcagctactcgactttcttcccctggtggtctttttcatcttctacaagctgtatgacatttttgtcgcctcgggcgcgctgattgtcgcgaccggcctggcgctggttgtcagctgggtgctctatcgcaagctggaaaagatgacgattttcacctttgtgctggtggcggtttttggcaccctgacgctggtgttccacaacgatgagttcattaagtggaaagtcacggttatctacagcctgtttgccgccgccctgctctacagccagtggtttatggagcagacgctgattcagcgcatgctgggcaaagagctgcagctgcccgacgcggtctggcgcaggctcaacgttgcctgggcgctgttcttcttcatctgcggcctggtaaacatctatgtcgccttttggttatctcaggcgttttgggttaactttaaagtgttcggtctctccggtctgaccttactgtttaccctgctcagcgggctttatatctggcgacagatgccgcagcaggaacaaaaataatcatctgcccggtccgccgggcatttttttagcattcacctgcatagaagtggaagcaatgggcgaaaaacatacattgccgaaaggcgaaatggtgctgcgtacgctcgccatgccagcagataccaacgccaacggcgatatttttggtggctggctgatgtcacaaatggatatgggtggcgctatcctggcgaaagagatcgctgaaggacgcgtggtgacggttttcgcgtcgacggcatgtcatttatgaagcccgtcgcggtgggcgatgtggtgagctgccatgcgagctgtcttcgtaccggcaacagttccatgacgattaatgtggaagtgtggatcaaaaaagtgtcgtctgagccgattggacaaacttacattgcgacggaagcggtgtttatttatgtggcggtcgacaatgagggtaattcccgtcctctgccagccggtcgtgccaaccagcaacccggcgaatgaaaaacaggtcaggctgttttagcctgacctgacgctttattccaggctggccccaccattaatcttaaacacgatattcatggtcagaccctgccctggccgtccgctctgatagcgccactttttcatcgcctgcttaacttcacgctcaaacatattgcgcggctcagcagagaggatctggatgttatccacccgtccctcactatccacatcaaacttcacccgtacccgcccctctacacgcagtgcaaatgcgcgttgtggatagccaggcttactgacgttcagtgcttttgggccggttgaggccgatgaggtgggtgacggcgtagattttggcgccgtggtcggtttgttctgcgtcgccggggcttcctgcttaaacggatcggcctgcggtttgctctcctgacgcggcttcacctcgcgtttaggctgctcccgcttgtgctctggtttcggtttgggctttggcttaggcttaggctcaggtttgggaatcggcaccggctccgctttcggcggttcgggcacgggctgaggttccggcaccggttcaggttctggctgaggttctggctgtggtgcaggcggctccacgatggccggtgcaggctcaggctggacttcaggggcgaccatggtaacgctgatgggctgcgacgctttgggcacctcaatcacctgctggaatgaagcatacagaattccggctatcacggccccatgcaaagcaacagacaacaacatggagacaggcgtgcgtttaggtaatggcatagtcagcgtggtcataacagtcgcagtgattgaatgaagcagcgattttaaatgcaaatagcaatcagtttcaataactcccgccatcccgcctgaagaaaagcgctttttagccctttatgctgagccattaaccactctgaggtttcgtttgcactctgaggggcaatcccttaacgtgttgcgaaattctggttaatgggagttccttagtgctttacgtcatttatgcagaagatactgcagattcactggaaaaacgtaacgccgtgcgccctgcccatctggcacggctcaaactgctgcaggaagagggacgcctgatcattgcaggcccgatgcctgctgtcgacagcaacgatcctggtgtagcgggctttaccggctcaaccgtgattgctgaattcccgtcattagaagaagcacaatcctgggcacaggatgatccctacttcgccgcgggcgtctataagcaggtttcggttaagccgtttaaacgcgtcttctgatcgtgactcagcattgaaaatggcttctgtgcctggcacagaagccatttttattttgatcgttcaagagaggaaagatgcagataatcattctggggctactggccattatcgctttactgatcggaagcgcggtttatctctggcgaaactcagggctggcgtaataaaaagcagtggattgtcatgctgatcgtgctggcggcggcactgcagctggtgaacgtaacgctgatgatgacgacacaacgtctcgctggttaatcagacctgaggtttcattgcgacagagcagcacatcactctctgtcgcagcaaccggccggtctgaatattctgcctcgcgaataaacgcagcgaccaactgatcttaataaattaaagcgttgttctgaacgacattgataataaaccggcagtacatcggcctggtcattcagtaatacacgctctttaatatcccgccactggctattttcagtgatgagttaaccgcgatccagaatcaggccaatcagcgcatgatagtgctgttcttcttccgggctggtgacatgctgtaagcggccgatcagttttgagcagatcgctttacgattcagactacggcccgaactgataatttccgtcacgacggagccaagaatggcctgttgtgagggctgcgcggcgctgtgtaaatacgcggagatgtcagagactgaagcgggaatacgaacgttagtttgcatggttgaccctcataggattcatttaagattactaaccgatgcgataaagttatacaacaacgagctatctgtacagatatttagcttaaaaaatcagatcgtcacgttttaatgacaataaactcataaataacagcacattacaacattgtaaagttgtacaacttgttagcctgcggtttttatcctgttaatattccctctttagtccgcgcctgaatgacctgttttactattaaaatatgatctttccgccctttttttagtattaaagaggaattatctcgcagagctgtctacatttaccccttgtgagttgaacctctgaatggatgcacagcacagtcgcgggcacattatgcataaaacttattctggccagtcccttacattgctcgacccgctgttatcccggctcctttctattgttgaccccaaaatagaagtaatgagtggttaccctgctaattgctcagtgtggctcactgtttattatcagcgtaaatcgcgtcagtggtcttacgaatggtacgatcgtgtgggttaccacaggccgactgagctgggcagctcaatggaatgtctgatgcgcgaagtcagcgatcgtggcgcgtcgcatcaggagcacctgatagcgcgacgggcgatggcagaatcggttttttttgaagcctgatttgaagtctgaatagcctgctttgtccgacaggctgaattcactgggctttcgctatattatctgcgtaataaacagaatcgaaacgacgctgctgttgtgccagctgatggcgaatgcagtggatacgcttataccgccgcgactgcccttccagccagcgtgagcggcggcgatgcacctgccgtaacattctccagcgcgccacttcatttctgcttcgtttcatcacttcctctctgacgtcatacacacgagggcattatagagatctctgcggtaatgccaaatcggatccttcatcgaggatgtccgggataaagggttccgttagccgtcatctgcacgtaaacttgccggacgaaagcgcgaacgggatgtccactttatgaccactttttataccctgatcagctggttgctggtgtttggttactggctgctgatcgccggggttacgctgcgcgtattgatgaagcgacgggcagtgacatccgcgatggcctggctactggttatctatattctgccgctggtagggattatcgcttatctctcttttggcgaactccatctgggtaaacgtcgtgcggagcgcgcccgcaccatgtggccatccactgcacgctggcttactgaccttaagcagtgccgtgaaatttttgccaccgaacacagcgacgttgcgcgttcgctgtttgagctttgctaccatcgtcagggcatcgccggggttaagggcaaccagctccagttgctcaccagcgccgacgacgtgatgcaggcgctgattcgtgatatccagctggcccgccacaacattgagatggtgttctatatatggcatcccggcggtctggcggatgaagtggcggaatcgctgatggccgcatcacgccgtggcgttcattgccgtctgctgctcgactctgcgggcagtgttactttcttccgcagcccctgggtcggcatgatgcgcaatgccggaatcgatgtggtggaagcgttgcaggtcagcctgctgcgcgtcttcctgcgacggatggatctgcgtcagcaccgcaaaatcgtactcattgataactacatcgcttataccggtagcatgaacctggtcgatccgcgcttctttaaacagagcgcgggtgtcggtcagtggattgacctgatggcgcgaatggaaggcccggtggcgacggcgatggggattgttttcagctgcgactgggagatagagaccggcaaacgcattttaccgccgccgcccgatcgcaacattatgccgtttgaacaggagagcggccacaccgtgcaggtgatcgcctccggccccggcttcccggaagatatgatccatcaggcgctgctgactgcggtctattcggcgcgtgaacagttgatcatgaccacgccctacttagtaccgagcgacgatctgctgcatgctatctgtacggcggcgcagcgtggcgtcaatgtcagcgtgattgtgcctcgtcacaatgactcgctgctggttggctgggccagccgctccttcttcagtgagttgctggaagcgggcgtgaaaatttatcagtttgaagatggcctgctgcataccaaaagcgtgctggtcgacggacaactgagcctggtgggaaccgtgaatctcgatatgcgcagtttatggctgaattttgaagtgacgctggtggttgatgatgcgggttttggcagcgatctcgcctgtgtgcaggatgactatatcgcccgtttcccgcctgctggatggcaagcgctgggcaaaacgtgcctggtggcaacgcatcgtcgaacgactgttttacttcttcagtcctttactgtaaaacgagccagattgtgtaaatggccgcaggccgacaggacagactatggatttaaataatcgccttaccgaagatgaaacgctggaacaagcctacgatatttttctcgaactggcagtcgacaatcttgatccggcagacgtcattctcttcaatctgcagttcgaagagcgcggtggcgcagagctgttcgatccctctgaagactggaaagatcatgtcgatttcgatctgaacccggacttcttcgccgaggtggtgattgggctgggtgaagcggacggtgaaccgatcaccgacgtctttgctcgcgtgctgctgtgccgcgagaaagaccacaaactctgtcatatcctgtggcgtgagtaagcgtcagatttgataagaaaacgccgggcgattgcccggcgttttgcattatagcgggtcgactttcagacaggagaccgcgtgattgaagctgccttccagcagcggccgggttttcgcacactccggaccggcaatcggacaacgggtgcggaacacgcagcctgatggcggattgatcggcgacggcagctccccctccagcagctgaatctgcttgttcttctccttgtccggatcggggatcggcaccgcggacatcagcgcacgggtataaggatgctgaggattactgtagacctctttgtaggtacccagctccaccgcatgccccagatacattaccagcacccggtcagagatatgtttcaccaccgccagatcgtgcgcaatgaagatcagcgataagcccatttcgcgctgcagctgctgcagcaggttaaccacctgggcctgaatcgagacgtccagtgcggagacaggctcatcacagataatcagctttggctccagaatcagcgcgcgggcgataccgatacgctgacactgaccgcccgagaaactcgtgcggatagcggttaatcaggttaggcagcagccccactttcatcatcatatttttgacgcggtctttcacttcctgacgcgccatttttggatgataggtacgcagtggctctgcgatgatatcgccgatggtcatacgcgggttcagcgacgccagcggatcctggaatatcatctggatatcgcttcgcgccttgcgccactcctcttcactttgccccagcagatcacggcctaaccaggcgacccgaccttcggtcgccttcaccagcccgataatggcgcgcgccagggtcgatttaccacagccagactcgcctaccacgcccagggtttccccctcatacagacgcaggctgacaccatcgactgctttcagggtttttgatggctgccagaaccactgcctgccatctttgatgtcgaaatgcaccttgaggtcggcgatttccagtaacactcttttttcagctacggtgctcatactaactcctccaccggcttaaagcaggcgcgcagacggccttcgccaaagggttccagcggtggtgcctgggtgcagatatccatagcgtgcggacaacgcggctggaacgggcagccctgcggcagacgcagcaggttgggtggattacccggaatcgtcgtcagactttccccttccgcatccagacgcggcaccgcattaagcagaccaatcgagtaaggatgtgacggctgataaaagacatcgcgggcacgaccatactccatggtgcgtccggcatacatcaccagcactttgtcgcagatccccgccaccacacccagatcgtgggtgatcatgataatggcggtattgaactcgcgcttgaggtcgttgagcagcgtcataatctgcgcctggacggtaacatccagcgcagtggtcggctcgtcggcaatcagcagtttgggacggcacagcagcgccatggcgatcatgacgcgctgacgcataccgccggagaactcatgcggatacatcttcatccgcttgcgcgcttccggcattttcaccgcatccagcattctcaccgactcttcaaacgcctgcgcgttgttcatccctttatgcagcttaagcacttccatcagctgctcgcccacccgcatataggggttcagcgaggtcatcgggtcctggaaaatcatcgcaatctgttcggcgcgcagtttattgagcttgttctcgggcagattcaggatctctttgccattgaacatcgccgaaccgccaatgcggccatttttcgccagcagccccatcagggcaaaggcggtttgtgatttgccggaaccggactcaccgacaatgcccagcgtctcaccggcgcgcagcgagaagttcaggtcgttaacggcggtaacatcaccatcgtgcgtgccaaaggtgacgcgtaaatctttgaccgtaagtagctgttcgcttcccgcgcgggccgccattgctggctggaattcatgaatagtcatcgggaaactccttaacgatctttcgggtcgagggcatcacgcaggccatcgccgataaagttgaaacagaacagcgtgaccaccaggaagcctgccggatagagcagcagccacggcgacacttccatcgagtttgccccgtcgctgaggagtgcgccccagctgctcagcggctcctgcgtacccaggcccaggaagctcaggaatgattcaaacaggatcatgctcggcaccagcagcgaggcgtaaaccaccaccacgcccagcacgttcggcacgatgtggcgcaccacgattttccaggtcgataccccacccacatgggccgcttcgataaactctttgcgcttcaggctcagcgtctggccgcgcacaatacgcgccatatcgagccacgaaaccataccgatggcggcaaaaatcagcaggatattgcgaccaaagaaggtcaccagcaggatcacgaagaacataaacgggaaggagttaaggatttccagaatacgcatcatcaccgagtctgttttaccgccgagatagccagcaatcgagccatagagcgtcccgacaatcaccgcgatcagcgcagaagccacgcccaccatcagcgagatccggccaccgatagccacacgcaccagcaggtcacgacccgaagaatcggtgccgaaccagtgaccagaggtggtatcgggcggcgaggacatcatggcccagtcagtatcgtcgtaggtgaactgcgccagcatcggcgcaaagatcacgaacagggtgatcaggaacagcaccagcaggctgatggaggcagcgcggttatgaataaaacgacgacgcgcgtcctgccagagactacgcccttctacttccagtttctcactgaacgcatcaagagcttcgctgtttttcttacttaacatcatggcgaactccgcaatcagtaacgaattttgggatcgataacggcatagagcacgtcaacaatcgcgttgaatacgatggtcagcaaacccaccagaatggtcaggctcatcaccagtgagtagtcacggttcagcgcgccgttcacaaacagctgaccgatgcccggcagaccgtagatcgactcaatcaccatcgaaccagtgatgatgccgacaaatgccggtcccatgtaggagatcaccggcagcaacgcgggcttcagcgcatgacgcattacaatgcggcgcagcggtaagcctttggcgcgcgcggtgcggataaagttggagtgcatcacttcaatcatcgatccacgggtgatacgcgcgatactggcgatgtaagccagcgacagcgccaccatcggcagcagcatgtagttccactgcccgccattccagccgccgcccggcagccacttcagggtgatggcgaacagcagaaccagcaacggcgcgaccacgaaactgggtatcaccacgccggtcattgccacccccatcaccgcaaaatcccacaagctgttctgtttgagcgcagcgataactccggccgtgacgccaagtaccaccgccagcagaaacgcggccaggccaagtttggccgagaccgggaacgcatgcgcgaccaggtagttgaccgaataatctttgtatttaaaggatgggccgaagtcgccgtgcgccagctgcaccaggtaatcgacatactgcttaccgataggatcgttgaggtgatatttcgcctcaatgttggccatcacttccggtgccagggtgcgctcgccggtaaacgggctgccgggcgccaggcgcatcataaagaaggagatggtaatcaggacgaacagcgtcggtagcgcttcaagcaagcgacgcaggatgaattttaacattgccgtacctaccaggctgttgcttcacaacataaaaaaaaagtaaaaggcggcgccagacgcgccgccactgctgatagcctgaatgctattagtgtttgatgatgtagaagtttttatccagggttttatccagtggatctttaccggtataaccgccgacataaggtttcaccagacgggtgttcacgtagtagtaaaccgggacgatggtgctgtctttatccatgatctgctcggcctgctgatagtcagctgcacgggctttagcatccggggccttaatcgcgtcgcgaatcactttgtcaaacgcatcgctcttatagtgcgaggtgttactgctgctgttggacagcatggtgttcaggaaggaagtcggttcattgtagtccgcacaccatgccgcacgggaaacatcgtagttaccctgatgacgggtatccaggaaggttttccactcctggttttccagcttgatgttcacgccgatatttttcttccagatcgacgaggcggcaattgccagctttttgtgcagatcggaggtgttatagagcaggttaaaggtcagcggtttgtcggcggtgtagcccgcttcggccagcagctttttcgcctcggcattacgcttgtcctgtgaccatttgaaccagtctggcggcagaatgtccatgccgtcggtcgctggtggcgtgtagctataggcaggtttctggccctgcgccagcactttattcaccatgatgtcacgatccagacccagcttcagggcagcgcgcacgcgcggatcggtgaatggcgctttctggttgttgatttcgtagtaataggtgcagagatatggatcgacgtgcagctctttaccgttgtcacgctgcagctttttaaacagctcaattggcaggttgttataggtcatgtcgctgccgtttctcggagaagtagcggttaacgtcactgacttctgaactgatcggcaggaaggtgactttgttcagcaccgtatgctcattgtcccagtagttcgggttacgcaccagggtgatacgttcgttaatcacgtgcgcttcaagcttaaaggcaccgttgccgacccagttctgcggctgcgtccactgatcgccaaatttctcaatcgccggtttgtaaaccggtgacatgacggagttaatcagcagcttatcaaaatagggaaccggctcactcagggtgacttccagcgtgtggtcatcaatagcttttacgcccagatcggtaactggttttttaccggcgatgatgtcatcgacgttcaggatatgaccatactgcggatagctggcatacggtgaggcggttttaggatcgaccagacgctcccagctgtagacgaagtcctgcgcggtgaccggctcgccattggaccatttggcatttttacgtaagtggaaagtccacactttgaaatctttattttcatagctttccgctacggccgggatcggtttaccgttgctgtcattgaccagcagaccttcgtaaagatcacgcgctacgttgtcttccggcacaccttcaattttgtgcggatcgagcgactgcacttcatcgccattgccgcgaaccagctcctgttttgcggccagctcaacgcccgcaggcactgttgctgcgaaagccgcattccctgccagggcactcactgcggcgaaaacgcccgctgcaatcaggctttttttcgtgatgttgttcattattacactccagttttattatcgtcaccgtggcgatgctctgccccggcgtcccccgtctgcgggctccctggcctgttaccagggagattgaccccaaaaaaaggtctgtttgctgatgcgctttccgactgtctcgccgaaacaggcgatcagatcagtgttttttgatgaaatagtacttcaggtctgtcatgtcctgcgggtctttgcccgtgaagccgccaacccagggcttcaccaggcgcacacttacgcggtagtaaactggcacaattggtgagtctttgtcgagttgtgtttcagcctgctgatacaggctggcgcgctgcgcctcgctgcccgccgtcagcgtctccgccatcagacgatcaaaggtcgcgctgctgtaaaacgcggtgttgatcgaggcgttgctgatcagcatgttcaggaaggttgagggttcattgtagtcagcacaccaggtggcgcgcaccacgtcatactgcgcctgatgacgggtctccagcatggttttccactcctgattctgcagcgtcaccttagcacccaggtttttctgccacatcgacgcggccgcaatcgcctgccgtttgttctgatcggaagtgttgtagagcagcgtaaaggtcagcggatgggcagcatcaaagccggcctctgtcagcagcttcttcgcggcttcattacgctgcgcctgcgtccaggtgaaccaggcaggtggcgtgagtttgataccggcggtaaaaggcggcgtcaggctgtaagccggaatctgcccctgggccatgatcttattggcaatgacctcgcgatcgagggtcatcttcagtgcagcacgcacccgcgcatcggtaaacggcggctttttgttattaatctcgtagtagaaggtgcagagcagtgggctgaccttcacttcatcgcccagctctttgcgcagcttgccaaacatctctggtggcaccgcactgttggtaatatccgtgccgccgctgcggtagcgattgatatcgctgttttcagaggcgatcggcaggaatgtgccctgctcgatcaccgtgtgtgcattatcccagtagcgaggattgcgcttcacgataattttttcattcactacccagtcgctcagcgtgtaggcgcagttaccgatgtaatgacccgggcgggtccaggcttcgccccactgcttaatggctggcgcataaaccggcttcatcgccgtatgcgctaacatcgccaccaggtaaggcaccggctcactcagggtaatttgcagccgatgggcatccagcgccttcacgcccagctgatcgggtgacgctttaccggcaaggatggcatcgatattggcaaaatgggctgcctgcagatagctggagtaaggcgacgcggttgtcgggtccaccagacggcgccagctgtagacgaaatcagtggcggtaaccggctcaccgttgctccacttcgcatcctcccgcagattaaaaatccagacggtgggttgcgggttttcccagcttttagcgacgccaggaacgacctgtccgctgttatcggtattgaccaggccgtccagcaggttgtgaataatattggattccggcacgccttcggttttatgcggatccagcgaggagacttcactgccgttattgatcacaatctgttgctgcgcggccagtgttgtgcccggcggcaccgtggcggcataggccggagaaaatgccattaacaaaacgactgcgagttttgaccgctgctgctgcaaattcttcatcccaatcatgcgaaacgccaaccttaaattaagtatcccgacaggcttaagcaaaaagcgttctcactttgggctttcggagaaaaaattttacgttgggccaaaaattatcagaagccgtgaaggcgcgccaaagcaaaatagctaaaatgttaactaattctcttttatcatgagaagtcaggcagcgaaagtgttaattttcgtcctgaaaatatcatatcgatatgaaaaatagactatttagctggaaacccctctcaggagcggaaagcagcgacaaacagcctcttttttggcacttatattggggaatctggcttcagcgtgatgaaatttaagatagcgtgattattctggcagtttgtgaggcttacacgaaaatagagagcagaatatcgtgtgaaaatagtgacattatttcgcagaaaaaagtctgtgagccagcgcgcagtaatgaaatttataattgcctgattctgttaagcacaacgaataattgcatcgtaatggtgcataaaatgcccctcctgcaccattacggatcattatttcacttcactctctgaaataagtgagcgtttaattgagtaagccgggaaaaatggacttcatgccggtgacaacaaattcgatgcccagtgccatcagtaacagacccataatacgcgtaatgacgttgataccggtctggccaagaatacgcaccattaacggcgcggcccggaagagtaaccagcagcagaatgcaaagatcgcaatcgccagagtgaaccccagcagatttatccagctgtggtagcgggtgctccagacaatggtcgagctgatagcacccggccccgccatcagcggcaacgccagcggcacaacccccacactttcacgaatcgccgtttctgacttctcctgcttattctgcttatcttcgcccagcttgccgctgatcatcgacatcgcaatggtgacgaccaggatcccacccgcgatgcggaaggagtcaatcgagataccaaacacatgcagaatcgcatcaccaaggaaacagtgacgtccagagaataatagcaaccgccagattggcagtgaggttggttttgttacgctcagccaccccctgataacgggtcatgctgatgaagaccggaataattcccaccggattgaccagcgcaaagagcccgacaaaaaattttatatagcctgataaatctaacagcgcagggttcacgactttactccgtaccacagggggggaaaacgcgcctaatgtatgtgaaaacaggcacggacgccagatgctgactcagctatttatactgttgaatgacggcgcatccagcgcgttaccccagagattaaaaagtgactggatttagccgctaccaggcagatgacgtgaagaggtaaccaatttgataaacaaagggcgtaaaggggagctgaaaggtgtcagcttgcggttaaattgatctgcatcaaaattgccctaccccaaaccaggtaatcttttcgcaacggaagtattagcggcagcgaagaaaatctcactgactgcaacagaagactagttcagtaaacagttgaaaatccgggcgttctgacccagtccaacgccttatggcaacgtgactatactcagggcgcaggattgtttactaaaaaagtttaacttccttcaggagaacaccatggccgtaaccaatgtcgccgaacttaatgcactggttgaacgtgtaaaaaaagcccagcgtgaatatgccaacttttctcaacaacaggtcgacgctatcttccgtgccgccgccctcgccgccgctgacgcccgaatcccgcttgccaagatggccgttgccgaatccggtatgggcatcgtcgaagacaaagtgatcaaaaaccattttgcttcagaatacatctacaacgcttataaagatgaaaaaacctgtggtgtgttagccacggatgatactttcggcaccattaccatcgccgaacctattggcctgatttgcggtatcgtcccgacgaccaaccccacttcaaccgccatcttcaaagcattaatcagccttaaaacccgtaacggcatcatcttctctcctcatccacgcgccaaagatgcgaccaacagagctgcagacatcgtattgcaggcggcggtggctgccggtgcgccaaaagatattatcggctggatcgacgcaccttccgttgagctgtcaaatcaactgatgcaccaccctgacatcaacctgattctcgccactggcggtccgggcatggtgaaagcggcttacagctccggtaaacctgcgattggtgtcggtgccggtaatacgccggtcgtgattgatgaaaccgccgatctgaaacgtgcggttgcgtcgattctgatgtcgaaaacctttgataacggggttatctgcgcctctgaacaatcggtgattgtggtcgattcagtctatgacgcggtgcgtgaacgtttcgccagccacggcggttatatgctgcagggtgccgaactgagtgcggtgcagaatattattctgaaaaacggcggcctgaatgcggccatcgtaggccagccagcgttcaaaattgcggagatggccggtatcagcgtgccaccgagcactaagattctgattggcgaagttaagctggtggatgagtctgagccgttcgctcatgaaaaactctcaccaacccttgcgatgtatcgggcgaaagatttccaggatgcggttgcgaaagcagaaaaactggtcgccatgggcggtatcggccacacctcctgtctctataccgatcaggacaaccagaccgaacgcgttcactacttcggcgacaaaatgaaaaccgcgcgtattctgatcaacacccccgcctcgcagggtggtatcggcgacctctacaactttaaactggcgccgtctctgacgctgggttgtggttcgtggggcggaaactctatttcagagaaacgtcggtccaaaacatctgatcaataccaaaactgtcgccaagcgagctgagaatatgttgtggcataaacttcctaaatccatctacttccgtcggggttcactgccaattgcgctggaagaagtggcaacggatggcgcgaaacgtgcctttatcgtcactgaccgcttcctgttcaataacggctatgccgaccaggtgacccgcgtactgaaatcacacggcattgaaacggaagtgttcttcgaagttgaagctgacccaacgctgagcatcgtgcgtaaaggtgctgagcagatgaacagcttcaaaccggatgtcatcatcgcgctgggcggtggctcaccgatggatgccgcgaaaatcatgtgggtgatgtacgaacatccggaaactcacttcgaggagctggcgttacgtttcatggatatccgtaaacgtatctacaagttccctaaaatgggtgtcaaagcgcgcatgattgccatcaccaccacatccggtaccggttctgaagtcacgccgtttgctgtagtgaccgatgatgcgacgggtcagaaatatccgctcgctgactacgcactgacgcctgatatggcgattgtcgatgccaacctggtgatggatatgccgcgttcactctgcgccttcggcggtctggatgccgtaacccacgcgctggaagcttatgtttcagtgctggcgaatgaatactctgacggacaggcactgcaggcactgaaactgctgaaagagaatctgccagccagctatgccgaaggcgccaaaaatccggtggcgcgtgagcgcgtacacaatgccgccactatcgccggtattgcgtttgccaacgccttcctcggggtttgtcactcaatggcgcataagctgggttcagagttccatatcccacacggcctggccaacgccctgttaatctctaacgttattcgctacaacgcgaatgacaacccgactaaacagaccgctttcagccagtacgatcgccctcaggcgcgccgtcgctacgccgagattgctgaccatctgggtctgagcgcaccaggtgaccgcaccgcgcagaaaattgagaagctgctcgcctggctggatgagattaaaactgaacttggtattccaacctctatccgtgaggcgggtgtgcaggaagcggacttcctggcgaaagtcgataaactggccgatgatgcgtttgatgaccagtgtaccggcgctaacccacgttatccgctgattgctgaactgaaacagattatgcttgatacctactacggtcgtgaatttgtcgaaccgttctcaagcgtagccgaagccattgctgagcagccggtaaaaggtattaagcttgagaagaaagccaaaaaagtctgatagtgccgttctgactgtctgataaaaaaacccgccccggcgggttttttattgcctgaacaatagggttaattcagcggagtctgagcgccatggatcgcctgcaacgatccctgctctatcgcctgtttataatgcttacggcagactgagatataacgttcgttaccgccaatcaccacctgctcaccctcactgaaaggtttgccctcgctatccagtcgcagaaccatactggccttgcgcccacagtgacaaatagttttgagttcaaccagcttatctgcccacgccagcagatactgactgccaacaaacagttcaccgcgaaaatccgtgcgcagaccataacagagcaccgggatatcaaggtcgtctacgacatctgacagcgctttaacctgctcacgggtcaggaactgactctcatcaaccagcacgcaatggacaggctgaacggcatgttcagcagcgatgtcgctgtagagtgatgtctctgcgttgtatagcaaggccggtgacgatagtccgatacgggaaactcacctgcccggcaccaaagcgattatcgatttcagcggtgtaaaccagtgaacgcatgccgcgctcatgatagttatatgaggattgtagcagtgcggttgatttccctgcattcatggcagagtaatagaaatagagttgagccatcggcgcgtatcttcatcaggactgaatggaatggcgcgcatattaccacaaagcggcggcaatacgttgcggttgatgagtgaataaagtgtaacggctggccgtttattcctctgcatgccgtttccagcgcctgttaagtgcagtgccgaacgggataagttttgcttattttacccgcaacaaaagcaatgacatttttgttgctgacctgaatacattaaatttatttgatatcggactaaaggaaaatatttttattctgcacaactgtgcaattttctggtgaaaattatttttagtcacgtgggtaattagtgatatacatatttttatgattgcagttattttatgtcgccactactattagcgggcaacacaacttttcccttattcagagaccaggacaatgagcgaagcactaaaagttcttaataatatccgtacgctgcgcgcccaggccagagagtattccgttgaaatactggaagagatgctggaaaagctggacgtagtagtaaaagagcgccgcgaagaagagtctcattttcaggcagaaaatgaagaacgcacgcgtaaacttaatcagtatcgtgaaatgctactggctgatggtattgacccgaatgaactgattaacacgctgaccgacacacggactgcggcaaaaggtaaacgctcagtacgtccggctaaatatggttacaccgatgaaaaaggcgagtccagaaacctggaccggtcagggccgcacaccggccgtgattaaaaaagcgctggaagaacagggtaaaaagctggacgattttttactgtaaaaacccgcagcgtcactgccttcctggcagcctgatgcgcaataaaaaaggaagccggagcttcctttttttcttttaatcagatactcagacgcggtaaaagtcgcggtaccagtccacaaagtttttaacgccctcttcgaccccggtctgcggtttgaatccaattgccttaaacaaggcttcggtatcagcactggtttccagtacatctccaggctgcattggcatcagatttttcttcgcagtaatgcccagggctttttcaatcgcttcgatatagctcatcaacgtgacaggctgactgtttccaatattataaacacgataaggcgctgaactggttgccggcgatccggtttcaactgtccagttgtcgtcctgttgtggaataacatcctgcaggcgaacaatggcttcagcaatatcgtcaatataggtaaagtcgcgtttcatctggccctggttatatacgtcaatcgcctcaccggcaatcattgcacgggtgaatttgaataacgccatatccggacggccccacgggccatagaccgtaaagaagcgcaatccagtggtcggcagctgatagagatgcgagtaagtgtgtgacattaactcgttggcttttttggtcgctgcatataaagaaaccggatgatcaacgctatcttcggttgagaaacggcatcttgcgattcagaccatagactgaactggatgaggcgtagagcagatgttcaattttatgatgacggcaaccttcaaggatattgaggtgacccgtcagattggagtctgcgtaggcatggggattttcaatggaataccggacaccagcctgagcgccaagatggataacgcgctggaatttttgctgatcgaacagtgacgccattgcgtcacggtccgccaggtccatctcaataaaagtaaaaccaggatcggccttaattaaattgagacgggcatgcttgagatttacgtcgtaataatcattcaggttgtcgataccgacaacctggtgaccggcggccagcagacgctggctgacatgaaaaccaataaaacctgcggcgccggtgaccagaaagttcataaatccctcgttaattatgcagtttgaatagacgctccgcggccgattgcataataaacgaaaccgcgtttgctgatacgctctggatcatacaggttacgaccatcaaaaatcacggcttctttcagtgcatttttgatgatgtcgaagtcaggtgcacggaagttttgccactccgtacagatgaccagaccgtcagcgccctgcagtgcggcttctttggtacccatcagcttaagatcgctgcggtgaccgtagatacgctgtgcttcatccatcgcttcagggtcaaacgcctgaacagatgcgccagcttcccacagcgtttccatcagcacacggctggaggcttcacgcatgtcgtcagtgttcggcttaaatgacaggccccagagcgcaaacgttttacctttcagatcgtcaccaaaatgacgtttgataaaggttggcagtttgtttttctggttgtcattcacatcttccacggcctgcaacagacgtggctgatagccaattgactcagcggtacggattaacgcctgcacatctttcgggaagcaggagccgccgtaaccacagccaggatagataaagtggtatccaatgcggggatcggaaccgatgccctggcgtactttttcaatatccgcgcctaaacgttcagccaggttagacatctcattcataaagctgattttggtggccagcatgcagtttgctgcatacttggtcagctctgcgctgcggatatccatcatgatcatacgatcgtggttacggttaaacggctcatagagctcgcgtaacagttctaccacgtcgtcgttgtcagtaccgacaacgatacgttctggacgcatacagtcattgactgcagcaccttctttgaggaattccgggttagataccacatcaaaagtgatgttggcgtcacgcgctttcagcgcttccgtcattaccgcacgaactttgtctgctgtgccaaccggaacggttgatttgtcgataaccactttgtgatcgttcatatgctgcgcaatggtgcgcgctacggcggtcacatatttcagatcggcagagccgtcttcatctggtggagtaccaactgcaataaactgcataacaccatggtttacgcccagctcagcatcagtgctgaacttcagacgacccgcttcgtaattggacattaccagcggcgttaaacctggttcgaaaataggaatgatgccttttttcagattttcgactttgttttcgtcgacatcaatgcagagaacgtcatgtccgacttcggctaacaccgcagcctgaaccagaccgacatagccgataccaaatacagtgactttcatcgagttatcctgtgtttatgaattactttttgttgccaactgcgccatcgagccattcagaaaaatctttgcccaataccggatgacgaacaccgtactcaacgaaagcctgcatgtagcccagtttgttaccacagtcatggctgacgcctttcaggtgatatgcttcaactgtctctttttccatcagcatcgcaatggagtcagtcagctgaacttcgccgcctgcacctggaggcgttttagccagcagtggccagatctctgaagagagaacataacgacctacaacggccaggtttgatggggattctgacgctttaggcttctcaaccacaccgaccattggtgcgctgtcgcctgggttcagttctgcgccctggcaatcgacaacaccgtatgcagtcacatcggcaaccggctcaaccatgatctggctgcggccagactcttcataacggctcagcatctctgccaggttatctttggttgggttagattcatattcgtcgatgatgacgtctggcaggataaccgcaaacggctcatcaccgatcagtgggtgtgcacacattacagcgtgacccagacctttagcgatgccctgacgaacctgcatgatggtgacgtgtggcgggcagattgactggatttcatccagcagctgacgcttaacgcgtttttccagcattgattccagttcgaagctggtatcaaagtggttttcgatggcattttttgatgaatgcgttaccagcacaatttcgttgatgccagcagcgatacactcgttaacgacatactggattaacggcttatcaaccagcggtaacatttctttaggaatcgctttggtagccgggagcatacgcgtacccaaacccgctaccgggattaccgctttttttactttggtattattggcagacattaagatacctctcttataggccgttcaagttaatacttgatatgtcggtttaaaatcggaaatgagtatatcagttagtatcgaacggatttatcctggaaggcaccaaaccgtcgaaattaagactattacccaactgtaaagctaaactctggccctgtcctcagcgccagaattcctctgtttttacggcttattcttccgtcgatagcatcagccgaatgcgcccgcccgcgccccagacgtggcattgccagttttctgcgcgctgactgatctggttaagatgggtgctgcccatagtgccaagggggacaccattgctgagctgaatctgatgggcatgaacatgaagtgtggcgttcaatccggccgaaaccagaattaagttctttaatccgcgatgatagtacccaaccagtaacgggaactggccgctcaggttcgcctggcgcagtaacagattgacctgtctgagcagcccattaagttccggcagacgctgtttctgcccggtcagttgctcctgcagcaggccattgaacagcgcccgcagcagcaacgctgccagcacgccattatcaccggcacgggtcacgtccagacagtagaacgccagatctttatcggagagcgccgcgatatcaagcaccagcccaggctgctcggccatcgtcaactgacgatagttaacccggcagttggcaatagtctgctgcaccggtggctggagttgcttgagcagcttggcagccgctttaggatcacgaaccagcgcatcccagtcctggaacagttgttcatcctcttccactttcgaagtgaacatagagggatagagacactcatagaccgcttcacggaagcgctcaaagtttttaagtggtttaagcagcacatcctgcaccccaagacgcaatacatgcgcaatatccgacatgttctcggttgctgagatgattaaaatcggcacgatgttgccgcgggtacgaatgtgctcaacgaactggatgccgctcatgcggggcatttccagatcgcagataatcaggtcgacagtatgctgttgtagttgtgcaattgcttccagaccatcttccgcttgtaacgtcacagcacccatcgataacaaaaattggtccagcaacgaacggaaaacagcctcatcttcgacaatgagtatctttttgccgagtagtggtttttccattctttccccctgcgtaccagatatttcaatagtggttcataaaacgcagttgcgcctttaagaattggctgaagtcaccgctttgaatgaacaacctgattatctgccacggaccagtggtaatagttcatccattttcttctctacggcggccttgccagcttcaatggcttcctcagcacgatgaaagtccagcgtcgaaatttgcggacagaccggctgaatcaaaacatcgggcggatcgcctgccatgcgattccgcttcaggcgattttccagcacctggatagaggtggacataatctccatcgcgccaggtgactgagacgcacggcgctgactgaaattcaccagacgctgacgcagcttcccaccccaactcaatgccgctgcggcggcttcttcttcgctattctgtggtgtcacggaaaagagatcctgctgcattaaatgcgcgtcatgctgcaagtcaacggcgataacaatgtctgcccccagggcacgggtaagtgaaatcggcaccgggttgactacggcaccatccaccagccaatacccattgtagcccaccggcggtaataaacctggcatactgcatgaagcgcgtactgcctgatgcagatcgccctctgtcagccagagttcacgaccggtactgaggttagtcgccaccacgccaaagggtttatgacagtgctctatcgtgtcattggggatcagctgacgaacatggctaaagacccgctcaccgcgcagcagtccgccacgctgccaggagacatccatcaggcgaataacatcccagtagcgaaatgcactgacccatttttccatcagcggcagacggttattcacataggcagatccgactaatgccccgacagagcagcccgcaacgacgtcgatctcaatacctgcacgctccagcgcgttgatcacgccgatgtgcgcccatcctttggccgctccagaacccagagccaatccaatttttacctttctcatttctgtctggtcctgccgtcaatacgtagcatcacaacacggggtcagctaacatagcgcgcttgtaaaaccgacccatcattcccgggagataatgtgtcagaaacctgcccatgttgtagcggagagcagtatagcgtatgttgcgagccctttcttcagggtaaccagattcctgttacagctgaacaacttatgcgatcccgttattgcgcttatgttcagcataatgcggactatctggttgcgacctggcatcctgagaagcgtgatccggcgctgtcagggcttttatctgaaagttttccgggaaccgactggctcagcctgaatgtaacccgttgtaatcatggaagccatgagaacgaagctttcgttaccttttttgcgcgataccgcgagaaaaccaacattcaggccattcatgaatgttcacgctttcttcgcgaggatcaacgctggtactatgttgacggtacagcaccgcccgtggggcgtaacgatcgctgcccgtgcggcagtgaaaaaaaatacaaaaaatgttgtggttaagctgacggctaccccagcggttttacccctaatgctttgacaggactctgattgagatgcaagcgcaaaccatgcaaagaaaagttttacgaaccatttgtcccgatgcaaaaggtctgatcgccaaaatcaccaatatttgttacaagcacgaacttaatatcgtgcagaacaatgagtttgttgatcatcgcaccgggcgttttttcatgcgtaccgaactggaagggatcttcaacgacaacaccctgctcgccgacctcgacagcgccctgccccagggttcagtccgggaaactgcacagcgccggtcgtcgccgcgtggtgattcttgtcactaaagaggcgcattgtctgggcgatctgttaatgaagagcgcgtttggcggcctggatatggaaattgcggcggtagtgggtaaccacgacaccctgcgttcactggttgagcgtttcgatattccgtttgtgctggtgagccatgagggactgacgcgggaagagcacgataagcgcatggtggaagagattgaccgctatcagcccgattacgtggtgctggcaaaatatatgcgcgtcctgacgcctgcttttgtgcagcgttatccgaaccagattatcaatattcaccactccttcctgcccgcctttatcggtgcccgtccctatcatcaggcttatgaacgtggcgtgaagatcatcggtgccaccgcgcactatgtgaatgacaatctcgatgaaggcccaatcatcatgcaggatgtgataaacgttgatcacagctacaccgccgatgagatgatgcgcgccggtcgcgacgtagaaaagaatgtcctgagcaatgcactgtataaagtgctggggcaacgcgtgtttgtttacggcaaccgcacgattattctttaatcagccagtgcgctgaattgtctgcagattcagcgctacgcgtaaaaagtgggcaaacagttgcggttttgccagtgggcgctttacacccttatcgcatttggtatgatgcgccccgctttaagagagaaagattcaggccatggtgggattcccgagcggccaaagggagcagactgtaaatctgccgtcacagacttcgaaggttcgaatccttctcccaccaccatctgaatctgaatcatcttaagccacatcactatcccaggtgggattcccgagcggccaaagggagcagactgtaaatctgccgtcacagacttcgaaggttcgaatccttctcccaccaccatctcgtatgttgcacaccatccccaaaataatacctaagcttcctgttctgcggggagagggatgagaaccttcgattaaggttcgggtcgagcatcgcgagacaacgcgcttcagcgcggcccgcagggtgaggcgcagcgcgccgaataatccttctcccaacaccatctcgcatgttgcacacaatcaccaaaataatacctaagcttcctgttctgcggggagagggatgagaaccttcgattaaggttcgggtcgagcatcgcgagacaacgcgcttcagcgcggcccgcagggtgaggcgcagcgcgccgaataatccttctcccaccaccatctcgtatgttgcacaccatccccaaaataatacctaagcttcctgttcacccccacattcctgcccgctttcacacaatctcagcctgttccgccatgactttttcagcaaaaatcgctaccatctccgcctgacatttctgaacaacggtcgatctcatgaaatttgtttcatttaacatcaatgggttgcgtgcccgcccgcatcagcttcaggcacttgtcgaacagcatcagcccgatgttatcggtctgcaggaaaccaaggtccatgacgacatgttcccgctggaagaggtgtcaaagctcggctatcacgtcttctatcatggacagaaaggtcactacggcgttgccctgttaaccaaagctgagccagtgtcagtgagccggggtttcccgggtgatgacgaagaatcccagcgccgcctgatcatcgcggaacttcccagcccgattggcgacatcacggtaattaacggctattttccgcagggcgagagccgcgaccatcccaccaagtttccggctaaagagaaattctatcgcgatctgcaacgtctgctgaccgaggatctgcctgctgataagccggttctgattatgggcgacatgaatatcagcagcaccgaccgggatattggtattggtgaggagagccgcaagcgctggctgcgcaccggcaaatgctccttcctgccggaagagcgcgagtggatggaccgcctgctgggcctgggactggttgatacctggcgtgagcacaatccggaggtggcggatcgcttttcctggttcgattaccgttcgaaagggtttgatgataatcgcgggttacgcatcgatctggtgctggcgagcaaaaccctggcgtcgcactgcgttgagaccggcattgattatgagatccggggcatggaaaaaccgtctgaccacgcgcccatctggtcaaccttccgcttttaactgacggtcgcgtggcagagcgccacgcgacggctatttcactattttccagatcaggttattggtgccgatggagtgttcatcacgggtacattgcagcaacaccccctctgatttcaccaccgcgccttccgtgtagttacggttctcaaagatacagcagcggagacagtctggctgacgtctctctgcctgtgtccatgcctcgggtggcatatccaccacgacatcggtgttgccaccattgctgccctgctgtggcattgactgataacgactgttggcctgcgccacgctggtcgccagcgacagggccacgaccagtaatactgaataacgcctcattccgtctcctttactttacgcctggttttgcgcaccggacgtttctgtccggtggacggtaatccccgaaatgcatgcgccgcaggctgctgtcgcgcctgctggatcagaccggttaaggtctgcacaagcggctgcatgaattcatcatagcggcaggccttttcgctgatacgcgtcagtgtcgattcccactgcgccgtcatatccgggcgtgctgccagatcgggcagggagtgaatcagggcgcgtccggcatctgtagaattgatatagcggcccttcttcaccaggaagccacgacgaaacagtaattcgataatgccggcgcgtgtggcttccgttcctaaaccatcggtcgcacgcagtactttctttaattctttatcctgaacgaaacgggcaatgccggtcatcgcagaaagaatagtggcatcggtaaacgggcgtggcggctgggtttgcttcgccagcacctctccgcgctcacacagcagctcatcccctttcgctaccacaggcaacggcatgccgtcgttctcttcatcccgctctttgttgcccagcagcgcacgccagcccgcttccgccaggaagcgcgctttcgcaacgaattttccgccagcaatatcgagatcgatgacacatttgcggaataccgcatccgggcagaactgcatcagatactggcgcgccaccagttcatagatatgctgctcgttttcactgagcttcaccgcgctggcacgggccgttggaataatggcgtggtgggcatccacttttttatcatcccagcagcgatttctgcgatcggcatcgaaatctgccggtggggttagctgtgactgatgcgcctgtatcgcctttaacaccgcatgacgaccggcaaaatgctcttcaggcagatagcggctgtccgaacggggataggtaatcagtttatgggtttcgtaaagccgctggcaggtatccagcaccgtctgcgcactcagcccataacgtttagcggcctcaatctgcaggctggataaggaaaagggcagcggcgccacctcattttcgcgcttatcgctgtaagcagtgacgagcgccggctggcccgtaatacgcgccaccacatgctccgccagggcgcgtttgagcaggcggccctcttcatcctgccacggttcacaggcttcactggggatccagctggcgataaatcgggcgccgtcaggcgtaaggatgtgcgctttcacttcgaagtaatctttcggcacgaagttctcgatctcttcatcgcgccggaccaccagcccaagcaccggcgtctgcacccggcccaccgacagtacgccatcatagcctgcattgcgtcccagcagcgtccaggcgcgggtcatgttaatgccatagagccagtccgcccgggcgcgggccagcgccgagacgcacaacggaataaactcgcgattttcacgcaggcggtttactgcccggtccaccgcctgaggattgagatcgttaatcagacagcgctgcaccttgctgcgtttttcagccggcaggttcaggtagtcgagcacctcatccaccagcaactgcccttcccgatccgggtcaccggcatgcaccacttcattcgcctgcgccagcaagccctcaaccactttcagttgcttagcgaccgagggacgcggttttagctgccatttttccggaatgatgggtaaatccgccagcgaccagcgcgcataacggctgtcataactgtcgggttgcgcctgctccagaagatggcctacacaccaggtgacgatctgatcgttgccgcaggcaatgaatccatcaccgcgtcgatgcggtttcggcagcacatctgcgatagcacgccccaggctcggtttttccgcaataaacaaacgcattgaatcaggtaatccttaacatcagggggaacgcagtgataaccggttgtccgctgtcggtttgaatactggggctatgttagcctggcaggcccgctggcgtaagtgtgatgcgcggcgttagcgatcgttcgcacaggaaccgtgcaaaaagcagggctgaaatgcaccctgccggaaccggacaagcattgtagtcagaagtaacggacgaaaggcgccgtgtcaggtgggagcaccgtggtgctggatttcagttgcggggtgcccagatagagaaagccgacgatggcatcctgttcgcggcagccaaacccctggcgtacctgctcgtcatcggtccagggaccactgcgccagataccgttgtaaccctgagcgacggccgccatctgcatggccatcactgcacagcttgccgaggcgatctgctcccagcgcggcactttgtggtgctcttcacaatgtgccaccaccgtaataatcatcggtgcgcgaaacggtgactggctcgctttgttaatcgccttttcatccagctgtttatcgcgtgctgcctgctccagcagctggctcagacggtcgcgcccctcattttccacaatgataaagcgccagggttgcagcgtgccgtgatccggggcgcgcataccagcccgcaggatattttccagtgcgtcacccgcaggtgccggctcagtcaggcgtgaggccgaacgtcggttgaccagtaactccagtgcgtccatgtttctctcccgatctctgtaatgttgcagttatcctggcacaggcagattttttgtaacagtgcgcagtgatttcctgctgacttttaacacgccgctctttaggatgagctcgtcggggaagtctggtccgcgcggcggccacttcctgctacatatttatggagagtctgatgcgcacattgtggcgaataattgcaggtctgttccgctggagctggcgggtactgaattttatcagggaatttattctgaatattttcctgattttgttgattgtggtgggtgtagggatctggctgcaggtcagcgggtcgggcggcagttcagcgccgattcagcaaggcgcactgaaagtggatctcagcggcgtgctggtggataaaccgtcggtaagcaatcgtctgagcaaaattggccgccagctgctgggtgccagcagtgaccgtttacaggaaaattcgctgtttgatgtggtcgacgctattcgtcaggcaaaagatgacagcaacattaaaggcatggtgctcgatttacgcgaatttgccggtggggatcagccttcactgcaatatgtgggtaaagcgctacgcgaattccgcgacagcggcaagccgatttatgcactgggcgacagctacagccaggcgcagtattaccttgccagctacgccaccaaaatctatctgtcgccacagggcaccgtagatctgcatggtttcgccactaacggactctattacaaaaccttgctggagaagctgaaagtcacctcacacgtcttccgtgtcgggacctacaaatcagcggttgagccgttcctgcgtgacgacatgtcccctgccgcacgggatgctgacagccgctgggtcggtcagctgtggcagaactacctgaacaccgtggcagcgaaaccgccagattacgccggagcaactcttccccggtgctgctgcgattattgccggattaaacgccgtgaaaggcgataccgcgcaatatgcgctggataacaagctggtcgatgccctgggttcacgtgcggcagccgatcaggagctggtaaaaacctttggtctggataagcagagcaacgattaccgtagcgtcagcatctatgactacagcgtgaaaaccacctccacgcagcaggatggcaacatcgcggtagtcatggccagcggtgccatcatggatggtgaagagacgccgggcaacgtcggtggcgacacgacggcggcgcagatccgcgatgcgcgtctcgatccgaaaatcaaagcgattattctgcgggtgaacagcccaggtggcagcgtcaccgcctcggaagcgattcgtgaagagctggcggcagcgcaggcggccggtaagccgattgtggtctcgatgggaggcatggcggcgtctggcggttactggatctcaacccctgccagctacattgtggcgaaccccagcacgctgactggctcgattggcatcttcggcgtgatcaatacgctggagaacagcctggacagtattggcgtgcacaccgacggtgttgcgacctcaccgctggcggatatctcaaccaccaaagcgctgccaacggaagttcagcagctgatgcagctgaccatcgaaaatggctaccgcaactttgtcggtctggtggcgaagtcacgtcataaaacgccagagcagattgatgccattgcacagggccacgtctggaccggcagcgatgcgaaagccaatggtctggttgatgcactgggtgacttcgatgatgccgtgaagaaggcgggcgagctggcgaaagtcagtaatccgcagctgagctggtatcaggatgacccgagcttcctggatatgatgctgagccagatgaacgcgtcggtgcaggctgtcctgcctgatacgctgaaagcctggctgccagcaccgatgctggatgtgatgagtgctatgaaagcccagcctggtctgttcgacaagcagaacgatcctcagaaccgttatgcattctgcctgaactgcggcgaagtgcgataaacctcgcagcccggccgctggtcgggctgcttttccccgctattccccttatactgcgcgttttatggcgagtctgagttctctaatgcaaaagaaaaacatctacgtagcctacactggcgggacgatcggtatgcagcgttcggcgcagggttatattcccgtctccggacacctgcagcaacagctggctaacatgccggagttccaccgccctgagatgcctgatttcaccattcatgagtatcagccgctgatcgactcttccgacatgaccccgcaggactggcagtctatcgcagaagatatccgtcagaactacgatcgctatgatggttttgtgatcctgcatggcaccgacaccatggcatttaccgcctcagcactctcctttatgctggaaaacctggccaagccggttatcgtcacgggctcgcagattccgttagcggaattacgttcagatggtcagcagaatctcttaaactcgctctatgtagcggccaactatccgatcagcgaagtgtcgctgtttttcaataacacgctctatcgcggtaaccggaccaccaaggcacatgcagacggcttcaacgcctttgcttcgcccaacctctctgcgctgctggaagcgggcattcatattcgtcgcctcaatacaccgccagccccagccggtcagggcgaaactgaaggttcacaccattacgcctcagcccattggcgtggtcaccatctatcccgggatttcagccgacgttgtgcgtaactttctgcgtcagccagtcaaagcattgatcctgcgctcctatggtgtgggtaatgcaccgcagaacaaggaatttctggcagaattgcagcaggccagcgagcgtggcatcgtggtggtaaatctcacccagtgtatttccggcaaagtgaatatgggcggatacgctaccggcaatgcgctggaacatgctggtgtcatcagcggatttgacctcaccgtggaagcggcgctgacaaagctacactttttactcagccaggatctttcggccgatcaaattcgagccagaatgcagcagaatttgcgcggcgaactgactgaagactgaaacggagcgatatgtaatgaagcgggcactcatcattattgatattcagaacgatttttgccccggcggcccgatggcagtccatgagggcgaccatacggtcgaggtggcaaatcgttatgcgcgactgttccgtgaaaacggtgaatgcgtactggcactgcaggactggcatccggccaatcacggcagctttgcctcggtttccggcgagccggtttacacgctgggcgagctaaatggtctggcccagatctggtggcccgatcacggcattcagggctcaactggcgctgattttcatccgggtctcgatcgctcactgttcgatgcgacgttccataagggccaggatcaggatgtcgacagctatagcgccttttttgacaatggccatcgccgtaaaaccgagctggacagctggctgcgtgagcgtgggatcacccatctggtgatgctggggctggcgacggattactgcgtcaaatatagcgtgctggatgcgctggagctgggttatcacgttgaggtggttaaagagggctgccggggcgtcaatctgaatcccgaggacagcgaaattgcctttgcccagatgaccgctcagggcgcgattctgatttaaaatggagctggcatgacgccagcttttttttaatgcagatggatgcgggtcacgtcagggtcaattccaaactcttctttgagctcttttttcgacttcatcaccatttcgccacctttgccgatggtcatgtgctgcggcgcgtcgttgtgccgcgcctgccacatcatgaccagctgcaggcaattgtcgcgctgctcctgggtcagtgccacgccatccggccatttaccaatctcaaccgccgtggcaagacgctgatagacttcaggcgtcatcgatgcaagcattgcttcaagctgttccttcatcgccattaccctttggtctgttcgccttgctcgtcggtaaaattcagcgaggcggagttaacacaatagcgtttcgccagtcggctgcgggccgtcagggaagacatgtcccaggtgcgcatcgcagctgccacagcggatctcaatacgctgcatgccgtgtgaatcatcttcaatatagcgaatcgcatcatcactgaccggctgatagaaactgggccagccacagccagagtcatacttcgtctcagagagaaaaagtggcgcctcacagatcagacagtggtagatcccttcctgcttgttgtgcagcagtgcgccgctgtaaggcggttccgttccgcgttgctgagtgacgtagcgttgcatttcagtcaactgtgcaatttttgcttcgggtgcggtgtctttagccattttaggattccgggcagtgccattctgaaaaattcgactattattctaacaaatgatcaacataacccgggtctttttttgtgctcaccctttcagcctgctctctgctaagcggatttgtgacatcgatcaccttttatccggcgcatccctatatattcggcgattgattcaacgaagcgcgatatcattggcggcgcgcaagcggttgcgcatcgaataattcctttcaggcgaattgatttgtcgcaacaattgacacgattccgcttgacgcctggtaaggtttttgtaattttacaggcaaccttttattcactaaccaatagctggtggaatatatgactatcaaagtaggtatcaacggtttcggccgtatcggtcgcatcgttttccgtgctgctcaaaagcgttctgacatcgaaatcgttgctatcaacgacctgctggacgcggattacatggcgtacatgctgaagtatgactctactcacggtcgtttcgacggcacagtagaagttcaggatggcgcactggtggttaacggtaaaaaaatccgtgttaccgctgaacgtgatccggccaacctgaagtgggatgaagtaggcgttgacgttgttgctgaagcaaccggtatcttcctgaccgacgaaaccgcgcgtaaacacatcaccgcaggtgctaagaaagtcgttctgaccggtccatctaaagatgacaccccaatgtttgttcgtggtgcaaacttcgacaaatatgatggccaggatatcgtgtctaacgcatcctgtaccactaactgcctggcaccgctggcaaaagtgatcaacgacaagtttggcatcgttgaaggtctgatgacgaccgttcacgccaccactgctacccagaaaaccgttgatggcccgtctcataaagactggcgcggcggccgcggcgcatcgcagaacatcattccttcatcaactggcgcagctaaagccgttggtaaagttctgccagagctgaacggcaaactgaccggtatggcattccgcgtaccaacccctaacgtttccgttgttgacctgaccgtgcgtctggaaaaagcggcttcttacaaagaaatctgtgctgcaattaaagcggctgcagaaggtgagatgaaagacgtttctgggctacgttgaagatgacgtggtttctaccgacttcaacggcgaaatcctgacttcagtgtttgacgctaaagccggtatcgcgctgaacgacaactttgtgaaactggtttcctggtatgacaacgaaactggctactcaaacaaagttctcgacctgattgcactggtttctgctaaataaggcagccagacatcattgagaataagggcgacttcggtcgccctttttttgatccgctcaggaaggaatcgaacatgcaagataaactgttttctctgccggtggtcacgcagatctccccttacctcacccagcgccagataggtgaactccccgccattgttgtgagtcaccctaaagtgcgggcagccattacgcttcagggcgcgcacctgatcgcctggcaacccagcggcgaaaagccggtactctggctgagtgataagagtctctttgcaccgggtaaggcgattcgtggcggcgttccgatctgctggccgtggttcggcccggcgggcgaaccggcacacggctttgcgcgggttcagccgtggaagctcacggcgcatgatgaaaatgaagatggcgtcatgctgacgctggtgctggagagcaatcctcagacgctgaagctctggccgcatgaattcaccctgattgcccgcttccgcctgggccagcattgtgagattgagctggaagcctatggtgactttgaagcgacggcggctctgcacagctactttaccgtcagcgacatcaacggtgtggaagtctcgggtctgggcaatagctatatcgacaaagtgaataacggcgaggtggccagcagcgacggcaaacagcgttatcctggacgcatcgaccgtatctttaccgtagcagaagattgctcagtgattaatgatactgcgggcgagcggcagatcgaggtgtaccaccatcatcatagtgacgttgtcacgtggaatccgggtgtggaactctcctgcagcatgacggatatggcgaatgagggctataagaccatggtctgtgtggagacggcgcgtatcagcaaaccgttacgcagcgcgggtgaaaagccagcacgactggccacgacgttccgcctcaaaaagaaagccgcagccagcaacaacgttaacggctaaacaatatccagcggcaacttatgctgtggcgctggccaggcgcgatcgatgagctgcaaatcctcatcggtcagttccacctccagcgccgccgcattttcctgaacgtgggccacggaactggctttaggaatggcaatcacccctggctgacgaatcacccaggccagcagtaattgcgccacgctgatgcccttctgctgtgcaatctgagtcagctgcggatcggtgaagagtgagtcacgtagccgtccggcctgggccagcggacaataggccatgaccggtacgccacgctgctgacatgccggcagcagatcaaattcaatgccgcgtgaagccagatgatagagcacctgattggtcgcgcaggcctcgcccttctcttcatcccacagtttcggccatatcatcggtgtcaaaattcgatacgccccagtgacgaattttgccctgctgctgcaggcgttccatggcgcgcagtgtctcttccagcggaatattgccgcgccagtgcaaaagatagagatcgagataatcggtttgcagacgttgcaggctgcgctcacaggctgcaatggcatccacttcgcccgcattccacggataaactttggagaccagcagcgcccggtcgcgacggcccagcagtgcctgcccgaccacctcttcggctccgccatctgcatacatttcggcggtatcaataagctgtaatccgcactcaagacccgcctgcaatgcagcgacttcatcagcacgctgcgccgggttttcacccatataccaggtgccctgaccgatcaccggcagctcgctaaaaccggcaaagttaatcgtgttacgcattctgctctcccgccccattctgaggccctgtaaaagaacagagggcattaaatgccctcttttggtgcgttatcagaaggtatagctgacacccgtccagattaacgcctgcccgcttttatcaatcatcgggctgtctttgatttcgctgtcgaagcggacgtaacgtcccatgacgctggcattccactgtggcgcaatctgatagctggcgctcagttccacataaggtgaccagctatcatccggattgtaacggctgatgccggtacgggcgctttcatgcccggataccccatagtaataacggttttgattggcgctgttccacgtggccccgatgcccggcgtcaggctgaagtcacccatctggaagcgatagaggtatgtcaggtcccagatcatcccattgctgttattgagcacatcccccagcaatgaggtacggacaatcccccagtcagcggtgtgacgataggttgcgccacccatcagcgtcatgcggcgtttatccagccctttcatgtcgcccaggtcattgtcgctgggtttgtactcctgcggtgaacccagcagcgtcagtgacagctggttctgaggatctttccacaggtagtagccgccctgcaggctgcggaaccagaagtcttcaccctcataattgataaccggaacggggatataccggtcctggccgccgcgataaggtgattcggcatagatgaccgatgcgccaatggaaagcggtgcggcattcgcgtgcgtggccagtaaataacagggcagaagtgcaacaagcgtcttaaatttgaattggttcacaatttattcattccataaatataacaatcaaacaggaagtctaacgttttttcacggctggattaacttatatcgaaatcctttaagtgacttatcgatgaaagtggcattaaaggttaaaaacacgttaagttaaagcatcacccatatgaacgcatctcacaacagacccgctgtacagttgatcttcccctcattaacccaaacccgtggaggaaatttcctagaagccatctacagttagaagtaacagcagacattttgtacgagcagagtaaccacaaaagttgtgtatcccgataagaaagatcaggttggcataagggttgctgtactcaacagagaatatcttccgggagctgctataagcctctaattacgctccttacctgtgctaaaaacgaaaggacgggcatcgctatgaatatattcgatcactatcgtcagcgttatgaagctgccaaggacgaagagttcacactgcaggaatttcttgctatctgtaagcaggatcgcagtgcatacgccaacgctgcagagcgactgttaatggctatcggagagccggtaatggtcgatactgctcaggagccacgcctttccagaatattctccaaccgtgtgatgggacgctatccggcgtttcgaggagttttacggcatggaggaagcgattgaacagatcgtctcctacctgaaacatgccgctcagggactggaagagaagaaacagatcctctatttactgggaccggtaggtggcggtaaatcctcactggcggaacggcttaagtcgctgatgcagcgggtacccatctatgtactgagcgccgacggggaacgcagcccggttaatgaccaccctctctgcctgtttaatccgcaggaagatgcgcatattctcgaaaaagagtatggcgtgccgcgccgttatctcggcacgattatgtcgccgtgggccgctaagcgactgcacgactttggcggcgatatctcgcgtttcaaagtggtgaaagtctggccgtcaatcctggaacaactggcgattgccaaaactgaaccgggtgatgagaacaaccaggatatctccgcgctggtcggtaaagtggatatccgtaaactggaaaaccacgcgcaaaacgatcctgatgcttacggttactccggcgcactctgccgtgccaaccagggcatcatggaattcgttgagatgttcaaagcgcctatcaaggtcctgcaccctttactgacggcgacgcaggaagggaactacaacggcaccgaggggatttcggcgctgccgtttaacggcattattctggcgcactccaacgaatcagagtgggtgacgttccgtaataacaagaataatgaggcgttccttgaccgtgtctatatcgtcaaggtgccctactgcctgcgggtctctgaagagatcaaaatctacgacaagttacttaatcacagtgagctggcgacctcgccctgcgcaccgggtacgctggaaaccctggcacgcttctctatcctgtcacgtctcaaggatccggataactccagcatctattccaaaatgcgggtctacgatggtgaaagcctgaaagataccgaccctaaggcgaagtcctggcaggagtatcatgattacgccggtgtggatgaggggatgaacggcctttcaacccgctttgcctttaagattctgtcgcgggtatttaactttgaccacgccgaagtggcggccaacccggtgcacctgttctatgtactggagcagcagattgagcgcgaacagttcccacaggatcaggccgagaaataccttgagcacctcaaaggctatctgatccccaaatatgctgagtttatcggcaaagagattcagaccgcctatctggaatcttactctgaatatggtcagaacatctttgaccgctatgtgacctatgccgacttctggattcaggatcaggagtatcgcgatcccgataccggacagctgtttgatcgtgaatcgctcaacgcggaactggaaaaaatcgagaagccagctggcatcagtaacccgaaagatttccgtaatgagatcgtcaacttcgtgctgcgcgccagggcacacaataacggtcgcaacccgaactggaccagttacgagaaattacgcaccgtgatcgagaagaaaatgttctcgaacacggaagagctgctgccggtgatttcgtttaataccaagacctccaccgatgagcagaaaaaacatgatgactttgtcgatcgcatgatggaaaaaggctatacccgcaaacaggttcgcctgctgtgtgaatggtatttgcgtgtgcgtaaatcgtcctgataagagtctgtaagcttgccggtaagtgataccggtctgacgaggtcgggtttcgcccggcctgcttacaatgtagtttgggggaataccatggcctatttcatcgatcgccgactcaacggcaaaaacaagagcgcggtaaaccgccagcgcttcttgcgccgttataagtcgcaaattaagcagtcgatctccgaggccatcaataaacgctcggtgaccgatgtaagcagcggtgagtctgtctctatcccgattgacgacatcaatgagccgattttccatcagggacgcggcggcaaccgccatcgggtccatccgggcaacgaccattttgtgcagaatgaccgggtcgagcgaccgcagggtggcggcggtggcggcagtggccagggcaatgccagtcaggatggtgaaggtcaggatgagtttgtctttcagatatcgaaagatgagtacctggacctgctgtttgaagatctcgccctgcctaacctgcgccggaaccagcatcgccagttgaatgagtataagacccaccgtgccggcttcacctccaacggtgtgcctgccaatatcagcgtcgtacgttcgctgcagaactcgctggcgcgtcgtacggcgatgaccgcgggtaaacgccggatgctgcacgaactggaagaaacgctgctggagattgagaactctgaaccggctcagcttctggaggaggagcggctgcgcaaagagatcgccgagttgcgggcgcgtatcgaacgggtgccttttatcgacaccttcgacctgcgctacaaaaactttgagaaacggccggagccttccagccaggcggtgatgttctgtctgatggatgtatccggatccatggatcaggccaccaaggatatggcgaaacgcttctatatcctgctttacctgttcctgagccgcacctacaagaatgtcgatgtggtttatattcgtcatcacacgcaggccaaagaggtggatgaacaggagttcttctactcccaggagaccggtggcaccatcgtttcgagtgcgctgaaactcatggatgaggtggtgaaagagcgctatgacccggcgcagtggaatatctatgctgcgcaggcgtcagatggcgataactgggccgacgattcaccgctctgtcacgagattctggcgaagcatattctgccggtggtgcgttattacagttatatcgaaattacccgccgtgcgcatcagacgctgtggcgcgagtatgagcatctgcagtcgacgttcgataactttgcaatcgaacacattcgtgagccggaagatatctacccggtgttccgatcgctgttccataaacaggcaacggaagcctgatgcactaagccggctaatcgccggctttttttatcttccgaataacctgctaaaacagtctgttttctgccgcttgcctgccaaccccctcattcttcacattaatctgattccatacgctgttaagcaattcgtataatgatcattttcacaatgacaactccttgataaaacattatctttcagagatagcatggatatttgtcaccagtcgctgcaccgcactgtcatatctcaggagatcgggtttgaaccacactattgtctacagtctgtttatcatcggttccgtgctggtcgcatcgagcattctgctcagctctttctcatccagactgggcatccccattctggtgatcttccttgccctgggcatgctgaccggggttgatggtatcggcggcatcgcctttgataactatccggcggcttacttaatctcgaacctggcgctggcgattatcctgctggatggcggcatgcggaccaaagccagctcatttaaagttgccctggggccagcgctgtcgctggcgaccgtcggggtcatgattaccgcaggcttaaccggtgtggtcgccgcctggttgtttaacctggatatgatgcagggcttcctgattggcgcgatcatcggctccacggatgccgccgccgtcttctcactgctgggtgacaaaggcctgaatgagcgcgtcagctccacgctggagattgaatcgggcagtaacgatccgatggcggtgttcctgaccattacgctgattgagatgatcgaacagggccgcagcggccttgactggatgttcctggtgcatctggtgcagcagtttggtctgggtatcgtgctgggcctgggcggcggctgggcgctgcagcagctgattaaccgtatcagtctggccggtgggctctatccgctgctggcgttgagtggcggcattctggtgttcgccctgaccacggtattagagggcagcggcatcctggcggtctatctgtgcggctttttactgggcaacaggccgattcgcaaccgtcacggcattctgcagacatttgacggcatggcgtggctgagtcagattggcatgttcatcgtgctgggactgctggtaaccccgtctgatttgtggcatatcgcagttccggcgatgatcctctcactgtggctgattctggtggcgcgcccactgtcggtgtttattggtctgctgccgtttcgcagttttaccacccgcgaaacgcgtctttatcagctgggtcggtttacgcggcgcggtgccgattatccttgcggtcttcccgatgatggccggattagaaaacgcgtcgctctattttaatatcgccttctttgtggtgctggtctccctgatgttgcagggcacctcgctgggctttgcagcgaaaaaagccaaagtggtggtgccgcctaccgcatcgcctatcagccgtatcggtctggatatccaccccgaaaatccgtgggagcagtttgtctaccagctcagcgctgacaagtggtgcatcggtgccgcactgcgtgacctgcagatgccgcgtgagacccgcatcgccgccctgttccgtgacaatgtgctgatgcatccgaatgatggaacgcgtctcagggagaacgacgtcatctgcgtgattggccgtgagcgcgatctgccggcgctgggtaagatgttcagccagtcgccgccggtttccctcgaccagcgtttctttggtgactttattctggatgctgaagctcgcctgcgcgatattgcgcagatttacggactggaactggatgagaacaccaacgatcagcagtcgctgggacaactggtgctgagtatgctgggcggcgcgccggtggttggcgatcaggttgagtggaatcagctgacgtggaccgtcgcggagaaagaggataaccgtattgtgaagattggtgtccgtccggctgaagagaaggaataatcctaatcattcagccacgttattttctgtcgatacgctaagcttaaaagtctatgccagcaaaaacgggagaaatgaatgggacacgtggttaaaattggtcgttatgagattgttgatgccgatcttgacagtgagaacctcgacaccgtcagcatcccctgccacaccaatcccggcttaattacccaacttgatggctgggatcgcgataccagcgttccggcatggattgacggagaaccggtggatctgcagattggtcattacgataaacagcaggaccgctggattttaaaaaaacctgcctgagtccgttatcactaccgccagtcgtaagatttggcggtaattcctaaaaagcgtcttaaacagtttggttataacctacccccgccttattttatccagtaaaaaccaaaacttagccatttaaaactttaatcacttttgatgttttcagattttttccgtattaactctgtcaaataactcctgcatactcattctcaatgctgcaacatttcgtgagtactatcacgctttagccgttatcttttttgcagctgcactggctttactgactgcaacagactgcaacagactgaaaattattttttaatttttcagaagcccacccctgagcgcgtacatgattctggtcaggccatcttttacttgagaaagagagcaggttttatggcaagtacattgataatgaatagcccgagccgctcgtggagcggcacgcgtaaaaatatcatcgtgaaattcgccctgagcttttccgatctgattgcacttaacctcgcactgtttttatctgccgcgacgatacagggtatttggggcgagctggatacctttattccacctcatcaaattgaatatcgttttgtggcacagtttattatgtcagtcatgtgtaccggatggttctgggtacgcctgcgtcactatacctatcgcaaacccttctggtttgagctgaaagagatcattaaaacattatttgttttctcgctgctcgacctcgcgttgatcgccttctctaaatgggatttctcccgcatggtgtgggtcttcagctggacatatgccctgctgctgctgccgctgatgcgtgctctggttaaacgcgccattcacaaggcgggtcagtggcagaaagagaccatcattattggctccggcagaaacgccaccgaagcttacgcggcgctgcagagtgaagagattctgggctacaacgtacaggcctttatctcggtcgatgatgttccggctcagcagagcgtgaatggcgtgccggtgatcacctggaaagatattaactggcagaccattgaccgtgacaacgtgcagtttattgtggctatggagtatgagcagcagccgatgcgcgatcgctggctgaaattcctgtcgaagatgaactgccgttcagtttcagtgatcccgacgctgcgcggcgtgccgctttacggcaccgacatgtcctttatcttcagccatgaagtgatgattctgcgtgtcagcaacaacctggcgaaacactcctcccgtttcatgaagcgtgcctttgatatcgtggtggcgtcgatgctgctgctgttcctcggcccaatcttcgccctgctctgttatatggtaaaacgtgatggcggcaatgccatttatggtcacgagcgtgtgggccagaatggcaaaaaattcaaatgtctgaaattccgttccatggtgaccaattccaaagaggtgctggagaaattactggcaaccagcgaagaggcgcggattgagtgggacaaagatttcaaactgaagaatgacccgcgcgtgacccggattggtagtttcctgcgtaaaaccagcctcgatgagttgccgcaactgtggaacgtgattcgtggcgagatgagcctggttggtccgcgtccggtgattgaagctgagctggagcgttatgccggtgatgtcgactactacctgatggccaagccgggtatgaccggtctgtggcaggtcagcggacgtaacgatatcgactatgatacccgcgtctattttgactcctggtatgtcaaaaactgggcgctctggaccgatatcgcgatcctgttcaaaaccgcaggcgtggtgttacgccgcgacggcgcttactaatcagacctcggcgatgcctgtttacagcaggcatcgcactttccgcacgacttcctctatcttttttgccgctgaatcattaccctctgcgatcgttttttaacagaacgcttaccctctggttgttatgcaaaaatttactctgctgttattaagcctggtgctgctggcacccttaggcatcgatctctatttgcccacgctgccacaaatcgcagaagggctggatacgccggttaatctggtgcagaccaccattcccctgtttctgctggtcatggggctgggacaactggtgaccggcccgctggtggacaactatggccgtaagccgattgccctggtgggcctggcgctttacatcacgggtagtgccatcgccgccaccgccacctcattcccgctgttcgtccttgcccgcctggtgcagggctgtggcgtctgctgcagcgcggtcgtggcctttagcggcgtgcgtgaccgcctgagcggtgatgatgccgcccgtgcgtatggcttcctgaatggtgcattaaacatcgtcccggccctggctccgctgctgggcggtttgctggccagcgcctttgactggcgcgcacccttctggtttctctgcgcctacggcgtgctgattacgctgctggtgattatctggctgccagagacgcgcccggcggataccctgcgggtgaaaggattaccgattaaacagtatgccgcgatcctgcgtcagccgcgctttctggcgtttcgcgttcgccaatgccggtgcgctgggcatggtgctgacctacgtgtcgctggcaccgcaggtattaatgaccgaaggcgggctgacgccaatccagttctcttttgcttttggcgccaacggtttctggatcatgtttgtcagcatgttcgtcaataaagcgattcgcaaagcgggtcgccctttctgcctggcgatgggattcttcactatgctgctgggcgcggtgctgctggtagcggggatgcagatcttcccggcggagatgcagacgcactgggcgctttacatgttcccggtggccgtttcagttgccgggctggcctttacggtgggaccggccaccagctatgcgctggagccctatcagcaacaggcgggcgtagcgtccgccttgcagggattcattcagatggccggtggcgcgtcaggcagcctggtcattgtggcgctgccggtggcggagaagctgtcgctgagtctgatgatgctgctgggtgcagcgctggcctttatcgcctggcgctgcagcagaaagatgcgcggcagcctgaccgcgcttaaataacggttaccggaacgcggggtgccagcgcacacatcagctcgtaccctaccgttccggccgcttttgccacctgatcgattttcacctgctcaccccacagctccacggctgagccaataccggcctggggacagggggtcaagtcgacggtgatcatatccatcgaaaccgcaccaaccacctgagtcattacaccatcgacacagacgggcgtacccgtcggggcatgccgtggatagccatccgcgtagccacaggccaccacgccaattcgctgcgctgcactggcgtgatagcggtagccgtaacccaccccatcgcccgcctgtagctgctggaccgcaataatctcactgcttaaggtcatcactggcttaaggccactgcctgcaatgtcctgccagtcaccgctgggcgacgcaccatacagaatgatgccgggacggacccagtcaaagtgcgcttcaggatgccacagggtgcaggcggagttggagagcgatcgcgggcagttcagcccctcagccgcctgctctacgcgctgcagtggcgcaatcagaccctgcggattttccgcatcggcaaaatgggccatcagcgtcatctcacctaccgtgctcagcgcccgcagcttttgccatgcaccgttgacctgttccgggcgaaaacccagccggttcatcccgctgttcattttgagatagatatcaaccggtgctgcaagtctggcactggccagcgcgttgatttgccagttactgtgtacgctggtggtgagacgataacggtcaatcagctgcagatcctctggctggaagaaaccttccagcagcagaatcggctttttccagccctgttcgcgcagctggatcgcctcttccatattaagaagcgcgaagccgtcagtggcagataacgcctcgcgcacgcgatcaatgccatggccataagcattagctttcaccactgaccagacgcgggaggcgggtgccgcctggcgaacaacagtcaggttatgacgtaacgcctgctggttgatggtagcgacaatcggacgtgacatcctctctctccctgaatacttaacgagttgcgttggcgttacgcagcggcgatgaggtcgccgcgaaaccgggtaagtagcggaacaccgctaagtcatccgccgcaatggccggctttttaccggagatgagatcggccagcaactgaccagaaccacacgccatcgtccagcccagcgtaccgtgaccggtattgagccagagattagagatcggtgtggcacccacaatcggcgtaccgtctggcgtcatcggacgcagaccggtccagaaactcgcctgcgcgagatgaccgccttcaggatagagatcactgaccaccatctccagcgtttcccgccgcgcttcggtgagtttggtgttaaaaccaacaatttccgccatgccgccgacacgaatacgatcgtcaaaccgcgtcaccgccactttgtaggtctcatccaggatagttgaaaccggtgcggcatctggatttttaatcggaatagtgagtgaatagcctttcagcggatagaccggaatatcgatgacattttttaacagcgcggtcgagtaggaaccaaacgccaccacatagctgtccgccttgatgatctcatcaccgcacttcacgccatagatgcgattgccatcgcgcagcaggtggtcgaccggagtattaaagcgaaagaccacgcccgcctcttcggccatttttgccagccgctgagtaaagagctgacagtcgccggtttcatcattgggcaggcgtaatccgccggtgagtttatgctgggttgccgccagtgccggttcaacgcgagacagttcatgcgcctgcagcaactcatagggcacgcccgcgtcgcgcagcaccgcaatatctttgctggcgctgtcgaaactgctgctgggtacggaacagttgcagcgtcccgccctgacggccctcataggcgatgccggtttcactgcgcagcgctttcagacagtcacggctatattcggcaatccgcaccatgcggcttttgttctgctgatagtgattgatgtcgcagttgcgcagcatgtgccacatccactccagctgaaaactactgccatccagccggatagccagcggcgcgtgacgctgaaacatccacttcaccgctttcaatggcacgccgggcgctgcccagggtgcggcataacccggagagatctgaccggcattccctgcactggtctccatcgctgcggcgggctgacgatcaatgaccgtcacctgatgtccggcacgtgccagataccaggcacttgccaccccgaccacaccacttccaagaattacaacgtgcatagctcccccacccgacctgtaaaagcataattcactgttcaactgatgatagtcagcggatttacacagcagacaccaccacagaatttcaccatccatttcacatcttttttacttttcaggtaactaaaatcttgtcgcacggccaatttcagcgctttatgcgtcttaatccttaaacacagaaataaatgacaacgaaggcagttaaatctgcctgttgcaggagattcattcaaccccatacattccgcttataaacaggattagattccgcaatttataataaggctagtattaaaggctgttaaattctctgccgcaccactcttaatgattttgtgccaaagaattcgtttgagttcgcatttcggataagcgacagtgggctatcattgttgtgttcgctcagtttttttcgggttccctttttcaggatgaagccttaaataaccagaacgggttgtctttcgggtcagccggtttgcaaaaaagaggtgcgctatgacgacaatctttgacgaagccatcagagacagcaaacgactcaatgacggaccagactggacattcgaactgcttgatgtctacttagccgagatcgaccgggtggctaaactctaccggcttgatacctacccgcaccaaatcgaagtgattacctctgaacagatgatggatgcctactccagcgtcggcatgccaatcaactattcacactggtcattcggcaaaaagtttatcgagaccgagcagcgctataagcatggtcagcagggtctggcctatgagattgtcatcaactctaatccctgcatcgcctacctgatggaagagaacaccatgaccatgcaggcgctggtgatggcgcatgcctgctatggccacaactctttctttaaaaataactatctgttccgcagctggacggatgccgggtcgattgtcgattacctgttgttcgccaaaaactatatcagtgactgcgaagagcgctatggcgtcgaagaggtagagcggctgctggactcctgccatgccttaatgaattatggcgtcgatcgctataagcgcccgcagaagatctctctgcaggaggagaaggcgcggcagaaaagccgtgaggagtatctgcaaagtcaggtgaacaccctgtggcgaacgctgccacggcgtgagaaagaggccgtcacctttgaagccgcgcgctacccctctgagccgcaggaaaacctgctctattttatggagaaaaacgccccgctgctggagtcatggcagcgtgagatcctgcgcattgtgcgcaaggtaagccagtatttctatccgcagaaacagacccaggtaatgaatgaaggctgggcgacattctggcactacaccatcctcaatcacctctatgatgaaggcaaagtgtcggaacgctttatgatggagtttcctgcacagccacaccaacgtcgtgtttcagccgccctataacagtcagtggtataacggcatcaacccctatgctttagggttcgcgatgatgcaggatatcaagcgtatctgtcagtcgccgaccgaggaagatcgctactggttcccggatatcgccggttccgactggctggaaacgctgcattttgcgatgcgcgagttcaaggatgagagttttatcagccagttcctgtcgccgaaagtcatgcgtgatttccgtctgtttaccgtactggatgatgaccgcaacaattatctcgaaatcgccgcgatccacgatgaggcaggctaccgggcaattcgccagcagctctctgcgcagtacaacctgagtaatctcgaaccgaatattcaggtctataacgtcgatctgcgcggtgaccgttcgctgaccctgcgttatgtgccgcagagccgcacgccgctggataagagccgtcgcgaggtgctgaagcatgtacatcgtctgtggggatttgatgtgattctggaacagcagaacgaggatggcagcgtagagctgctggatcgtaatccaccacgcggttcatcactctgatgggataaaaacaaaaaaccggacgcgatgtccggttttttttaacgcttactgcctagatcgtcgggcagattcttctgcatactgtgccagatttcaccgctgcggcggccgtagttgcgcaccacgtccacaatctcatcctgtccgggctctttgtcgcacagttccagcagtttcagatagaaatcgcgcgcgacctgacgggcttccggattagagaagtagtggcggccaacacgggtatagagccctttcaggccattcagaatcagaccgtaaatcgggttacctgacgcaaacgccagaccgcggaacacccggtagtcgagctcggtataggcatcagcctgatcggcagccgcgctgaccgtttccagcacttcgcgtgctttgtccggatgatggcgcagcgcccggctgataaagatcgatgaaatattgctgcgtaccgacagcaggttgtcgatcagcaccggaacgctgtcgtgatcgagacgggccagcgtttccagaatattcaggccggacgtctcccagaaatcgttcacccgcgtcggtttaccgtgctgaatagtcagccagccatcgcgcgccaggcgctgcagcacttcacgcaaggtggtgcgcgtcaccccaatcaattcagaaagctcacgctcagcaggaagaatcgaccctggcggaaagcgactgttccagatgctttcaataatatactcttcagcaaatcccgctggactctgagcctttataaccatagcaatgtgttctcgttgcttttctaatcatgatgggcactcatcataccagacgccctatagcggatatagcctgcgtaaccattaaaaccgggcgcaggcgcatatttcagcatggctgaccgcagtatcagcggcttcgggatcacgggcgggctgaatggctttctgcgctgaaatggcgcgtgccacagcaccgctgagtgtcagcgttcagccaccctgaaagcgcaggactttgacagcatataacccgcgcctgccgtttcgcctcctgccgcatgcgatcgcccctgtcgccactgcggctctccccgctcttcactgacggtcgttctgcagataaggtccggcttatcctcatttaacctgctctggatcagaatcaggtcatgtttgcacacgatttttccctgcccctggctggtttgcaaacgcttttggtttacactgcgtggcattaacgtttacagggaatgcaatatgttgcgatatctgaatcaatgctcacgtggtcgcggagcctggttactactggcactgactgcacttgcactggaattaacagcactcttttttcagcacgtaatgggcctgaagccctgcgtgatgtgtatttatgagcgcaatgcgctgtttggtgtgctgggcgcgggtctggttggtgcgattgcgccgaaatcgccgttgcgtctggcggcactggcgttgtggatctacagtgcctgggaaggtctgcgtctctcttatgaacataccatgattcagctgcaccctaaccccttcaccacctgtgattttgctgcccgcttccccagcggcttaccgctggataagtggctgccgtcggtgtttcttgccagcggtgactgtgcagaacgcagctggactttcctgacgctcagcatgccgcagtggatgattgtggtgttcgccggttatctgctggtcgcggcgctggtgctgatagcccagccgctgaaacctaaacgccgcgatctctttggtcgctgagatcaaaaaaggctgccactggcataatgctggtcagttaagcgacaggtgataacgcagtctggtgccgggcaggggctggcggtcctcgcgccgctgcgcggttccttcacttcattcctctgcctgacggaccgccggggatggcacatcctgtgccgccccgcctttcgcccgcgtcctgcgggctctcctggcagactcattctgttcagcgctgcggattgcctgcccctgcccggcaccagcctgctctgaaacttcagtgtgtattgttaaaaagggcacgagagtggaggcctgagcgcctctgctgctgaaagggctatccgcagcgctgaggcgtgacggtgggccagaagtccacgccgggaagcgtggacaggtcggggccggccagggagggccgatccccgaacggttcgtcggcacgacgtcaaagccgaaggtaccgcgtgagcggcgcgaggacggcccggcagcagcagaggtgcgcaggcacgcgctgcggcttgctcgcccggaaaaaaagctgccacgtttgaccgtgacagcctttacaaatctaatcttaactgaccagcattatgccactggcagtcttttttctgttccgattgatagcgcggcactcagccgttgcgatcggggcgatcaataatgtgatcttcccagtcccgcacttcactctcacgcaccgcaatataccgcaccgaaatacgctgcgcatgcatcgctgttttcgaaccggcccgcagcggatgccatacgggtaaatctttgccctcacccagcagccggtaggcgcaggtgcgcggcagccagttgaaggtcgtcagattttcgcgcgttaacttgatgcaatcctcttcaagctcgaagcggcgctcatagttgcggcactggcaggttttaatattgagctgatcacaggcgacattggtgaagtagatctcatcggtgtcggcgtcctgcaatttgttcaggcaacactgcccacaaccatcacacaaggattcccattcctcatcgctcatttgtgccaggcgtttttgttgccagaaaggggtgtcagtcatgatgatttgtccggattgtgcctaaaccgcaccttataaagcctatgcggcggtgatgcaagtttttagagtacgcgcgtgctgatgccgtgacccgccagtgaaacttccagctgatcacccgagcgcatcgggcctaccccttctggcgtaccggtcagaatcacatcgcctgcacgcagcgtaaagtagtggctcatatgggcaatcagcggcaggattttatgaatcatgtcttcggtgttgccgtgctgacgcacttcaccgttcaccagcaatttaagctcgacgttctgcggatcgccactgaattccgtcaccgggataaaaccagagacaggacaggcgttatcaaagcctttggatttttcccacggctggcccgcttttttcagcccggcctgcaggtcacgcagtgtcagatccagcgccacgccataacctgcaatcgccttagccacatgcgcatcggtcgcctgcttcagtgtcgcgccgatcagcaccgccagttcaacttcatgatggacctcgccaaacgcgtcgggaatagagagcggctgacgcaaatcacacagcgccgtttccggcttgataaagatcaccggttcggttggggttgcgctgcccatctctttaatgtgctttgcataattactcccgacgcaaaccactttgctgaccggaaaatctaacagagcgccttgccagttacgatgctgatacatgctcatcccctgttcaggttaggtgtgatgccagcgctgctggcgggttgatgtttgctcatgcgttgatcgaaatgccaacctcatagcgtgataataagatccttttaacggtccggcgtgcgtaatttgtcagaaagcgtaaatgcaggggttgaagcgctgaataatcgtacaaatcgggagaaaaaattgagcagggaatttaaaaaggggtgaaacagataagctgcaccgttaattttgcgcagcatcagggcaatattatcctgccaggatcgcaccgacaggatttatatttacagaagaatccgagttaaagttttttatcggcctgtaaatgaatgttgaggagactttcaatcggcggagggagctgtaaataatagccctgctcgctcaatccctgcttaactttattgatatccgcattagccagcctgtcccgccccgccagcttaagcaccatcgccagctgcggcttgccaaagcctttcagcaattcttccggaacgcgcgagaaatcgtcctttttttcaacgtagagataagtctggtcacgtaacgggcttctgtagatcacacaaaacatattttttactcgaattaaccggcgttgaggcttgtctgaatatagctgtaactataacatgcttgcagaacttcgaatattcaccgttagcgcttcaacgatgattttatcatcgccaggctttcggtagtgaaaacaggactgagtcgggacagatgtcgcaaacgccaatcgaattcaaaggtagcagtttcaccctgtctgtcgtccatttgcatcaccatgaccctgcggtgattcgcaaggcactccaggtcaagattgaccaggctccagatttcctgaaaaacgcgccggtggtacttaacgtctcgacattaagtgccgatgttaactggaaactgttgcaacaggcggtttctcgccaccggtttacgcattgtcggcgtaagcggctgcaaagatgaagcgctgaaacgtatgatcgcccgtgccggcctgcccgtgctggcagaaggtaaagaggccagaccgcaagccgccgcgccgcagccgatacctgaacctctgccggctgtaaccgaaacggtagcaacgaaaacccgcatcgtgaacaccccggtgcgctcgggccagcagatttatgcgcgtgacgccgatttgatcatcaccagcagcgtcagcgccggcgccgaactggtcgccgatggcaatattcacatttacggcatgatgcgcggtcgcgccctggcgggtgccagcggtgaccgcaactgccagattttttgtaccaacctggctgccgagctggtctcgattgccggagagtactggatcatggatcagatcccgcaagaattttttggtaaagctgcgcgcctgtgcctgcaggatggcgcgctgactatccagacacttaattaggccccttttcttttgttaaggaaatcaacatttatggcacgcattattgtagttacatccggtaaagggggcgttggtaagaccacgtcaagcgcggccatcgccaccggtttagcgcagaaaggcaaaaagacagttgtgatcgactttgatatcggtctgcgtaacctggatttgatcatgggctgtgagcgccgtgtggtctacgactttgttaatgtaatccagggcgatgccacactgaaccaggcgctgattcgcgacaaacgcacggagcagctctacattctgcctgcgtcgcagacccgtgataaagatgcgctgacccgtgagggtgttgaaaaagttctgaacgatttggctaagatggagttcgatttcatcgtctgtgactcaccggcagggattgaaacgggcgcactgatggcgctctactttgccgatgaagccattattaccaccaacccggaagtctcttctgtccgcgactccgaccgcatcctcggcatcatctcatccaaatcccgtcgcgctgaaaacagtcaggacccggtgaaggagcatctgctgctgacccgctataaccctggccgggtgaaccgtggcgatatgctgagcatggaagatgtgctggagatcctgcgcattcctctggtcggcgtgatccctgaagatcaatcggtgttacgtgcctctaaccagggcgaaccggtgattcttgacggcgaatctgatgctggcaaagcctatgccgataccgttgaacggttgctcg
